United States Patent 9,782,462 (MODIFIED POLYNUCLEOTIDES FOR THE PRODUCTION OF PROTEINS ASSOCIATED WITH HUMAN DISEASE) - sequence listing, part 44

SEQ ID NO: 81143 - DNA, 717 bp, Artificial Sequence
  Description of Artificial Sequence: Synthetic coding sequence
atgggcgtgcagggcttccaggagttcctggagaagagatgccccggcgccgtggtgcccgtggacctgctgaagctggccagaaccgtgagcagacagcagcagcagcagcacctgcacagacagctgccccccaccgccgccctggcccccggcgcccccagagccgccagaggcagcgtgcccctgcagccccccctgccccccgccgccctgggcgcctacagcggcggcgccggccccatcagacaccaccaccccgcccaccacttccaccaccacggccaggcccagcccggcctgcacccccccctgcccccccccccccccccccagctgcccggcgccagagtgctggtggacgccggcagcgccctgcccagactgtacggcggctaccagaccgactgggtgtgcggcggccagtggaacgccatgctgggctacctgagcgccctgtgccaggcctgcgcctaccccggcggcgacggcctggagctggtggtgatgttccccggcggcctgggcaaggacagactggccgagtggggcagaagatgccaggccgagagacagaccgcccagctgatcgtgggccacgtgggcaacaagggcacccccccccccagagcctggttcctgccccccgcctgcctgagccactgcgtgagactggccctgatcagattcagagtgaagcaggccgccatgctgtag

SEQ ID NO: 81144 - DNA, 3408 bp, Artificial Sequence
  Description of Artificial Sequence: Synthetic coding sequence
atggagacccagaaggacgaggccgcccaggccaagggcgccgccgccagcggcagcaccagagagcagaccgccgagaagggcgccaagaacaaggccgccgaggccaccgagggccccaccagcgagcccagcagcagcggccccggcagactgaagaagaccgccatgaagctgttcggcggcaagaagggcatctgcaccctgcccagcttcttcggcggcggcagaagcaagggcagcggcaagggcagcagcaagaagggcctgagcaagagcaagacccacgacggcctgagcgaggccgcccacggccccgaggacgtggtgagcgagggcaccggcttcagcctgcccctgcccgagctgccctgccagttccccagcagccagagcgcccacggcgccctggagaccggcagcagatgcaagaccagcgtggccggcgccaccgagaaggccgtggccgagaagttccccagcatgcccaagcccaagaagggcctgaagggcttcttcagcagcatcagaagacacagaaagagcaaggtgaccggcgccgagcagagcgagcccggcgccaagggccccgagagagtgagagccagaccccacgagcacgtgagcagcgccccccaggtgccctgcttcgaggagaccttccaggcccccagaaaggagaacgccaacccccaggacgcccccggccccaaggtgagccccacccccgagcccagcccccccgccaccgagaagatggcctgcaaggaccccgagaagcccatggaggcctgcgccagcgcccacgtgcagcccaagcccgcccccgaggccagcagcctggaggagccccacagccccgagaccggcgagaaggtggtggccggcgaggtgaacccccccaacggccccgtgggcgaccccctgagcctgctgttcggcgacgtgaccagcctgaagagcttcgacagcctgaccggctgcggcgacatcatcgccgagcaggacatggacagcatgaccgacagcatggccagcggcggccagagagccaacagagacggcaccaagagaagcagctgcctggtgacctaccagggcggcggcgaggagatggccctgcccgacgacgacgacgaggaggaggaggaggaggaggaggtggagctggaggaggaggaggaggaggtgaaggaggaggaggaggacgacgacctggagtacctgtgggagaccgcccagatgtaccccagacccaacatgaacctgggctaccaccccaccaccagccccggccaccacggctacatgctgctggaccccgtgagaagctaccccggcctggcccccggcgagctgctgaccccccagagcgaccagcaggagagcgcccccaacagcgacgagggctactacgacagcaccacccccggcttcgaggacgacagcggcgaggccctgggcctggtgagaagagactgcctgcccagagacagctacagcggcgacgccctgtacgagttctacgagcccgacgacagcctggagaacagcccccccggcgacgactgcctgtacgacctgcacggcagaagcagcgagatgttcgaccccttcctgaacttcgagcccttcctgagcagcagaccccccggcgccatggagaccgaggaggagagactggtgaccatccagaagcagctgctgtactgggagctgagaagagagcagctggaggcccaggaggccagagccagagaggcccacgccagagaggcccacgccagagaggcctacaccagagaggcctacggcagagaggcctacgccagagaggcccacacctgggaggcccacggcagagaggccagaaccagagaggcccaggccagagaggtgagatgcagagagacccaggtgagagagacccaggccagacaggagaagcccgtgctggagtaccagatgagacccctgggccccagcgtgatgggcctggccgccggcgtgagcggcaccagccagatcagccacagaggcatcaccagcgccttccccaccaccgccagcagcgagcccgactggagagacttcagacccctggagaagagatacgagggcacctgcagcaagaaggaccagagcacctgcctgatgcagctgttccagagcgacgccatgttcgagcccgacatgcaggaggccaacttcggcggcagccccagaagagcctaccccacctacagcccccccgaggaccccgaggaggaggaggtggagaaggagggcaacgccaccgtgagcttcagccaggccctggtggagttcaccagcaacggcaacctgttcagcagcatgagctgcagcagcgacagcgacagcagcttcacccagaacctgcccgagctgccccccatggtgaccttcgacatcgccgacgtggagagagacggcgagggcaagtgcgaggagaaccccgagttccacaacgacgaggacctggccgccagcctggaggccttcgagctgggctactaccacaagcacgccttcaacaactaccacagcagattctaccagggcctgccctggggcgtgagcagcctgcccagatacctgggcctgcccggcctgcaccccagacccccccccgccgccatggccctgaacagaagaagcagaagcctggacaccgccgagaccctggagatggagctgagcaacagccacctggtgcagggctacctggagagcgacgagctgcaggcccagcaggaggacagcgacgaggaggacgaggaggaggaggagggcgagtggagcagagacagccccctgagcctgtacaccgagccccccggcgcctacgactggcccgcctgggccccctgccccctgcccgtgggccccggccccgcctggatcagccccaaccagctggacagacccagcagccagagcccctacagacaggccacctgctgcatcccccccatgaccatgagcatcagcctgagcgtgcccgagagcagagcccccggcgagagcggcccccagctggccagacccagccacctgcacctgcccatgggcccctgctacaacctgcagccccaggccagccagagcatgagagccagacccagagacgtgctgctgcccgtggacgagcccagctgcagcagcagcagcggcggcttcagccccagccccctgccccaggccaagcccgtgggcatcacccacggcatcccccagctgcccagagtgagacccgagcacccccagccccagcccacccactacggccccagcagcctggacctgagcaaggagagagccgagcagggcgccagcctggccaccagctacagcagcaccgccatgaacggcaacctggccaagtag

SEQ ID NO: 81145 - DNA, 2415 bp, Artificial Sequence
  Description of Artificial Sequence: Synthetic coding sequence
atggagacccagaaggacgaggccgcccaggccaagggcgccgccgccagcggcagcaccagagagcagaccgccgagaagggcgccaagaacaaggccgccgaggccaccgagggccccaccagcgagcccagcagcagcggccccggcagactgaagaagaccgccatgaagctgttcggcggcaagaagggcatctgcaccctgcccagcttcttcggcggcggcagaagcaagggcagcggcaagggcagcagcaagaagggcctgagcaagagcaagacccacgacggcctgagcgaggccgcccacggccccgaggacgtggtgagcgagggcaccggcttcagcctgcccctgcccgagctgccctgccagttccccagcagccagagcgcccacggcgccctggagaccggcagcagatgcaagaccagcgtggccggcgccaccgagaaggccgtggccgagaagttccccagcatgcccaagcccaagaagggcctgaagggcttcttcagcagcatcagaagacacagaaagagcaaggtgaccggcgccgagcagagcgagcccggcgccaagggccccgagagagtgagagccagaccccacgagcacgtgagcagcgccccccaggtgccctgcttcgaggagaccttccaggcccccagaaaggagaacgccaacccccaggacgcccccggccccaaggtgagccccacccccgagcccagcccccccgccaccgagaagatggcctgcaaggaccccgagaagcccatggaggcctgcgccagcgcccacgtgcagcccaagcccgcccccgaggccagcagcctggaggagccccacagccccgagaccggcgagaaggtggtggccggcgaggtgaacccccccaacggccccgtgggcgaccccctgagcctgctgttcggcgacgtgaccagcctgaagagcttcgacagcctgaccggctgcggcgacatcatcgccgagcaggacatggacagcatgaccgacagcatggccagcggcggccagagagccaacagagacggcaccaagagaagcagctgcctggtgacctaccagggcggcggcgaggagatggccctgcccgacgacgacgacgaggaggaggaggaggaggaggaggtggagctggaggaggaggaggaggaggtgaaggaggaggaggaggacgacgacctggagtacctgtgggagaccgcccagatgtaccccagacccaacatgaacctgggctaccaccccaccaccagccccggccaccacggctacatgctgctggaccccgtgagaagctaccccggcctggcccccggcgagctgctgaccccccagagcgaccagcaggagagcgcccccaacagcgacgagggctactacgacagcaccacccccggcttcgaggacgacagcggcgaggccctgggcctggtgagaagagactgcctgcccagagacagctacagcggcgacgccctgtacgagttctacgagcccgacgacagcctggagaacagcccccccggcgacgactgcctgtacgacctgcacggcagaagcagcgagatgttcgaccccttcctgaacttcgagcccttcctgagcagcagaccccccggcgccatggagaccgaggaggagagactggtgaccatccagaagcagctgctgtactgggagctgagaagagagcagctggaggcccaggaggccagagccagagaggcccacgccagagaggcccacgccagagaggcctacaccagagaggcctacggcagagaggcctacgccagagaggcccacacctgggaggcccacggcagagaggccagaaccagagaggcccaggccagagaggtgagatgcagagagacccaggtgagagagacccaggccagacaggagaagcccgtgctggagtaccagatgagacccctgggccccagcgtgatgggcctggccgccggcgtgagcggcaccagccagatcagccacagaggcatcaccagcgccttccccaccaccgccagcagcgagcccgactggagagacttcagacccctggagaagagatacgagggcacctgcagcaagaaggaccagagcacctgcctgatgcagctgttccagagcgacgccatgttcgagcccgacatgcaggaggccaacttcggcggcagccccagaagagcctaccccacctacagcccccccgaggaccccgaggaggaggaggtggagaaggagggcaacgccaccgtgagcttcagccaggccctggtggagttcaccagcaacggcaacctgttcagcagcatcagatgccccggcaccgaggacaagagacaggtgacccaggcctgcggcacctggtag

SEQ ID NO: 81146 - DNA, 1566 bp, Artificial Sequence
  Description of Artificial Sequence: Synthetic coding sequence
atgttcaccagcgagaagggcgtggtggaggagtggctgagcgagttcaagaccctgcccgagaccagcctgcccaactacgccaccaacctgaaggacaagagcagcctggtgagcagcctgtacaaggtgatccaggagccccagagcgagctgctggagcccgtgtgccaccagctgttcgagttctacagaagcggcgaggagcagctgctgcagttcaccctgcagttcctgcccgagctgatctggtgctacctggccgtgagcgccagcagaaacgtgcacagcagcggctgcatcgaggccctgctgctgggcgtgtacaacctggagatcgtggacaagcagggccacaccaaggtgctgagcttcaccatccccagcctgagcaagcccagcgtgtaccacgagcccagcagcatcggcagcatggccctgaccgagagcgccctgagccagcacggcctgagcaaggtggtgtacagcggcccccacccccagagagagatgctgaccgcccagaacagattcgaggtgctgaccttcctgctgctgtgctacaacgccgccctgacctacatgcccagcgtgagcctgcagagcctgtgccagatctgcagcagaatctgcgtgtgcggctaccccagacagcacgtgagaaagtacaagggcatcagcagcagaatccccgtgagcagcggcttcatggtgcagatgctgaccggcatctacttcgccttctacaacggcgagtgggacctggcccagaaggccctggacgacatcatctacagagcccagctggagctgtaccccgagcccctgctggtggccaacgccatcaaggccagcctgccccacggccccatgaagagcaacaaggagggcaccagatgcatccaggtggagatcacccccaccagcagcagaatcagcagaaacgccgtgaccagcatgagcatcagaggccacagatggaagagacacggcaacaccgagctgaccggccaggaggagctgatggagatcagcgaggtggacgagggcttctacagcagagccgccagcagcaccagccagagcggcctgagcaacagcagccacaactgcagcaacaagcccagcatcggcaagaaccacagaagaagcggcggcagcaagaccggcggcaaggagaaggagaccaccggcgagagctgcaaggaccacttcgccagaaagcagacccagagagcccagagcgagaacctggagctgctgagcctgaagagactgaccctgaccaccagccagagcctgcccaagcccagcagccacggcctggccaagaccgccgccaccgtgttcagcaagagcttcgagcaggtgagcggcgtgaccgtgccccacaaccccagcagcgccgtgggctgcggcgccggcaccgacgccaacagattcagcgcctgcagcctgcaggaggagaagctgatctacgtgagcgagagaaccgagctgcccatgaagcaccagagcggccagcagagaccccccagcatcagcatcaccctgagcaccgactag

SEQ ID NO: 81147 - DNA, 342 bp, Artificial Sequence
  Description of Artificial Sequence: Synthetic coding sequence
atggacggcagagtgcagctgatcaaggccctgctggccctgcccatcagacccgccaccagaagatggagaaaccccatccccttccccgagaccttcgacggcgacaccgacagactgcccgagttcatcgtgcagaccggcagctacatgttcgtggacgagaacaccttcagcagcgacgccctgaaggtgaccttcctgatcaccagactgaccggccccgccctgcagtgggtgatcccctacatcaagaaggagagccccctgctgaacgactacagaggcttcctggccgagatgaagagagtgttcggctgggaggaggacgaggacttctag

SEQ ID NO: 81148 - DNA, 2241 bp, Artificial Sequence
  Description of Artificial Sequence: Synthetic coding sequence
atgggcgacgtgctgagcacccacctggacgacgccagaagacagcacatcgccgagaagaccggcaagatcctgaccgagttcctgcagttctacgaggaccagtacggcgtggccctgttcaacagcatgagacacgagatcgagggcaccggcctgccccaggcccagctgctgtggagaaaggtgcccctggacgagagaatcgtgttcagcggcaacctgttccagcaccaggaggacagcaagaagtggagaaacagattcagcctggtgccccacaactacggcctggtgctgtacgagaacaaggccgcctacgagagacaggtgccccccagagccgtgatcaacagcgccggctacaagatcctgaccagcgtggaccagtacctggagctgatcggcaacagcctgcccggcaccaccgccaagagcggcagcgcccccatcctgaagtgccccacccagttccccctgatcctgtggcacccctacgccagacactactacttctgcatgatgaccgaggccgagcaggacaagtggcaggccgtgctgcaggactgcatcagacactgcaacaacggcatccccgaggacagcaaggtggagggccccgccttcaccgacgccatcagaatgtacagacagagcaaggagctgtacggcacctgggagatgctgtgcggcaacgaggtgcagatcctgagcaacctggtgatggaggagctgggccccgagctgaaggccgagctgggccccagactgaagggcaagccccaggagagacagagacagtggatccagatcagcgacgccgtgtaccacatggtgtacgagcaggccaaggccagattcgaggaggtgctgagcaaggtgcagcaggtgcagcccgccatgcaggccgtgatcagaaccgacatggaccagatcatcaccagcaaggagcacctggccagcaagatcagagccttcatcctgcccaaggccgaggtgtgcgtgagaaaccacgtgcagccctacatccccagcatcctggaggccctgatggtgcccaccagccagggcttcaccgaggtgagagacgtgttcttcaaggaggtgaccgacatgaacctgaacgtgatcaacgagggcggcatcgacaagctgggcgagtacatggagaagctgagcagactggcctaccaccccctgaagatgcagagctgctacgagaagatggagagcctgagactggacggcctgcagcagagattcgacgtgagcagcaccagcgtgttcaagcagagagcccagatccacatgagagagcagatggacaacgccgtgtacaccttcgagaccctgctgcaccaggagctgggcaagggccccaccaaggaggagctgtgcaagagcatccagagagtgctggagagagtgctgaagaagtacgactacgacagcagcagcgtgagaaagagattcttcagagaggccctgctgcagatcagcatccccttcctgctgaagaagctggcccccacctgcaagagcgagctgcccagattccaggagctgatcttcgaggacttcgccagattcatcctggtggagaacacctacgaggaggtggtgctgcagaccgtgatgaaggacatcctgcaggccgtgaaggaggccgccgtgcagagaaagcacaacctgtacagagacagcatggtgatgcacaacagcgaccccaacctgcacctgctggccgagggcgcccccatcgactggggcgaggagtacagcaacagcggcggcggcggcagccccagccccagcacccccgagagcgccaccctgagcgagaagagaagaagagccaagcaggtggtgagcgtggtgcaggacgaggaggtgggcctgcccttcgaggccagccccgagagccccccccccgccagccccgacggcgtgaccgagatcagaggcctgctggcccagggcctgagacccgagagccccccccccgccggccccctgctgaacggcgcccccgccggcgagagcccccagcccaaggccgcccccgaggccagcagcccccccgccagccccctgcagcacctgctgcccggcaaggccgtggacctgggcccccccaagcccagcgaccaggagaccggcgagcaggtgagcagccccagcagccaccccgccctgcacaccaccaccgaggacagcgccggcgtgcagaccgagttctag

SEQ ID NO: 81149 - DNA, 2202 bp, Artificial Sequence
  Description of Artificial Sequence: Synthetic coding sequence
atgggctggatgggcgagaagaccggcaagatcctgaccgagttcctgcagttctacgaggaccagtacggcgtggccctgttcaacagcatgagacacgagatcgagggcaccggcctgccccaggcccagctgctgtggagaaaggtgcccctggacgagagaatcgtgttcagcggcaacctgttccagcaccaggaggacagcaagaagtggagaaacagattcagcctggtgccccacaactacggcctggtgctgtacgagaacaaggccgcctacgagagacaggtgccccccagagccgtgatcaacagcgccggctacaagatcctgaccagcgtggaccagtacctggagctgatcggcaacagcctgcccggcaccaccgccaagagcggcagcgcccccatcctgaagtgccccacccagttccccctgatcctgtggcacccctacgccagacactactacttctgcatgatgaccgaggccgagcaggacaagtggcaggccgtgctgcaggactgcatcagacactgcaacaacggcatccccgaggacagcaaggtggagggccccgccttcaccgacgccatcagaatgtacagacagagcaaggagctgtacggcacctgggagatgctgtgcggcaacgaggtgcagatcctgagcaacctggtgatggaggagctgggccccgagctgaaggccgagctgggccccagactgaagggcaagccccaggagagacagagacagtggatccagatcagcgacgccgtgtaccacatggtgtacgagcaggccaaggccagattcgaggaggtgctgagcaaggtgcagcaggtgcagcccgccatgcaggccgtgatcagaaccgacatggaccagatcatcaccagcaaggagcacctggccagcaagatcagagccttcatcctgcccaaggccgaggtgtgcgtgagaaaccacgtgcagccctacatccccagcatcctggaggccctgatggtgcccaccagccagggcttcaccgaggtgagagacgtgttcttcaaggaggtgaccgacatgaacctgaacgtgatcaacgagggcggcatcgacaagctgggcgagtacatggagaagctgagcagactggcctaccaccccctgaagatgcagagctgctacgagaagatggagagcctgagactggacggcctgcagcagagattcgacgtgagcagcaccagcgtgttcaagcagagagcccagatccacatgagagagcagatggacaacgccgtgtacaccttcgagaccctgctgcaccaggagctgggcaagggccccaccaaggaggagctgtgcaagagcatccagagagtgctggagagagtgctgaagaagtacgactacgacagcagcagcgtgagaaagagattcttcagagaggccctgctgcagatcagcatccccttcctgctgaagaagctggcccccacctgcaagagcgagctgcccagattccaggagctgatcttcgaggacttcgccagattcatcctggtggagaacacctacgaggaggtggtgctgcagaccgtgatgaaggacatcctgcaggccgtgaaggaggccgccgtgcagagaaagcacaacctgtacagagacagcatggtgatgcacaacagcgaccccaacctgcacctgctggccgagggcgcccccatcgactggggcgaggagtacagcaacagcggcggcggcggcagccccagccccagcacccccgagagcgccaccctgagcgagaagagaagaagagccaagcaggtggtgagcgtggtgcaggacgaggaggtgggcctgcccttcgaggccagccccgagagccccccccccgccagccccgacggcgtgaccgagatcagaggcctgctggcccagggcctgagacccgagagccccccccccgccggccccctgctgaacggcgcccccgccggcgagagcccccagcccaaggccgcccccgaggccagcagcccccccgccagccccctgcagcacctgctgcccggcaaggccgtggacctgggcccccccaagcccagcgaccaggagaccggcgagcaggtgagcagccccagcagccaccccgccctgcacaccaccaccgaggacagcgccggcgtgcagaccgagttctag

SEQ ID NO: 81150 - DNA, 1191 bp, Artificial Sequence
  Description of Artificial Sequence: Synthetic coding sequence
atggtgcccaccagccagggcttcaccgaggtgagagacgtgttcttcaaggaggtgaccgacatgaacctgaacgtgatcaacgagggcggcatcgacaagctgggcgagtacatggagaagctgagcagactggcctaccaccccctgaagatgcagagctgctacgagaagatggagagcctgagactggacggcctgcagcagagattcgacgtgagcagcaccagcgtgttcaagcagagagcccagatccacatgagagagcagatggacaacgccgtgtacaccttcgagaccctgctgcaccaggagctgggcaagggccccaccaaggaggagctgtgcaagagcatccagagagtgctggagagagtgctgaagaagtacgactacgacagcagcagcgtgagaaagagattcttcagagaggccctgctgcagatcagcatccccttcctgctgaagaagctggcccccacctgcaagagcgagctgcccagattccaggagctgatcttcgaggacttcgccagattcatcctggtggagaacacctacgaggaggtggtgctgcagaccgtgatgaaggacatcctgcaggccgtgaaggaggccgccgtgcagagaaagcacaacctgtacagagacagcatggtgatgcacaacagcgaccccaacctgcacctgctggccgagggcgcccccatcgactggggcgaggagtacagcaacagcggcggcggcggcagccccagccccagcacccccgagagcgccaccctgagcgagaagagaagaagagccaagcaggtggtgagcgtggtgcaggacgaggaggtgggcctgcccttcgaggccagccccgagagccccccccccgccagccccgacggcgtgaccgagatcagaggcctgctggcccagggcctgagacccgagagccccccccccgccggccccctgctgaacggcgcccccgccggcgagagcccccagcccaaggccgcccccgaggccagcagcccccccgccagccccctgcagcacctgctgcccggcaaggccgtggacctgggcccccccaagcccagcgaccaggagaccggcgagcaggtgagcagccccagcagccaccccgccctgcacaccaccaccgaggacagcgccggcgtgcagaccgagttctag

SEQ ID NO: 81151 - DNA, 3072 bp, Artificial Sequence
  Description of Artificial Sequence: Synthetic coding sequence
atgggcgccggcgccctggccatctgccagagcaaggccgccgtgagactgaaggaggacatgaagaagatcgtggccgtgcccctgaacgagcagaaggacttcacctaccagaagctgttcggcgtgagcctgcaggagctggagagacagggcctgaccgagaacggcatccccgccgtggtgtggaacatcgtggagtacctgacccagcacggcctgacccaggagggcctgttcagagtgaacggcaacgtgaaggtggtggagcagctgagactgaagttcgagagcggcgtgcccgtggagctgggcaaggacggcgacgtgtgcagcgccgccagcctgctgaagctgttcctgagagagctgcccgacagcctgatcaccagcgccctgcagcccagattcatccagctgttccaggacggcagaaacgacgtgcaggagagcagcctgagagacctgatcaaggagctgcccgacacccactactgcctgctgaagtacctgtgccagttcctgaccaaggtggccaagcaccacgtgcagaacagaatgaacgtgcacaacctggccaccgtgttcggccccaactgcttccacgtgccccccggcctggagggcatgaaggagcaggacctgtgcaacaagatcatggccaagatcctggagaactacaacaccctgttcgaggtggagtacaccgagaacgaccacctgagatgcgagaacctggccagactgatcatcgtgaaggaggtgtactacaagaacagcctgcccatcctgctgaccagaggcctggagagagacatgcccaagcccccccccaagaccaagatccccaagagcagaagcgagggcagcatccaggcccacagagtgctgcagcccgagctgagcgacggcatcccccagctgagcctgagactgagctacagaaaggcctgcctggaggacatgaacagcgccgagggcgccatcagcgccaagctggtgcccagcagccaggaggacgagagacccctgagccccttctacctgagcgcccacgtgccccaggtgagcaacgtgagcgccaccggcgagctgctggagagaaccatcagaagcgccgtggagcagcacctgttcgacgtgaacaacagcggcggccagagcagcgaggacagcgagagcggcaccctgagcgccagcagcgccaccagcgccagacagagaagaagacagagcaaggagcaggacgaggtgagacacggcagagacaagggcctgatcaacaaggagaacacccccagcggcttcaaccacctggacgactgcatcctgaacacccaggaggtggagaaggtgcacaagaacaccttcggctgcgccggcgagagaagcaagcccaagagacagaagagcagcaccaagctgagcgagctgcacgacaaccaggacggcctggtgaacatggagagcctgaacagcaccagaagccacgagagaaccggccccgacgacttcgagtggatgagcgacgagagaaagggcaacgagaaggacggcggccacacccagcacttcgagagccccaccatgaagatccaggagcaccccagcctgagcgacaccaagcagcagagaaaccaggacgccggcgaccaggaggagagcttcgtgagcgaggtgccccagagcgacctgaccgccctgtgcgacgagaagaactgggaggagcccatccccgccttcagcagctggcagagagagaacagcgacagcgacgaggcccacctgagcccccaggccggcagactgatcagacagctgctggacgaggacagcgaccccatgctgagccccagattctacgcctacggccagagcagacagtacctggacgacaccgaggtgccccccagcccccccaacagccacagcttcatgagaagaagaagcagcagcctgggcagctacgacgacgagcaggaggacctgacccccgcccagctgaccagaagaatccagagcctgaagaagaagatcagaaagttcgaggacagattcgaggaggagaagaagtacagacccagccacagcgacaaggccgccaaccccgaggtgctgaagtggaccaacgacctggccaagttcagaagacagctgaaggagagcaagctgaagatcagcgaggaggacctgacccccagaatgagacagagaagcaacaccctgcccaagagcttcggcagccagctggagaaggaggacgagaagaagcaggagctggtggacaaggccatcaagcccagcgtggaggccaccctggagagcatccagagaaagctgcaggagaagagagccgagagcagcagacccgaggacatcaaggacatgaccaaggaccagatcgccaacgagaaggtggccctgcagaaggccctgctgtactacgagagcatccacggcagacccgtgaccaagaacgagagacaggtgatgaagcccctgtacgacagatacagactggtgaagcagatcctgagcagagccaacaccatccccatcatcggcagccccagcagcaagagaagaagccccctgctgcagcccatcatcgagggcgagaccgccagcttcttcaaggagatcaaggaggaggaggagggcagcgaggacgacagcaacgtgaagcccgacttcatggtgaccctgaagaccgacttcagcgccagatgcttcctggaccagttcgaggacgacgccgacggcttcatcagccccatggacgacaagatccccagcaagtgcagccaggacaccggcctgagcaacctgcacgccgccagcatccccgagctgctggagcacctgcaggagatgagagaggagaagaagagaatcagaaagaagctgagagacttcgaggacaacttcttcagacagaacggcagaaacgtgcagaaggaggacagaacccccatggccgaggagtacagcgagtacaagcacatcaaggccaagctgagactgctggaggtgctgatcagcaagagagacaccgacagcaagagcatgtag

SEQ ID NO: 81152 - DNA, 2010 bp, Artificial Sequence
  Description of Artificial Sequence: Synthetic coding sequence
atggcctgcgagatcatgcccctgcagagcagccaggaggacgagagacccctgagccccttctacctgagcgcccacgtgccccaggtgagcaacgtgagcgccaccggcgagctgctggagagaaccatcagaagcgccgtggagcagcacctgttcgacgtgaacaacagcggcggccagagcagcgaggacagcgagagcggcaccctgagcgccagcagcgccaccagcgccagacagagaagaagacagagcaaggagcaggacgaggtgagacacggcagagacaagggcctgatcaacaaggagaacacccccagcggcttcaaccacctggacgactgcatcctgaacacccaggaggtggagaaggtgcacaagaacaccttcggctgcgccggcgagagaagcaagcccaagagacagaagagcagcaccaagctgagcgagctgcacgacaaccaggacggcctggtgaacatggagagcctgaacagcaccagaagccacgagagaaccggccccgacgacttcgagtggatgagcgacgagagaaagggcaacgagaaggacggcggccacacccagcacttcgagagccccaccatgaagatccaggagcaccccagcctgagcgacaccaagcagcagagaaaccaggacgccggcgaccaggaggagagcttcgtgagcgaggtgccccagagcgacctgaccgccctgtgcgacgagaagaactgggaggagcccatccccgccttcagcagctggcagagagagaacagcgacagcgacgaggcccacctgagcccccaggccggcagactgatcagacagctgctggacgaggacagcgaccccatgctgagccccagattctacgcctacggccagagcagacagtacctggacgacaccgaggtgccccccagcccccccaacagccacagcttcatgagaagaagaagcagcagcctgggcagctacgacgacgagcaggaggacctgacccccgcccagctgaccagaagaatccagagcctgaagaagaagatcagaaagttcgaggacagattcgaggaggagaagaagtacagacccagccacagcgacaaggccgccaaccccgaggtgctgaagtggaccaacgacctggccaagttcagaagacagctgaaggagagcaagctgaagatcagcgaggaggacctgacccccagaatgagacagagaagcaacaccctgcccaagagcttcggcagccagctggagaaggaggacgagaagaagcaggagctggtggacaaggccatcaagcccagcgtggaggccaccctggagagcatccagagaaagctgcaggagaagagagccgagagcagcagacccgaggacatcaaggacatgaccaaggaccagatcgccaacgagaaggtggccctgcagaaggccctgctgtactacgagagcatccacggcagacccgtgaccaagaacgagagacaggtgatgaagcccctgtacgacagatacagactggtgaagcagatcctgagcagagccaacaccatccccatcatcgaggaggaggagggcagcgaggacgacagcaacgtgaagcccgacttcatggtgaccctgaagaccgacttcagcgccagatgcttcctggaccagttcgaggacgacgccgacggcttcatcagccccatggacgacaagatccccagcaagtgcagccaggacaccggcctgagcaacctgcacgccgccagcatccccgagctgctggagcacctgcaggagatgagagaggagaagaagagaatcagaaagaagctgagagacttcgaggacaacttcttcagacagaacggcagaaacgtgcagaaggaggacagaacccccatggccgaggagtacagcgagtacaagcacatcaaggccaagctgagactgctggaggtgctgatcagcaagagagacaccgacagcaagagcatgtag

SEQ ID NO: 81153 - DNA, 2094 bp, Artificial Sequence
  Description of Artificial Sequence: Synthetic coding sequence
atggcctgcgagatcatgcccctgcagagcagccaggaggacgagagacccctgagccccttctacctgagcgcccacgtgccccaggtgagcaacgtgagcgccaccggcgagctgctggagagaaccatcagaagcgccgtggagcagcacctgttcgacgtgaacaacagcggcggccagagcagcgaggacagcgagagcggcaccctgagcgccagcagcgccaccagcgccagacagagaagaagacagagcaaggagcaggacgaggtgagacacggcagagacaagggcctgatcaacaaggagaacacccccagcggcttcaaccacctggacgactgcatcctgaacacccaggaggtggagaaggtgcacaagaacaccttcggctgcgccggcgagagaagcaagcccaagagacagaagagcagcaccaagctgagcgagctgcacgacaaccaggacggcctggtgaacatggagagcctgaacagcaccagaagccacgagagaaccggccccgacgacttcgagtggatgagcgacgagagaaagggcaacgagaaggacggcggccacacccagcacttcgagagccccaccatgaagatccaggagcaccccagcctgagcgacaccaagcagcagagaaaccaggacgccggcgaccaggaggagagcttcgtgagcgaggtgccccagagcgacctgaccgccctgtgcgacgagaagaactgggaggagcccatccccgccttcagcagctggcagagagagaacagcgacagcgacgaggcccacctgagcccccaggccggcagactgatcagacagctgctggacgaggacagcgaccccatgctgagccccagattctacgcctacggccagagcagacagtacctggacgacaccgaggtgccccccagcccccccaacagccacagcttcatgagaagaagaagcagcagcctgggcagctacgacgacgagcaggaggacctgacccccgcccagctgaccagaagaatccagagcctgaagaagaagatcagaaagttcgaggacagattcgaggaggagaagaagtacagacccagccacagcgacaaggccgccaaccccgaggtgctgaagtggaccaacgacctggccaagttcagaagacagctgaaggagagcaagctgaagatcagcgaggaggacctgacccccagaatgagacagagaagcaacaccctgcccaagagcttcggcagccagctggagaaggaggacgagaagaagcaggagctggtggacaaggccatcaagcccagcgtggaggccaccctggagagcatccagagaaagctgcaggagaagagagccgagagcagcagacccgaggacatcaaggacatgaccaaggaccagatcgccaacgagaaggtggccctgcagaaggccctgctgtactacgagagcatccacggcagacccgtgaccaagaacgagagacaggtgatgaagcccctgtacgacagatacagactggtgaagcagatcctgagcagagccaacaccatccccatcatcggcagccccagcagcaagagaagaagccccctgctgcagcccatcatcgagggcgagaccgccagcttcttcaaggagatcaaggaggaggaggagggcagcgaggacgacagcaacgtgaagcccgacttcatggtgaccctgaagaccgacttcagcgccagatgcttcctggaccagttcgaggacgacgccgacggcttcatcagccccatggacgacaagatccccagcaagtgcagccaggacaccggcctgagcaacctgcacgccgccagcatccccgagctgctggagcacctgcaggagatgagagaggagaagaagagaatcagaaagaagctgagagacttcgaggacaacttcttcagacagaacggcagaaacgtgcagaaggaggacagaacccccatggccgaggagtacagcgagtacaagcacatcaaggccaagctgagactgctggaggtgctgatcagcaagagagacaccgacagcaagagcatgtag

SEQ ID NO: 81154 - DNA, 609 bp, Artificial Sequence
  Description of Artificial Sequence: Synthetic coding sequence
atgggcgccggcgccctggccatctgccagagcaaggccgccgtgagactgaaggaggacatgaagaagatcgtggccgtgcccctgaacgagcagaaggacttcacctaccagaagctgttcggcgtgagcctgcaggagctggagagacagggcctgaccgagaacggcatccccgccgtggtgtggaacatcgtggagtacctgacccagcacggcctgacccaggagggcctgttcagagtgaacggcaacgtgaaggtggtggagcagctgagactgaagttcgagagcggcgtgcccgtggagctgggcaaggacggcgacgtgtgcagcgccgccagcctgctgaagctgttcctgagagagctgcccgacagcctgatcaccagcgccctgcagcccagattcatccagctgttccaggacggcagaaacgacgtgcaggagagcagcctgagagacctgatcaaggagctgcccgacacccactactgcctgctgaagtacctgtgccagttcctgaccaaggtggccaagcaccacgtgcagaacagaatgaacgtgcacaacctggccaccgtgttcggccccaactgcttccagtag

SEQ ID NO: 81155 - DNA, 1494 bp, Artificial Sequence
  Description of Artificial Sequence: Synthetic coding sequence
atggccagccccgccccccccgagcacgccgaggagggctgccccgcccccgccgccgaggagcaggccccccccagccccccccccccccaggccagccccgccgagagacagcagcaggaggaggaggcccaggaggccggcgccgccgagggcgccggcctgcaggtggaggaggccgccggcagagccgccgccgccgtgacctggctgctgggcgagcccgtgctgtggctgggctgcagagccgacgagctgctgagctggaagagacccctgagaagcctgctgggcttcgtggccgccaacctgctgttctggttcctggccctgaccccctggagagtgtaccacctgatcagcgtgatgatcctgggcagagtgatcatgcagatcatcaaggacatggtgctgagcagaaccagaggcgcccagctgtggagaagcctgagcgagagctgggaggtgatcaacagcaagcccgacgagagacccagactgagccactgcatcgccgagagctggatgaacttcagcatcttcctgcaggagatgagcctgttcaagcagcagagccccggcaagttctgcctgctggtgtgcagcgtgtgcaccttcttcaccatcctgggcagctacatccccggcgtgatcctgagctacctgctgctgctgtgcgccttcctgtgccccctgttcaagtgcaacgacatcggccagaagatctacagcaagatcaagagcgtgctgctgaagctggacttcggcatcggcgagtacatcaaccagaagaagagagagagaagcgaggccgacaaggagaagagccacaaggacgacagcgagctggacttcagcgccctgtgccccaagatcagcctgaccgtggccgccaaggagctgagcgtgagcgacaccgacgtgagcgaggtgagctggaccgacaacggcaccttcaacctgagcgagggctacaccccccagaccgacaccagcgacgacctggacagacccagcgaggaggtgttcagcagagacctgagcgacttccccagcctggagaacggcatgggcaccaacgacgaggacgagctgagcctgggcctgcccaccgagctgaagagaaagaaggagcagctggacagcggccacagacccagcaaggagacccagagcgccgccggcctgaccctgcccctgaacagcgaccagaccttccacctgatgagcaacctggccggcgacgtgatcaccgccgccgtgaccgccgccatcaaggaccagctggagggcgtgcagcaggccctgagccaggccgcccccatccccgaggaggacaccgacaccgaggagggcgacgacttcgagctgctggaccagagcgagctggaccagatcgagagcgagctgggcctgacccaggaccaggaggccgaggcccagcagaacaagaagagcagcggcttcctgagcaacctgctgggcggccactag

SEQ ID NO: 81156 - DNA, 1071 bp, Artificial Sequence
  Description of Artificial Sequence: Synthetic coding sequence
atgcccgagggcgaggacttcggccccggcaagagctgggaggtgatcaacagcaagcccgacgagagacccagactgagccactgcatcgccgagagctggatgaacttcagcatcttcctgcaggagatgagcctgttcaagcagcagagccccggcaagttctgcctgctggtgtgcagcgtgtgcaccttcttcaccatcctgggcagctacatccccggcgtgatcctgagctacctgctgctgctgtgcgccttcctgtgccccctgttcaagtgcaacgacatcggccagaagatctacagcaagatcaagagcgtgctgctgaagctggacttcggcatcggcgagtacatcaaccagaagaagagagagagaagcgaggccgacaaggagaagagccacaaggacgacagcgagctggacttcagcgccctgtgccccaagatcagcctgaccgtggccgccaaggagctgagcgtgagcgacaccgacgtgagcgaggtgagctggaccgacaacggcaccttcaacctgagcgagggctacaccccccagaccgacaccagcgacgacctggacagacccagcgaggaggtgttcagcagagacctgagcgacttccccagcctggagaacggcatgggcaccaacgacgaggacgagctgagcctgggcctgcccaccgagctgaagagaaagaaggagcagctggacagcggccacagacccagcaaggagacccagagcgccgccggcctgaccctgcccctgaacagcgaccagaccttccacctgatgagcaacctggccggcgacgtgatcaccgccgccgtgaccgccgccatcaaggaccagctggagggcgtgcagcaggccctgagccaggccgcccccatccccgaggaggacaccgacaccgaggagggcgacgacttcgagctgctggaccagagcgagctggaccagatcgagagcgagctgggcctgacccaggaccaggaggccgaggcccagcagaacaagaagagcagcggcttcctgagcaacctgctgggcggccactag

SEQ ID NO: 81157 - DNA, 2151 bp, Artificial Sequence
  Description of Artificial Sequence: Synthetic coding sequence
atggccaccagccacagagtggccaagctggtggccagcagcctgcagacccccgtgaaccccatcaccggcgccagagtggcccagtacgagagagaggaccccctgaaggccctggccgccgccgaggccatcctggaggacgaggaggaggagaaggtggcccagcccgccggcgccagcgccgacctgaacaccagcttcagcggcgtggacgagcacgcccccatcagctacgaggacttcgtgaacttccccgacatccaccacagcaacgaggagtacttcaagaaggtggaggagctgaaggccgcccacatcgagaccatggccaagctggagaagatgtaccaggacaagctgcacctgaaggaggtgcagcccgtggtgatcagagaggacagcctgagcgacagcagcagaagcgtgagcgagaagaacagctaccaccccgtgagcctgatgaccagcttcagcgagcccgacctgggccagagcagcagcctgtacgtgagcagcagcgaggaggagctgcccaacctggagaaggagtaccccagaaagaacagaatgatgacctacgccaaggagctgatcaacaacatgtggaccgacttctgcgtggaggactacatcagatgcaaggacaccggcttccacgccgccgagaagagaagaaagaagagaaaggagtgggtgcccaccatcaccgtgcccgagcccttccagatgatgatcagagagcagaagaagaaggaggagagcatgaagagcaagagcgacatcgagatggtgcacaaggccctgaagaagcaggaggaggaccccgagtacaagaagaagttcagagccaaccccgtgcccgccagcgtgttcctgcccctgtaccacgacctggtgaagcagaaggaggagagaagaagaagcctgaaggagaagagcaaggaggccctgctggccagccagaagcccttcaagttcatcgccagagaggagcagaagagagccgccagagagaagcagctgagagacttcctgaagtacaagaagaagaccaacagattcaaggccagacccatccccagaagcacctacggcagcaccaccaacgacaagctgaaggaggaggagctgtacagaaacctgagaacccagctgagagcccaggagcacctgcagaacagcagccccctgccctgcagaagcgcctgcggctgcagaaaccccagatgccccgagcaggccgtgaagctgaagtgcaagcacaaggtgagatgccccacccccgacttcgaggacctgcccgagagataccagaagcacctgagcgagcacaagagccccaagctgctgaccgtgtgcaagcccttcgacctgcacgccagcccccacgccagcatcaagagagagaagatcctggccgacatcgaggccgacgaggagaacctgaaggagaccagatggccctacctgagccccagaagaaagagccccgtgagatgcgccggcgtgaaccccgtgccctgcaactgcaacccccccgtgcccaccgtgagcagcagaggcagagagcaggccgtgagaagaagcctggaggagaagaagatgctggaggaggagagaaacagaatcctgaccaagcagaagcagagaatgaaggagctgcagaagctgctgaccaccagagccaaggcctacgacagccaccagagcctggcccagatcagcaagagcagagtgaagtgcctgagaaagagcgagaaggagagaatgagagagtaccagagagagctggaggagagagaggagaagctgaagaagagacccctgctgttcgagagagtggcccagaagaacgccagaatggccgccgagaagcactacagcaacaccctgaaggccctgggcatcagcgacgagttcgtgagcaagaagggccagagcggcaaggtgctggagtacttcaacaaccaggagaccaagagcgtgaccgaggacaaggagagcttcaacgaggaggagaagatcgaggagagagagaacggcgaggagaactacttcatcgacaccaacagccaggacagctacaaggagaaggacgaggccaacgaggagagcgaggaggagaagagcgtggaggagagccactag

SEQ ID NO: 81158 - DNA, 1983 bp, Artificial Sequence
  Description of Artificial Sequence: Synthetic coding sequence
atggccaccagccacagagtggccaagctggtggccagcagcctgcagacccccgtgaaccccatcaccggcgccagagtggcccagtacgagagagaggaccccctgaaggccctggccgccgccgaggccatcctggaggacgaggaggaggagaaggtggcccagcccgccggcgccagcgccgacctgaacaccagcttcagcggcgtggacgagcacgcccccatcagctacgaggacttcgtgaacttccccgacatccaccacagcaacgaggagtacttcaagaaggtggaggagctgaaggccgcccacatcgagaccatggccaagctggagaagatgtaccaggacaagctgcacctgaaggaggtgcagcccgtggtgatcagagaggacagcctgagcgacagcagcagaagcgtgagcgagaagaacagctaccaccccgtgagcctgatgaccagcttcagcgagcccgacctgggccagagcagcagcctgtacgtgagcagcagcgaggaggagctgcccaacctggagaaggagtaccccagaaagaacagaatgatgacctacgccaaggagctgatcaacaacatgtggaccgacttctgcgtggaggactacatcagatgcaaggacaccggcttccacgccgccgagaagagaagaaagaagagaaaggagtgggtgcccaccatcaccgtgcccgagcccttccagatgatgatcagagagcagaagaagaaggaggagagcatgaagagcaagagcgacatcgagatggtgcacaaggccctgaagaagcaggaggaggaccccgagtacaagaagaagttcagagccaaccccgtgcccgccagcgtgttcctgcccctgtaccacgacctggtgaagcagaaggaggagagaagaagaagcctgaaggagaagagcaaggaggccctgctggccagccagaagcccttcaagttcatcgccagagaggagcagaagagagccgccagagagaagcagctgagagacttcctgaagtacaagaagaagaccaacagattcaaggccagacccatccccagaagcacctacggcagcaccaccaacgacaagctgaaggaggaggagctgtacagaaacctgagaacccagctgagagcccaggagcacctgcagaacagcagccccctgccctgcagaagcgcctgcggctgcagaaaccccagatgccccgagcaggccgtgaagctgaagtgcaagcacaaggtgagatgccccacccccgacttcgaggacctgcccgagagataccagaagcacctgagcgagcacaagagccccaagctgctgaccgtgtgcaagcccttcgacctgcacgccagcccccacgccagcatcaagagagagaagatcctggccgacatcgaggccgacgaggagaacctgaaggagaccagatggccctacctgagccccagaagaaagagccccgtgagatgcgccggcgtgaaccccgtgccctgcaactgcaacccccccgtgcccaccgtgagcagcagaggcagagagcaggccgtgagaaagagcgagaaggagagaatgagagagtaccagagagagctggaggagagagaggagaagctgaagaagagacccctgctgttcgagagagtggcccagaagaacgccagaatggccgccgagaagcactacagcaacaccctgaaggccctgggcatcagcgacgagttcgtgagcaagaagggccagagcggcaaggtgctggagtacttcaacaaccaggagaccaagagcgtgaccgaggacaaggagagcttcaacgaggaggagaagatcgaggagagagagaacggcgaggagaactacttcatcgacaccaacagccaggacagctacaaggagaaggacgaggccaacgaggagagcgaggaggagaagagcgtggaggagagccactag

SEQ ID NO: 81159 - DNA, 645 bp, Artificial Sequence
  Description of Artificial Sequence: Synthetic coding sequence
atgagcgtgccccagatccacgtggaggaggtgggcgccgaggagggcgccggcgccgccgccccccccgacgaccacctgagaagcctgaaggccctgaccgagaagctgagactggagaccagaagacccagctacctggagtggcaggccagactggaggagcacacctggcccttccccagacccgccgccgagccccaggccagcctggaggagggcgagagaggcggccaggagcccctgctgcccctgagagaggccggccagcacccccccagcgccagaagcgccagccagggcgccagacccctgagcaccggcaagctggagggcttccagagcatcgacgaggccatcgcctggctgagaaaggagctgaccgagatgagactgcaggaccagcagctggccagacagctgatgagactgagaggcgacatcaacaagctgaagatcgagcacacctgcagactgcacagaagaatgctgaacgacgccacctacgagctggaggagagagacgagctggccgacctgttctgcgacagccccctggccagcagcttcagcctgagcacccccctgaagctgatcggcgtgaccaagatgaacatcaacagcagaagattcagcctgtgctag

SEQ ID NO: 81160 - DNA, 1248 bp, Artificial Sequence
  Description of Artificial Sequence: Synthetic coding sequence
atggccgccagcatcagcggctacaccttcagcgccgtgtgcttccacagcgccaacagcaacgccgaccacgagggcttcctgctgggcgaggtgagacaggaggagaccttcagcatcagcgacagccagatcagcaacaccgagttcctgcaggtgatcgagatccacaaccaccagccctgcagcaagctgttcagcttctacgactacgccagcaaggtgaacgaggagagcctggacagaatcctgaaggacagaagaaagaaggtgatcggctggtacagattcagaagaaacacccagcagcagatgagctacagagagcaggtgctgcacaagcagctgaccagaatcctgggcgtgcccgacctggtgttcctgctgttcagcttcatcagcaccgccaacaacagcacccacgccctggagtacgtgctgttcagacccaacagaagatacaaccagagaatcagcctggccatccccaacctgggcaacaccagccagcaggagtacaaggtgagcagcgtgcccaacaccagccagagctacgccaaggtgatcaaggagcacggcaccgacttcttcgacaaggacggcgtgatgaaggacatcagagccatctaccaggtgtacaacgccctgcaggagaaggtgcaggccgtgtgcgccgacgtggagaagagcgagagagtggtggagagctgccaggccgaggtgaacaagctgagaagacagatcacccagagaaagaacgagaaggagcaggagagaagactgcagcaggccgtgctgagcagacagatgcccagcgagagcctggaccccgccttcagccccagaatgcccagcagcggcttcgccgccgagggcagaagcaccctgggcgacgccgaggccagcgaccccccccccccctacagcgacttccaccccaacaaccaggagagcaccctgagccacagcagaatggagagaagcgtgttcatgcccagaccccaggccgtgggcagcagcaactacgccagcaccagcgccggcctgaagtaccccggcagcggcgccgacctgccccccccccagagagccgccggcgacagcggcgaggacagcgacgacagcgactacgagaacctgatcgaccccaccgagcccagcaacagcgagtacagccacagcaaggacagcagacccatggcccaccccgacgaggaccccagaaacacccagaccagccagatctag

SEQ ID NO: 81161 - DNA, 3522 bp, Artificial Sequence
  Description of Artificial Sequence: Synthetic coding sequence
atgaccagaagatgcatgcccgccagacccggcttccccagcagccccgcccccggcagcagcccccccagatgccacctgagacccggcagcaccgcccacgccgccgccggcaagagaaccgagagccccggcgacagaaagcagagcatcatcgacttcttcaagcccgccagcaagcaggacagacacatgctggacagcccccagaagagcaacatcaagtacggcggcagcagactgagcatcaccggcaccgagcagttcgagagaaagctgagcagccccaaggagagcaagcccaagagagtgccccccgagaagagccccatcatcgaggccttcatgaagggcgtgaaggagcaccacgaggaccacggcatccacgagagcagaagaccctgcctgagcctggccagcaagtacctggccaagggcaccaacatctacgtgcccagcagctaccacctgcccaaggagatgaagagcctgaagaagaagcacagaagccccgagagaagaaagagcctgttcatccacgagaacaacgagaagaacgacagagacagaggcaagaccaacgccgacagcaagaagcagaccaccgtggccgaggccgacatcttcaacaacagcagcagaagcctgagcagcagaagcagcctgagcagacaccaccccgaggagagccccctgggcgccaagttccagctgagcctggccagctactgcagagagagagagctgaagagactgagaaaggagcagatggagcagagaatcaacagcgagaacagcttcagcgaggccagcagcctgagcctgaagagcagcatcgagagaaagtacaagcccagacaggagcagagaaagcagaacgacatcatccccggcaagaacaacctgagcaacgtggagaacggccacctgagcagaaagagaagcagcagcgacagctgggagcccaccagcgccggcagcaagcagaacaagttccccgagaagagaaagagaaacagcgtggacagcgacctgaagagcaccagagagagcatgatccccaaggccagagagagcttcctggagaagagacccgacggcccccaccagaaggagaagttcatcaagcacatcgccctgaagacccccggcgacgtgctgagactggaggacatcagcaaggagcccagcgacgagaccgacggcagcagcgccggcctggcccccagcaacagcggcaacagcggccaccacagcaccagaaacagcgaccagatccaggtggccggcaccaaggagaccaagatgcagaagccccacctgcccctgagccaggagaagagcgccatcaagaaggccagcaacctgcagaagaacaagaccgccagcagcaccaccaaggagaaggagaccaagctgcccctgctgagcagagtgcccagcgccggcagcagcctggtgcccctgaacgccaagaactgcgccctgcccgtgagcaagaaggacaaggagagaagcagcagcaaggagtgcagcggccacagcaccgagagcaccaagcacaaggagcacaaggccaagaccaacaaggccgacagcaacgtgagcagcggcaagatcagcggcggccccctgagaagcgagtacggcacccccaccaagagcccccccgccgccctggaggtggtgccctgcatccccagccccgccgcccccagcgacaaggcccccagcgagggcgagagcagcggcaacagcaacgccggcagcagcgccctgaagagaaagctgagaggcgacttcgacagcgacgaggagagcctgggctacaacctggacagcgacgaggaggaggagaccctgaagagcctggaggagatcatggccctgaacttcaaccagacccccgccgccaccggcaagccccccgccctgagcaagggcctgagaagccagagcagcgactacaccggccacgtgcaccccggcacctacaccaacaccctggagagactggtgaaggagatggaggacacccagagactggacgagctgcagaagcagctgcaggaggacatcagacagggcagaggcatcaagagccccatcagaatcggcgaggaggacagcaccgacgacgaggacggcctgctggaggagcacaaggagttcctgaagaagttcagcgtgaccatcgacgccatccccgaccaccaccccggcgaggagatcttcaacttcctgaacagcggcaagatcttcaaccagtacaccctggacctgagagacagcggcttcatcggccagagcgccgtggagaagctgatcctgaagagcggcaagaccgaccagatcttcctgaccacccagggcttcctgaccagcgcctaccactacgtgcagtgccccgtgcccgtgctgaagtggctgttcagaatgatgagcgtgcacaccgactgcatcgtgagcgtgcagatcctgagcaccctgatggagatcaccatcagaaacgacaccttcagcgacagccccgtgtggccctggatccccagcctgagcgacgtggccgccgtgttcttcaacatgggcatcgacttcagaagcctgttccccctggagaacctgcagcccgacttcaacgaggactacctggtgagcgagacccagaccaccagcagaggcaaggagagcgaggacagcagctacaagcccatcttcagcaccctgcccgagaccaacatcctgaacgtggtgaagttcctgggcctgtgcaccagcatccaccccgagggctaccaggacagagagatcatgctgctgatcctgatgctgttcaagatgagcctggagaagcagctgaagcagatccccctggtggacttccagagcctgctgatcaacctgatgaagaacatcagagactggaacaccaaggtgcccgagctgtgcctgggcatcaacgagctgagcagccacccccacaacctgctgtggctggtgcagctggtgcccaactggaccagcagaggcagacagctgagacagtgcctgagcctggtgatcatcagcaagctgctggacgagaagcacgaggacgtgcccaacgccagcaacctgcaggtgagcgtgctgcacagatacctggtgcagatgaagcccagcgacctgctgaagaagatggtgctgaagaagaaggccgagcagcccgacggcatcatcgacgacagcctgcacctggagctggagaagcaggcctactacctgacctacatcctgctgcacctggtgggcgaggtgagctgcagccacagcttcagcagcggccagagaaagcacttcgtgctgctgtgcggcgccctggagaagcacgtgaagtgcgacatcagagaggacgccagactgttctacagaaccaaggtgaaggacctggtggccagaatccacggcaagtggcaggagatcatccagaactgcagacccacccagggccagctgcacgacttctgggtgcccgacagctag

SEQ ID NO: 81162 - DNA, 3561 bp, Artificial Sequence
  Description of Artificial Sequence: Synthetic coding sequence
atgaccagaagatgcatgcccgccagacccggcttccccagcagccccgcccccggcagcagcccccccagatgccacctgagacccggcagcaccgcccacgccgccgccggcaagagaaccgagagccccggcgacagaaagcagagcatcatcgacttcttcaagcccgccagcaagcaggacagacacatgctggacagcccccagaagagcaacatcaagtacggcggcagcagactgagcatcaccggcaccgagcagttcgagagaaagctgagcagccccaaggagagcaagcccaagagagtgccccccgagaagagccccatcatcgaggccttcatgaagggcgtgaaggagcaccacgaggaccacggcatccacgagagcagaagaccctgcctgagcctggccagcaagtacctggccaagggcaccaacatctacgtgcccagcagctaccacctgcccaaggagatgaagagcctgaagaagaagcacagaagccccgagagaagaaagagcctgttcatccacgagaacaacgagaagaacgacagagacagaggcaagaccaacgccgacagcaagaagcagaccaccgtggccgaggccgacatcttcaacaacagcagcagaagcctgagcagcagaagcagcctgagcagacaccaccccgaggagagccccctgggcgccaagttccagctgagcctggccagctactgcagagagagagagctgaagagactgagaaaggagcagatggagcagagaatcaacagcgagaacagcttcagcgaggccagcagcctgagcctgaagagcagcatcgagagaaagtacaagcccagacaggagcagagaaagcagaacgacatcatccccggcaagaacaacctgagcaacgtggagaacggccacctgagcagaaagagaagcagcagcgacagctgggagcccaccagcgccggcagcaagcagaacaagttccccgagaagagaaagagaaacagcgtggacagcgacctgaagagcaccagagagagcatgatccccaaggccagagagagcttcctggagaagagacccgacggcccccaccagaaggagaagttcatcaagcacatcgccctgaagacccccggcgacgtgctgagactggaggacatcagcaaggagcccagcgacgagaccgacggcagcagcgccggcctggcccccagcaacagcggcaacagcggccaccacagcaccagaaacagcgaccagatccaggtggccggcaccaaggagaccaagatgcagaagccccacctgcccctgagccaggagaagagcgccatcaagaaggccagcaacctgcagaagaacaagaccgccagcagcaccaccaaggagaaggagaccaagctgcccctgctgagcagagtgcccagcgccggcagcagcctggtgcccctgaacgccaagaactgcgccctgcccgtgagcaagaaggacaaggagagaagcagcagcaaggagtgcagcggccacagcaccgagagcaccaagcacaaggagcacaaggccaagaccaacaaggccgacagcaacgtgagcagcggcaagatcagcggcggccccctgagaagcgagtacggcacccccaccaagagcccccccgccgccctggaggtggtgccctgcatccccagccccgccgcccccagcgacaaggcccccagcgagggcgagagcagcggcaacagcaacgccggcagcagcgccctgaagagaaagctgagaggcgacttcgacagcgacgaggagagcctgggctacaacctggacagcgacgaggaggaggagaccctgaagagcctggaggagatcatggccctgaacttcaaccagacccccgccgccaccggcaagccccccgccctgagcaagggcctgagaagccagagcagcgactacaccggccacgtgcaccccggcacctacaccaacaccctggagagactggtgaaggagatggaggacacccagagactggacgagctgcagaagcagctgcaggaggacatcagacagggcagaggcatcaagagccccatcagaatcggcgaggaggacagcaccgacgacgaggacggcctgctggaggagcacaaggagttcctgaagaagttcagcgtgaccatcgacgccatccccgaccaccaccccggcgaggagatcttcaacttcctgaacagcggcaagatcttcaaccagtacaccctggacctgagagacagcggcttcatcggccagagcgccgtggagaagctgatcctgaagagcggcaagaccgaccagatcttcctgaccacccagggcttcctgaccagcgcctaccactacgtgcagtgccccgtgcccgtgctgaagtggctgttcagaatgatgagcgtgcacaccgactgcatcgtgagcgtgcagatcctgagcaccctgatggagatcaccatcagaaacgacaccttcagcgacagccccgtgtggccctggatccccagcctgagcgacgtggccgccgtgttcttcaacatgggcatcgacttcagaagcctgttccccctggagaacctgcagcccgacttcaacgaggactacctggtgagcgagacccagaccaccagcagaggcaaggagagcgaggacagcagctacaagcccatcttcagcaccctgcccgagaccaacatcctgaacgtggtgaagttcctgggcctgtgcaccagcatccaccccgagggctaccaggacagagagatcatgctgctgatcctgatgctgttcaagatgagcctggagaagcagctgaagcagatccccctggtggacttccagagcctgctgatcaacctgatgaagaacatcagagactggaacaccaaggtgcccgagctgtgcctgggcatcaacgagctgagcagccacccccacaacctgctgtggctggtgcagctggtgcccaactggaccagcagaggcagacagctgagacagtgcctgagcctggtgatcatcagcaagctgctggacgagaagcacgaggacgtgcccaacgccagcaacctgcaggtgagcgtgctgcacagatacctggtgcagatgaagcccagcgacctgctgaagaagatggtgctgaagaagaaggccgagcagcccgacggcatcatcgacgacagcctgcacctggagctggagaagcaggcctactacctgacctacatcctgctgcacctggtgggcgaggtgagctgcagccacagcttcagcagcggccagagaaagcacttcgtgctgctgtgcggcgccctggagaagcacgtgaagtgcgacatcagagaggacgccagactgttctacagaaccaaggtgaaggacctggtggccagaatccacggcaagtggcaggagatcatccagaactgcagacccacccaggtgagcttctgctacaccatcagctgcatcctgaacagcttcgccgagtggcacagcagctactgcctgaagtag

SEQ ID NO: 81163 - DNA, 2277 bp, Artificial Sequence
  Description of Artificial Sequence: Synthetic coding sequence
atgaccagaagatgcatgcccgccagacccggcttccccagcagccccgcccccggcagcagcccccccagatgccacctgagacccggcagcaccgcccacgccgccgccggcaagagaaccgagagccccggcgacagaaagcagagcatcatcgacttcttcaagcccgccagcaagcaggacagacacatgctggacagcccccagaagagcaacatcaagtacggcggcagcagactgagcatcaccggcaccgagcagttcgagagaaagctgagcagccccaaggagagcaagcccaagagagtgccccccgagaagagccccatcatcgaggccttcatgaagggcgtgaaggagcaccacgaggaccacggcatccacgagagcagaagaccctgcctgagcctggccagcaagtacctggccaagggcaccaacatctacgtgcccagcagctaccacctgcccaaggagatgaagagcctgaagaagaagcacagaagccccgagagaagaaagagcctgttcatccacgagaacaacgagaagaacgacagagacagaggcaagaccaacgccgacagcaagaagcagaccaccgtggccgaggccgacatcttcaacaacagcagcagaagcctgagcagcagaagcagcctgagcagacaccaccccgaggagagccccctgggcgccaagttccagctgagcctggccagctactgcagagagagagagctgaagagactgagaaaggagcagatggagcagagaatcaacagcgagaacagcttcagcgaggccagcagcctgagcctgaagagcagcatcgagagaaagtacaagcccagacaggagcagagaaagcagaacgacatcatccccggcaagaacaacctgagcaacgtggagaacggccacctgagcagaaagagaagcagcagcgacagctgggagcccaccagcgccggcagcaagcagaacaagttccccgagaagagaaagagaaacagcgtggacagcgacctgaagagcaccagagagagcatgatccccaaggccagagagagcttcctggagaagagacccgacggcccccaccagaaggagaagttcatcaagcacatcgccctgaagacccccggcgacgtgctgagactggaggacatcagcaaggagcccagcgacgagaccgacggcagcagcgccggcctggcccccagcaacagcggcaacagcggccaccacagcaccagaaacagcgaccagatccaggtggccggcaccaaggagaccaagatgcagaagccccacctgcccctgagccaggagaagagcgccatcaagaaggccagcaacctgcagaagaacaagaccgccagcagcaccaccaaggagaaggagaccaagctgcccctgctgagcagagtgcccagcgccggcagcagcctggtgcccctgaacgccaagaactgcgccctgcccgtgagcaagaaggacaaggagagaagcagcagcaaggagtgcagcggccacagcaccgagagcaccaagcacaaggagcacaaggccaagaccaacaaggccgacagcaacgtgagcagcggcaagatcagcggcggccccctgagaagcgagtacggcacccccaccaagagcccccccgccgccctggaggtggtgccctgcatccccagccccgccgcccccagcgacaaggcccccagcgagggcgagagcagcggcaacagcaacgccggcagcagcgccctgaagagaaagctgagaggcgacttcgacagcgacgaggagagcctgggctacaacctggacagcgacgaggaggaggagaccctgaagagcctggaggagatcatggccctgaacttcaaccagacccccgccgccaccggcaagccccccgccctgagcaagggcctgagaagccagagcagcgactacaccggccacgtgcaccccggcacctacaccaacaccctggagagactggtgaaggagatggaggacacccagagattcgtgagcatcaagatcaacctgctgaacctgaccttctgcctgttcgtgtggctgaccttcaacctgcccttcctgaagaaccacgagaagctggcctgcatcctggacagcgtggtgaactgcgtgagaatcagatacgtgggcagaacccagtggctgatgcccgtgatcaccaccctgtgggagacccaggccagactgctggagcccagaagcagcagactgagatag

SEQ ID NO: 81164 - DNA, 675 bp, Artificial Sequence
  Description of Artificial Sequence: Synthetic coding sequence
atgaccagaatcaccgagctgtggagcagcccccagtggaaggtgggcgccgaggtgtgcggcagacagatgagagagcagagaaccgccgagcagagcgagacccagagaacctggctgagcatggccgccaccctgcagttcctggtgtgcctggtggtggccatctgcctgctgagcggcgtgaccaccacccagccccacgccggccagcccatggacagcaccagcgtgggcggcggcctgcaggagcccgaggcccccgaggtgatgttcgagctgctgtgggccggcctggagctggacgtgatgggccagctgcacatccaggacgaggagctggccagcacccaccccggcagaagactgagactgctgctgcagcaccacgtgcccagcgacctggagggcaccgagcagtggctgcagcagctgcaggacctgagaaagggcccccccctgagcacctgggacttcgagcacctgctgctgaccggcctgagctgcgtgtacagactgcacgccgccagcgaggccgaggagagaggcagatgggcccaggtgttcgccctgctggcccaggagaccctgtgggacctgtgcaagggcttctgcccccaggacagaccccccagcctgggcagctgggccagcatcctggaccccttcccctag

SEQ ID NO: 81165 - DNA, 606 bp, Artificial Sequence
  Description of Artificial Sequence: Synthetic coding sequence
atgagagagcagagaaccgccgagcagagcgagacccagagaacctggctgagcatggccgccaccctgcagttcctggtgtgcctggtggtggccatctgcctgctgagcggcgtgaccaccacccagccccacgccggccagcccatggacagcaccagcgtgggcggcggcctgcaggagcccgaggcccccgaggtgatgttcgagctgctgtgggccggcctggagctggacgtgatgggccagctgcacatccaggacgaggagctggccagcacccaccccggcagaagactgagactgctgctgcagcaccacgtgcccagcgacctggagggcaccgagcagtggctgcagcagctgcaggacctgagaaagggcccccccctgagcacctgggacttcgagcacctgctgctgaccggcctgagctgcgtgtacagactgcacgccgccagcgaggccgaggagagaggcagatgggcccaggtgttcgccctgctggcccaggagaccctgtgggacctgtgcaagggcttctgcccccaggacagaccccccagcctgggcagctgggccagcatcctggaccccttcccctag

SEQ ID NO: 81166 - DNA, 1626 bp, Artificial Sequence
  Description of Artificial Sequence: Synthetic coding sequence
atgcccggcctgagaagagacagactgctgaccctgctgctgctgggcgccctgctgagcgccgacctgtacttccacctgtggccccaggtgcagagacagctgagacccagagagagacccagaggctgcccctgcaccggcagagccagcagcctggccagagacagcgccgccgccgccagcgaccccggcaccatcgtgcacaacttcagcagaaccgagcccagaaccgagcccgccggcggcagccacagcggcagcagcagcaagctgcaggccctgttcgcccaccccctgtacaacgtgcccgaggagccccccctgctgggcgccgaggacagcctgctggccagccaggaggccctgagatactacagaagaaaggtggccagatggaacagaagacacaagatgtacagagagcagatgaacctgaccagcctggacccccccctgcagctgagactggaggccagctgggtgcagttccacctgggcatcaacagacacggcctgtacagcagaagcagccccgtggtgagcaagctgctgcaggacatgagacacttccccaccatcagcgccgactacagccaggacgagaaggccctgctgggcgcctgcgactgcacccagatcgtgaagcccagcggcgtgcacctgaagctggtgctgagattcagcgacttcggcaaggccatgttcaagcccatgagacagcagagagacgaggagacccccgtggacttcttctacttcatcgacttccagagacacaacgccgagatcgccgccttccacctggacagaatcctggacttcagaagagtgccccccaccgtgggcagaatcgtgaacgtgaccaaggagatcctggaggtgaccaagaacgagatcctgcagagcgtgttcttcgtgagccccgccagcaacgtgtgcttcttcgccaagtgcccctacatgtgcaagaccgagtacgccgtgtgcggcaacccccacctgctggagggcagcctgagcgccttcctgcccagcctgaacctggcccccagactgagcgtgcccaacccctggatcagaagctacaccctggccggcaaggaggagtgggaggtgaaccccctgtactgcgacaccgtgaagcagatctacccctacaacaacagccagagactgctgaacgtgatcgacatggccatcttcgacttcctgatcggcaacatggacagacaccactacgagatgttcaccaagttcggcgacgacggcttcctgatccacctggacaacgccagaggcttcggcagacacagccacgacgagatcagcatcctgagccccctgagccagtgctgcatgatcaagaagaagaccctgctgcacctgcagctgctggcccaggccgactacagactgagcgacgtgatgagagagagcctgctggaggaccagctgagccccgtgctgaccgagccccacctgctggccctggacagaagactgcagaccatcctgagaaccgtggagggctgcatcgtggcccacggccagcagagcgtgatcgtggacggccccgtggagcagctggcccccgacagcggccaggccaacctgaccagctag

SEQ ID NO: 81167 - DNA, 1023 bp, Artificial Sequence
  Description of Artificial Sequence: Synthetic coding sequence
atgggccccccccacagcggccccggcggcgtgagagtgggcgccctgctgctgctgggcgtgctgggcctggtgagcggcctgagcctggagcccgtgtactggaacagcgccaacaagagattccaggccgagggcggctacgtgctgtacccccagatcggcgacagactggacctgctgtgccccagagccagaccccccggcccccacagcagccccaactacgagttctacaagctgtacctggtgggcggcgcccagggcagaagatgcgaggccccccccgcccccaacctgctgctgacctgcgacagacccgacctggacctgagattcaccatcaagttccaggagtacagccccaacctgtggggccacgagttcagaagccaccacgactactacatcatcgccaccagcgacggcaccagagagggcctggagagcctgcagggcggcgtgtgcctgaccagaggcatgaaggtgctgctgagagtgggccagagccccagaggcggcgccgtgcccagaaagcccgtgagcgagatgcccatggagagagacagaggcgccgcccacagcctggagcccggcaaggagaacctgcccggcgaccccaccagcaacgccaccagcagaggcgccgagggccccctgcccccccccagcatgcccgccgtggccggcgccgccggcggcctggccctgctgctgctgggcgtggccggcgccggcggcgccatgtgctggagaagaagaagagccaagcccagcgagagcagacaccccggccccggcagcttcggcagaggcggcagcctgggcctgggcggcggcggcggcatgggccccagagaggccgagcccggcgagctgggcatcgccctgagaggcggcggcgccgccgacccccccttctgcccccactacgagaaggtgagcggcgactacggccaccccgtgtacatcgtgcaggacggccccccccagagcccccccaacatctactacaaggtgtag

SEQ ID NO: 81168 - DNA, 438 bp, Artificial Sequence
  Description of Artificial Sequence: Synthetic coding sequence
atgttcaccagccccagcgagggcaagcccggcaacatggacagacaccactacgagatgttcaccaagttcggcgacgacggcttcctgatccacctggacaacgccagaggcttcggcagacacagccacgacgagatcagcatcctgagccccctgagccagtgctgcatgatcaagaagaagaccctgctgcacctgcagctgctggcccaggccgactacagactgagcgacgtgatgagagagagcctgctggaggaccagctgagccccgtgctgaccgagccccacctgctggccctggacagaagactgcagaccatcctgagaaccgtggagggctgcatcgtggcccacggccagcagagcgtgatcgtggacggccccgtggagcagctggcccccgacagcggccaggccaacctgaccagctag

SEQ ID NO: 81169 - DNA, 1230 bp, Artificial Sequence
  Description of Artificial Sequence: Synthetic coding sequence
atgaagctgaagcagagagtggtgctgctggccatcctgctggtgatcttcatcttcaccaaggtgttcctgatcgacaacctggacaccagcgccgccaacagagaggaccagagagccttccacagaatgatgaccggcctgagagtggagctggcccccaagctggaccacaccctgcagagcccctgggagatcgccgcccagtgggtggtgcccagagaggtgtaccccgaggagacccccgagctgggcgccgtgatgcacgccatggccaccaagaagatcatcaaggccgacgtgggctacaagggcacccagctgaaggccctgctgatcctggagggcggccagaaggtggtgttcaagcccaagagatacagcagagaccacgtggtggagggcgagccctacgccggctacgacagacacaacgccgaggtggccgccttccacctggacagaatcctgggcttccacagagcccccctggtggtgggcagattcgtgaacctgagaaccgagatcaagcccgtggccaccgagcagctgctgagcaccttcctgaccgtgggcaacaacacctgcttctacggcaagtgctactactgcagagagaccgagcccgcctgcgccgacggcgacatcatggagggcagcgtgaccctgtggctgcccgacgtgtggcccctgcagaagcacagacacccctggggcagaacctacagagagggcaagctggccagatgggagtacgacgagagctactgcgacgccgtgaagaagaccagcccctacgacagcggccccagactgctggacatcatcgacaccgccgtgttcgactacctgatcggcaacgccgacagacaccactacgagagcttccaggacgacgagggcgccagcatgctgatcctgctggacaacgccaagagcttcggcaaccccagcctggacgagagaagcatcctggcccccctgtaccagtgctgcatcatcagagtgagcacctggaacagactgaactacctgaagaacggcgtgctgaagagcgccctgaagagcgccatggcccacgaccccatcagccccgtgctgagcgacccccacctggacgccgtggaccagagactgctgagcgtgctggccaccgtgaagcagtgcaccgaccagttcggcatggacaccgtgctggtggaggacagaatgcccctgagccacctgtag

SEQ ID NO: 81170 - DNA, 417 bp, Artificial Sequence
  Description of Artificial Sequence: Synthetic coding sequence
atgaagctgaagcagagagtggtgctgctggccatcctgctggtgatcttcatcttcaccaaggtgttcctgatcgacaacctggacaccagcgccgccaacagagaggaccagagagccttccacagaatgatgaccggcctgagagtggagctggcccccaagctggaccacaccctgcagagcccctgggagatcgccgcccagtgggtggtgcccagagaggtgtaccccgaggagacccccgagctgggcgccgtgatgcacgccatggccaccaagaagatcatcaaggccgacgtgggctacaagggcacccagctgaaggccctgctgatcctggagggcggccagaaggtggtgttcaagcccaagagatacagcagagaccacgtggtggagggcgagccctactag

SEQ ID NO: 81171 - DNA, 1755 bp, Artificial Sequence
  Description of Artificial Sequence: Synthetic coding sequence
atgaagatgatgctggtgagaagattcagagtgctgatcctgatggtgttcctggtggcctgcgccctgcacatcgccctggacctgctgcccagactggagagaagaggcgccagacccagcggcgagcccggctgcagctgcgcccagcccgccgccgaggtggccgcccccggctgggcccaggtgagaggcagacccggcgagccccccgccgccagcagcgccgccggcgacgccggctggcccaacaagcacaccctgagaatcctgcaggacttcagcagcgaccccagcagcaacctgagcagccacagcctggagaagctgccccccgccgccgagcccgccgagagagccctgagaggcagagaccccggcgccctgagaccccacgaccccgcccacagacccctgctgagagaccccggccccagaagaagcgagagcccccccggccccggcggcgacgccagcctgctggccagactgttcgagcaccccctgtacagagtggccgtgccccccctgaccgaggaggacgtgctgttcaacgtgaacagcgacaccagactgagccccaaggccgccgagaaccccgactggccccacgccggcgccgagggcgccgagttcctgagccccggcgaggccgccgtggacagctaccccaactggctgaagttccacatcggcatcaacagatacgagctgtacagcagacacaaccccgccatcgaggccctgctgcacgacctgagcagccagagaatcaccagcgtggccatgaagagcggcggcacccagctgaagctgatcatgaccttccagaactacggccaggccctgttcaagcccatgaagcagaccagagagcaggagaccccccccgacttcttctacttcagcgactacgagagacacaacgccgagatcgccgccttccacctggacagaatcctggacttcagaagagtgccccccgtggccggcagaatggtgaacatgaccaaggagatcagagacgtgaccagagacaagaagctgtggagaaccttcttcatcagccccgccaacaacatctgcttctacggcgagtgcagctactactgcagcaccgagcacgccctgtgcggcaagcccgaccagatcgagggcagcctggccgccttcctgcccgacctgagcctggccaagagaaagacctggagaaacccctggagaagaagctaccacaagagaaagaaggccgagtgggaggtggaccccgactactgcgaggaggtgaagcagacccccccctacgacagcagccacagaatcctggacgtgatggacatgaccatcttcgacttcctgatgggcaacatggacagacaccactacgagaccttcgagaagttcggcaacgagaccttcatcatccacctggacaacggcagaggcttcggcaagtacagccacgacgagctgagcatcctggtgcccctgcagcagtgctgcagaatcagaaagagcacctacctgagactgcagctgctggccaaggaggagtacaagctgagcctgctgatggccgagagcctgagaggcgaccaggtggcccccgtgctgtaccagccccacctggaggccctggacagaagactgagagtggtgctgaaggccgtgagagactgcgtggagagaaacggcctgcacagcgtggtggacgacgacctggacaccgagcacagagccgccagcgccagatag

SEQ ID NO: 81172 - DNA, 3957 bp, Artificial Sequence
  Description of Artificial Sequence: Synthetic coding sequence
atgatgaacagaaccacccccgaccaggagctggtgcccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaaccagcacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccatgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccagccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcctgaaggagccccagaagcccgagcagcccacccccagaaagagcccctacggccccccccccaccggcctgttcgacgacgacgacggcgacgacgacgacgacttcttcagcgccccccacagcaagcccagcaagaccagaaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagctacagcaagaacctgaagcccagcagcgagaccaagacccagaagggcctgttcagcgacgaggaggacagcgaggacctgttcagcagccagagcgccagcaacctgaagggcgccagcctgctgcccggcaagctgcccaccagcgtgagcctgttcgacgacgaggacgaggaggacaacctgttcggcggcaccgccgccaagaagcagaccctgagcctgcaggcccagagagaggagaaggccaaggccagcgagctgagcaagaagaaggccagcgccctgctgttcagcagcgacgaggagtggaacatccccgccagccagacccacctggccagcgacagcagaagcaagggcgagcccagagacagcggcaccctgcagagccaggaggccaaggccgtgaagaagaccagcctgttcgaggaggacaaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggctgcgaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtgaacagcttcaagaaccagaagcaccccgagagcatccagggcagcaaggagaagggcatctggaagcccgagaccccccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgaggccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacaccagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcagcagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcaccggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 81173 - DNA, 3789 bp, Artificial Sequence
  Description of Artificial Sequence: Synthetic coding sequence
atgaacagaaccacccccgaccaggagctggtgcccgccagcgagcccgtgtgggagagaccctggagcgtggaggagatcagaagaagcagccagagctggagcctggccgccgacgccggcagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaaccagcacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccatgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccagccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcctgaaggagccccagaagcccgagcagcccacccccagaaagagcccctacggccccccccccaccggcctgttcgacgacgacgacggcgacgacgacgacgacttcttcagcgccccccacagcaagcccagcaagaccagaaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagctacagcaagaacctgaagcccagcagcgagaccaagacccagaagggcctgttcagcgacgaggaggacagcgaggacctgttcagcagccagagcgccagcaacctgaagggcgccagcctgctgcccggcaagctgcccaccagcgtgagcctgttcgacgacgaggacgaggaggacaacctgttcggcggcaccgccgccaagaagcagaccctgagcctgcaggcccagagagaggagaaggccaaggccagcgagctgagcaagaagaaggccagcgccctgctgttcagcagcgacgaggagtggaacatccccgccagccagacccacctggccagcgacagcagaagcaagggcgagcccagagacagcggcaccctgcagagccaggaggccaaggccgtgaagaagaccagcctgttcgaggaggacaaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggctgcgaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtgaacagcttcaagaaccagaagcaccccgagagcatccagggcagcaaggagaagggcatctggaagcccgagaccccccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgaggccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacaccagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcagcagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcaccggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 81174 - DNA, 399 bp, Artificial Sequence
  Description of Artificial Sequence: Synthetic coding sequence
atggaggaccagaacatcatccaggccccccagaaggaggtgggcaagggctgcgaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtgaacagcttcaagaaccagaagcaccccgagagcatccagggcagcaaggagaagggcatctggaagcccgagaccccccaggtgagaaaccccctgtag

SEQ ID NO: 81175 - DNA, 3963 bp, Artificial Sequence
  Description of Artificial Sequence: Synthetic coding sequence
atgatgaacagaaccacccccgaccaggagctggtgcccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaaccagcacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccatgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccagccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcctgaaggagccccagaagcccgagcagcccacccccagaaagagcccctacggccccccccccaccggcctgttcgacgacgacgacggcgacgacgacgacgacttcttcagcgccccccacagcaagcccagcaagaccagaaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagctacagcaagaacctgaagcccagcagcgagaccaagacccagaagggcctgttcagcgacgaggaggacagcgaggacctgttcagcagccagagcgccagcaacctgaagggcgccagcctgctgcccggcaagctgcccaccagcgtgagcctgttcgacgacgaggacgaggaggacaacctgttcggcggcaccgccgccaagaagcagaccctgagcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacaaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggctgcgaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtgaacagcttcaagaaccagaagcaccccgagagcatccagggcagcaaggagaagggcatctggaagcccgagaccccccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgaggccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacaccagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcagcagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcaccggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 81176 - DNA, 4026 bp, Artificial Sequence
  Description of Artificial Sequence: Synthetic coding sequence
atgatgaacagaaccacccccgaccaggagctggtgcccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaaccagcacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccatgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccagccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcctgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagctacagcaagaacctgaagcccagcagcgagaccaagacccagaagggcctgttcagcgacgaggaggacagcgaggacctgttcagcagccagagcgccagcaacctgaagggcgccagcctgctgcccggcaagctgcccaccagcgtgagcctgttcgacgacgaggacgaggaggacaacctgttcggcggcaccgccgccaagaagcagaccctgagcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacaaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggctgcgaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtgaacagcttcaagaaccagaagcaccccgagagcatccagggcagcaaggagaagggcatctggaagcccgagaccccccaggacagcagcggcctggcccccttcaagaccaaggagcccagcaccagaatcggcaagatccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgaggccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacaccagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcagcagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcaccggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 81177 - DNA, 840 bp, Artificial Sequence
  Description of Artificial Sequence: Synthetic coding sequence
atgatgaacagaaccacccccgaccaggagctggtgcccgccagcgagcccgtgtgggagagaccctggagcgtggaggagatcagaagaagcagccagagctggagcctggccgccgacgccggcagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaaccagcacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccatgggcagagtggacgaggagcccaccaccctgcccagcggcgaggccaagcccagaaagaccctgaaggagaagaaggagagaagaacccccagcgactag

SEQ ID NO: 81178 - DNA, 3762 bp, Artificial Sequence
  Description of Artificial Sequence: Synthetic coding sequence
atgcccagactgagcggcaagagcgtgagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaaccagcacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccatgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccagccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcctgaaggagccccagaagcccgagcagcccacccccagaaagagcccctacggccccccccccaccggcctgttcgacgacgacgacggcgacgacgacgacgacttcttcagcgccccccacagcaagcccagcaagaccggcaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagctacagcaagaacctgaagcccagcagcgagaccaagacccagaagggcctgttcagcgacgaggaggacagcgaggacctgttcagcagccagagcgccagcaacctgaagggcgccagcctgctgcccggcaagctgcccaccagcgtgagcctgttcgacgacgaggacgaggaggacaacctgttcggcggcaccgccgccaagaagcagaccctgagcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacaaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggctgcgaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtgaacagcttcaagaaccagaagcaccccgagagcatccagggcagcaaggagaagggcatctggaagcccgagaccccccaggacagcagcggcctggcccccttcaagaccaaggagcccagcaccagaatcggcaagatccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgaggccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacaccagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcagcagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcaccggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 81179 - DNA, 3738 bp, Artificial Sequence
  Description of Artificial Sequence: Synthetic coding sequence
atgatgaacagaaccacccccgaccaggagctggtgcccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaaccagcacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccatgggcagagtggacgaggagcccaccaacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccagccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcctgaaggagccccagaagcccgagcagcccacccccagaaagagcccctacggccccccccccaccggcctgttcgacgacgacgacggcgacgacgacgacgacttcttcagcgccccccacagcaagcccagcaagaccagaaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagctacagcaagaacctgaagcccagcagcgagaccaagacccagaagggcctgttcagcgacgaggaggacagcgaggacctgttcagcagccagagcgccagcaacctgaagggcgccagcctgctgcccggcaagctgcccaccagcgtgagcctgttcgacgacgaggacgaggaggacaacctgttcggcggcaccgccgccaagaagcagaccctgagcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacaaggaggacgacctgttcgccatcgccaaggacagccagaagaagacccagagagtgagcctgctgttcgaggacgacgtggacagcggcggcagcctgttcggcagcccccccaccagcgtgccccccgccaccaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggctgcgaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggtgcaggagaagaagagagtggtgaagaaggaccacagcgtgaacagcttcaagaaccagaagcaccccgagagcatccagggcagcaaggagaagggcatctggaagcccgagaccccccaggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgaggccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacaccagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcagcagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcaccggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 81180 - DNA, 3840 bp, Artificial Sequence
  Description of Artificial Sequence: Synthetic coding sequence
atgatgaacagaaccacccccgaccaggagctggtgcccgccagcgagcccgtgtgggagagaccctggagcgtggaggagatcagaagaagcagccagagctggagcctggccgccgacgccggcctgctgcagttcctgcaggagttcagccagcagaccatcagcagaacccacgagatcaagaagcaggtggacggcctgatcagagagaccaaggccaccgactgcagactgcacaacgtgttcaacgacttcctgatgctgagcaacacccagttcatcgagaacagagtgtacgacgaggaggtggaggagcccgtgctgaaggccgaggccgagaagaccgagcaggagaagaccagagagcagaaggaggtggacctgatccccaaggtgcaggaggccgtgaactacggcctgcaggtgctggacagcgccttcgagcagctggacatcaaggccggcaacagcgacagcgaggaggacgacgccaacggcagagtggagctgatcctggagcccaaggacctgtacatcgacagacccctgccctacctgatcggcagcaagctgttcatggagcaggaggacgtgggcctgggcgagctgagcagcgaggagggcagcgtgggcagcgacagaggcagcatcgtggacaccgaggaggagaaggaggaggaggagagcgacgaggacttcgcccaccacagcgacaacgagcagaaccagcacaccacccagatgagcgacgaggaggaggacgacgacggctgcgacctgttcgccgacagcgagaaggaggaggaggacatcgaggacatcgaggagaacaccagacccaagagaagcagacccaccagcttcgccgacgagctggccgccagaatcaagggcgacgccatgggcagagtggacgaggagcccaccaccctgcccagcggcgaggccaagcccagaaagaccctgaaggagaagaaggagagaagaacccccagcgacgacgaggaggacaacctgttcgccccccccaagctgaccgacgaggacttcagccccttcggcagcggcggcggcctgttcagcggcggcaagggcctgttcgacgacgaggacgaggagagcgacctgttcaccgaggccagccaggacagacaggccggcgccagcgtgaaggaggagagcagcagcagcaagcccggcaagaagatccccgccggcgccgtgagcgtgttcctgggcgacaccgacgtgttcggcgccgccagcgtgcccagcctgaaggagccccagaagcccgagcagcccacccccagaaagagcccctacggccccccccccaccggcctgttcgacgacgacgacggcgacgacgacgacgacttcttcagcgccccccacagcaagcccagcaagaccagaaaggtgcagagcaccgccgacatcttcggcgacgaggagggcgacctgttcaaggagaaggccgtggccagccccgaggccaccgtgagccagaccgacgagaacaaggccagagccgagaagaaggtgaccctgagctacagcaagaacctgaagcccagcagcgagaccaagacccagaagggcctgttcagcgacgaggaggacagcgaggacctgttcagcagccagagcgccagcaacctgaagggcgccagcctgctgcccggcaagctgcccaccagcgtgagcctgttcgacgacgaggacgaggaggacaacctgttcggcggcaccgccgccaagaagcagaccctgagcctgcaggcccagagagaggagaaggccaaggccagcgagctgagcaagaagaaggccagcgccctgctgttcagcagcgacgaggaggaccagtggaacatccccgccagccagacccacctggccagcgacagcagaagcaagggcgagcccagagacagcggcaccctgcagagccaggaggccaaggccgtgaagaagaccagcctgttcgaggaggacaaggaggacgacctgttcgccatcgccaaggacagccagaagaagacccagagagtgagcctgctgttcgaggacgacgtggacagcggcggcagcctgttcggcagcccccccaccagcgtgccccccgccaccaagaagaaggagaccgtgagcgaggccccccccctgctgttcagcgacgaggaggagaaggaggcccagctgggcgtgaagagcgtggacaagaaggtggagagcgccaaggagagcctgaagttcggcagaaccgacgtggccgagagcgagaaggagggcctgctgaccagaagcgcccaggagaccgtgaagcacagcgacctgttcagcagcagcagcccctgggacaagggcaccaagcccagaaccaagaccgtgctgagcctgttcgacgaggaggaggacaagatggaggaccagaacatcatccaggccccccagaaggaggtgggcaagggctgcgaccccgacgcccaccccaagagcaccggcgtgttccaggacgaggagctgctgttcagccacaagctgcagaaggacaacgaccccgacgtggacctgttcgccggcaccaagaagaccaagctgctggagcccagcgtgggcagcctgttcggcgacgacgaggacgacgacctgttcagcagcgccaagagccagcccctggccaacctggccatcaaccccgccgccctgctgcccaccgccgccagccagatcagcgaggtgaagcccgtgctgcccgagctggccttccccagcagcgagcacagaagaagccacggcctggagagcgtgcccgtgctgcccggcagcggcgaggccggcgtgagcttcgacctgcccgcccaggccgacaccctgcacagcgccaacaagagcagagtgaagatgagaggcaagagaagaccccagaccagagccgccagaagactggccgcccaggagagcagcgaggccgaggacatgagcgtgcccagaggccccatcgcccagtgggccgacggcgccatcagccccaacggccacagaccccagctgagagccgccagcggcgaggacagcaccgaggaggccctggccgccgccgccgccccctgggagggcggccccgtgcccggcgtggacaccagccccttcgccaagagcctgggccacagcagaggcgaggccgacctgttcgacagcggcgacatcttcagcaccggcaccggcagccagagcgtggagagaaccaagcccaaggccaagatcgccgagaaccccgccaacccccccgtgggcggcaaggccaagagccccatgttccccgccctgggcgaggccagcagcgacgacgacctgttccagagcgccaagcccaagcccgccaagaagaccaaccccttccccctgctggaggacgaggacgacctgttcaccgaccagaaggtgaagaagaacgagaccaagagcagcagccagcaggacgtgatcctgaccacccaggacatcttcgaggacgacatcttcgccaccgaggccatcaagcccagccagaagaccagagagaaggagaagaccctggagagcaacctgttcgacgacaacatcgacatcttcgccgacctgaccgtgaagcccaaggagaagagcaagaagaaggtggaggccaagagcatcttcgacgacgacatggacgacatcttcagcaccggcatccaggccaagaccaccaagcccaagagcagaagcgcccaggccgcccccgagcccagattcgagcacaaggtgagcaacatcttcgacgaccccctgaacgccttcggcggccagtag

SEQ ID NO: 81181 - DNA, 1329 bp, Artificial Sequence
  Description of Artificial Sequence: Synthetic coding sequence
atggccgagggcgagggctacttcgccatgagcgaggacgagctggcctgcagcccctacatccccctgggcggcgacttcggcggcggcgacttcggcggcggcgacttcggcggcggcgacttcggcggcggcggcagcttcggcggccactgcctggactactgcgagagccccaccgcccactgcaacgtgctgaactgggagcaggtgcagagactggacggcatcctgagcgagaccatccccatccacggcagaggcaacttccccaccctggagctgcagcccagcctgatcgtgaaggtggtgagaagaagactggccgagaagagaatcggcgtgagagacgtgagactgaacggcagcgccgccagccacgtgctgcaccaggacagcggcctgggctacaaggacctggacctgatcttctgcgccgacctgagaggcgagggcgagttccagaccgtgaaggacgtggtgctggactgcctgctggacttcctgcccgagggcgtgaacaaggagaagatcacccccctgaccctgaaggaggcctacgtgcagaagatggtgaaggtgtgcaacgacagcgacagatggagcctgatcagcctgagcaacaacagcggcaagaacgtggagctgaagttcgtggacagcctgagaagacagttcgagttcagcgtggacagcttccagatcaagctggacagcctgctgctgttctacgagtgcagcgagaaccccatgaccgagaccttccaccccaccatcatcggcgagagcgtgtacggcgacttccaggaggccttcgaccacctgtgcaacaagatcatcgccaccagaaaccccgaggagatcagaggcggcggcctgctgaagtactgcaacctgctggtgagaggcttcagacccgccagcgacgagatcaagaccctgcagagatacatgtgcagcagattcttcatcgacttcagcgacatcggcgagcagcagagaaagctggagagctacctgcagaaccacttcgtgggcctggaggacagaaagtacgagtacctgatgaccctgcacggcgtggtgaacgagagcaccgtgtgcctgatgggccacgagagaagacagaccctgaacctgatcaccatgctggccatcagagtgctggccgaccagaacgtgatccccaacgtggccaacgtgacctgctactaccagcccgccccctacgtggccgacgccaacttcagcaactactacatcgcccaggtgcagcccgtgttcacctgccagcagcagacctacagcacctggctgccctgcaactag

SEQ ID NO: 81182 - DNA, 1176 bp, Artificial Sequence
  Description of Artificial Sequence: Synthetic coding sequence
atggccgaggagagcagctgcaccagagactgcatgagcttcagcgtgctgaactgggaccaggtgagcagactgcacgaggtgctgaccgaggtggtgcccatccacggcagaggcaacttccccaccctggagatcaccctgaaggacatcgtgcagaccgtgagaagcagactggaggaggccggcatcaaggtgcacgacgtgagactgaacggcagcgccgccggccacgtgctggtgaaggacaacggcctgggctgcaaggacctggacctgatcttccacgtggccctgcccaccgaggccgagttccagctggtgagagacgtggtgctgtgcagcctgctgaacttcctgcccgagggcgtgaacaagctgaagatcagccccgtgaccctgaaggaggcctacgtgcagaagctggtgaaggtgtgcaccgacaccgacagatggagcctgatcagcctgagcaacaagaacggcaagaacgtggagctgaagttcgtggacagcatcagaagacagttcgagttcagcgtggacagcttccagatcatcctggacagcctgctgttcttctacgactgcagcaacaaccccatcagcgagcacttccaccccaccgtgatcggcgagagcatgtacggcgacttcgaggaggccttcgaccacctgcagaacagactgatcgccaccaagaaccccgaggagatcagaggcggcggcctgctgaagtacagcaacctgctggtgagagacttcagacccaccgaccaggaggagatcaagaccctggagagatacatgtgcagcagattcttcatcgacttccccgacatcctggagcagcagagaaagctggagacctacctgcagaaccacttcgccgaggaggagagaagcaagtacgactacctgatgatcctgagaagagtggtgaacgagagcaccgtgtgcctgatgggccacgagagaagacagaccctgaacctgatcagcctgctggccctgagagtgctggccgagcagaacatcatccccagcgccaccaacgtgacctgctactaccagcccgccccctacgtgagcgacggcaacttcagcaactactacgtggcccacccccccgtgacctacagccagccctaccccacctggctgccctgcaactag

SEQ ID NO: 81183 - DNA, 2340 bp, Artificial Sequence
  Description of Artificial Sequence: Synthetic coding sequence
atgcagcaggccctggagctggccctggacagagccgagtacgtgatcgagagcgccagacagagaccccccaagagaaagtacctgagcagcggcagaaagagcgtgttccagaagctgtacgacctgtacatcgaggagtgcgagaaggagcccgaggtgaagaagctgagaagaaacgtgaacctgctggagaagctggtgatgcaggagaccctgagctgcctggtggtgaacctgtaccccggcaacgagggctacagcctgatgctgagaggcaagaacggcagcgacagcgagaccatcagactgccctacgaggagggcgagctgctggagtacctggacgccgaggagctgccccccatcctggtggacctgctggagaagagccaggtgaacatcttccactgcggctgcgtgatcgccgagatcagagactacagacagagcagcaacatgaagagccccggctaccagagcagacacatcctgctgagacccaccatgcagaccctgatctgcgacgtgcacagcatcaccagcgacaaccacaagtggacccaggaggacaagctgctgctggagagccagctgatcctggccaccgccgagcccctgtgcctggaccccagcatcgccgtgacctgcaccgccaacagactgctgtacaacaagcagaagatgaacaccagacccatgaagagatgcttcaagagatacagcagaagcagcctgaacagacagcaggacctgagccactgccccccccccccccagctgagactgctggacttcctgcagaagagaaaggagagaaaggccggccagcactacgacctgaagatcagcaaggccggcaactgcgtggacatgtggaagagaagcccctgcaacctggccatccccagcgaggtggacgtggagaagtacgccaaggtggagaagagcatcaagagcgacgacagccagcccaccgtgtggcccgcccacgacgtgaaggacgactacgtgttcgagtgcgaggccggcacccagtaccagaagaccaagctgaccatcctgcagagcctgggcgaccccctgtactacggcaagatccagccctgcaaggccgacgaggagagcgacagccagatgagccccagccacagcagcaccgacgaccacagcaactggttcatcatcggcagcaagaccgacgccgagagagtggtgaaccagtaccaggagctggtgcagaacgaggccaagtgccccgtgaagatgagccacagcagcagcggcagcgccagcctgagccaggtgagccccggcaaggagaccgaccagaccgagaccgtgagcgtgcagagcagcgtgctgggcaagggcgtgaagcacagacccccccccatcaagctgcccagcagcagcggcaacagcagcagcggcaactacttcaccccccagcagaccagcagcttcctgaagagccccacccccccccccagcagcaagcccagcagcatccccagaaagagcagcgtggacctgaaccaggtgagcatgctgagccccgccgccctgagccccgccagcagcagccagagaaccaccgccacccaggtgatggccaacagcgccggcctgaacttcatcaacgtggtgggcagcgtgtgcggcgcccaggccctgatgagcggcagcaaccccatgctgggctgcaacaccggcgccatcacccccgccggcatcaacctgagcggcctgctgcccagcggcggcctgctgcccaacgccctgcccagcgccatgcaggccgccagccaggccggcgtgcccttcggcctgaagaacaccagcagcctgagacccctgaacctgctgcagctgcccggcggcagcctgatcttcaacaccctgcagcagcagcagcagcagctgagccagttcaccccccagcagccccagcagcccaccacctgcagcccccagcagcccggcgagcagggcagcgagcagggcagcaccagccaggagcaggccctgagcgcccagcaggccgccgtgatcaacctgaccggcgtgggcagcttcatgcagagccaggccgccgtgctgagccagctgggcagcgccgagaacagacccgagcagagcctgccccagcagagattccagctgagcagcgccttccagcagcagcagcagcagatccagcagctgagattcctgcagcaccagatggccatggccgccgccgccgcccagaccgcccagctgcaccaccacagacacaccggcagccagagcaagagcaagatgaagagaggcacccccaccacccccaagttctag

SEQ ID NO: 81184 - DNA, 2202 bp, Artificial Sequence
  Description of Artificial Sequence: Synthetic coding sequence
atgcagcaggccctggagctggccctggacagagccgagtacgtgatcgagagcgccagacagagaccccccaagagaaagtacctgagcagcggcagaaagagcgtgttccagaagctgtacgacctgtacatcgaggagtgcgagaaggagcccgaggtgaagcagaagctgagaagaaacgtgaacctgctggagaagctggtgatgcaggagaccctgagctgcctggtggtgaacctgtaccccggcaacgagggctacagcctgatgctgagaggcaagaacggcagcgacagcgagaccatcagactgccctacgaggagggcgagctgctggagtacctggacgccgaggagctgccccccatcctggtggacctgctggagaagagccaggtgaacatcttccactgcggctgcgtgatcgccgagatcagagactacagacagagcagcaacatgaagagccccggctaccagagcagacacatcctgctgagacccaccatgcagaccctgatctgcgacgtgcacagcatcaccagcgacaaccacaagtggacccaggaggacaagctgctgctggagagccagctgatcctggccaccgccgagcccctgtgcctggaccccagcatcgccgtgacctgcaccgccaacagactgctgtacaacaagcagaagatgaacaccagacccatgaagagatgcttcaagagatacagcagaagcagcctgaacagacagcaggacctgagccactgccccccccccccccagctgagactgctggacttcctgcagaagagaaaggagagaaaggccggccagcactacgacctgaagatcagcaaggccggcaactgcgtggacatgtggaagagaagcccctgcaacctggccatccccagcgaggtggacgtggagaagtacgccaaggtggagaagagcatcaagagcgacgacagccagcccaccgtgtggcccgcccacgacgtgaaggacgactacgtgttcgagtgcgaggccggcacccagtaccagaagaccaagctgaccatcctgcagagcctgggcgaccccctgtactacggcaagatccagccctgcaaggccgacgaggagagcgacagccagatgagccccagccacagcagcaccgacgaccacagcaactggttcatcatcggcagcaagaccgacgccgagagagtggtgaaccagtaccaggagctggtgcagaacgaggccaagtgccccgtgaagatgagccacagcagcagcggcagcgccagcctgagccaggtgagccccggcaaggagaccgaccagaccgagaccgtgagcgtgcagagcagcgtgctgggcaagggcgtgaagcacagacccccccccatcaagctgcccagcagcagcggcaacagcagcagcggcaactacttcaccccccagcagaccagcagcttcctgaagagccccacccccccccccagcagcaagcccagcagcatccccagaaagagcagcgtggacctgaaccaggtgagcatgctgagccccgccgccctgagccccgccagcagcagccagagaaccaccgccacccaggtgatggccaacagcgccggcctgaacttcatcaacgtggtgggcagcgtgtgcggcgcccaggccctgatgagcggcagcaaccccatgctgggctgcaacaccggcgccatcacccccgccggcatcaacctgagcggcctgctgcccagcggcggcctgctgcccaacgccctgcccagcgccatgcaggccgccagccaggccggcgtgcccttcggcctgaagaacaccagcagcctgagacccctgaacctgctgcagctgcccggcggcagcctgatcttcaacaccctgcagcagcagcagcagcagctgagccagttcaccccccagcagccccagcagcccaccacctgcagcccccagcagcccggcgagcagggcagcgagcagggcagcaccagccaggagcaggccctgagcgcccagcaggccgccgtgatcaacctgaccggcgtgggcagcttcatgcagagccaggccgccgccgtggccatcctggccgccagcaacggctacggcagcagcagcagcaccaacagcagcgccaccagcagcagcgcctacagacagcccgtgaagaagtag

SEQ ID NO: 81185 - DNA, 2202 bp, Artificial Sequence; identical to SEQ ID NO: 81184
  Description of Artificial Sequence: Synthetic coding sequence

SEQ ID NO: 81186 - DNA, 2202 bp, Artificial Sequence; identical to SEQ ID NO: 81184
  Description of Artificial Sequence: Synthetic coding sequence

SEQ ID NO: 81187 - DNA, 2217 bp, Artificial Sequence
  Description of Artificial Sequence: Synthetic coding sequence
atgcagcaggccctggagctggccctggacagagccgagtacgtgatcgagagcgccagacagagaccccccaagagaaagtacctgagcagcggcagaaagagcgtgttccagaagctgtacgacctgtacatcgaggagtgcgagaaggagcccgaggtgaagaagctgagaagaaacgtgaacctgctggagaagctggtgatgcaggagaccctgagctgcctggtggtgaacctgtaccccggcaacgagggctacagcctgatgctgagaggcaagaacggcagcgacagcgagaccatcagactgccctacgaggagggcgagctgctggagtacctggacgccgaggagctgccccccatcctggtggacctgctggagaagagccaggtgaacatcttccactgcggctgcgtgatcgccgagatcagagactacagacagagcagcaacatgaagagccccggctaccagagcagacacatcctgctgagacccaccatgcagaccctgatctgcgacgtgcacagcatcaccagcgacaaccacaagtggacccaggaggacaagctgctgctggagagccagctgatcctggccaccgccgagcccctgtgcctggaccccagcatcgccgtgacctgcaccgccaacagactgctgtacaacaagcagaagatgaacaccagacccatgaagagatgcttcaagagatacagcagaagcagcctgaacagacagcaggacctgagccactgccccccccccccccagctgagactgctggacttcctgcagaagagaaaggagagaaaggccggccagcactacgacctgaagatcagcaaggccggcaactgcgtggacatgtggaagagaagcccctgcaacctggccatccccagcgaggtggacgtggagaagtacgccaaggtggagaagagcatcaagagcgacgacagccagcccaccgtgtggcccgcccacgacgtgaaggacgactacgtgttcgagtgcgaggccggcacccagtaccagaagaccaagctgaccatcctgcagagcctgggcgaccccctgtactacggcaagatccagccctgcaaggccgacgaggagagcgacagccagatgagccccagccacagcagcaccgacgaccacagcaactggttcatcatcggcagcaagaccgacgccgagagagtggtgaaccagtaccaggagctggtgcagaacgaggccaagtgccccgtgaagatgagccacagcagcagcggcagcgccagcctgagccaggtgagccccggcaaggagaccgaccagaccgagaccgtgagcgtgcagagcagcgtgctgggcaagggcgtgaagcacagacccccccccatcaagctgcccagcagcagcggcaacagcagcagcggcaactacttcaccccccagcagaccagcagcttcctgaagagccccacccccccccccagcagcaagcccagcagcatccccagaaagagcagcgtggacctgaaccaggtgagcatgctgagccccgccgccctgagccccgccagcagcagccagagaaccaccgccacccaggtgatggccaacagcgccggcctgaacttcatcaacgtggtgggcagcgtgtgcggcgcccaggccctgatgagcggcagcaaccccatgctgggctgcaacaccggcgccatcacccccgccggcatcaacctgagcggcctgctgcccagcggcggcctgctgcccaacgccctgcccagcgccatgcaggccgccagccaggccggcgtgcccttcggcctgaagaacaccagcagcctgagacccctgaacctgctgcagctgcccggcggcagcctgatcttcaacaccctgcagcagcagcagcagcagctgagccagttcaccccccagcagccccagcagcccaccacctgcagcccccagcagcccggcgagcagggcagcgagcagggcagcaccagccaggagcaggccctgagcgcccagcaggccgccgtgatcaacctgaccggcgtgggcagcttcatgcagagccaggccgccgccgtggccatcctggccgccagcaacggctacggcagcagcagcagcaccaacagcagcgccaccagcagcagcgcctacagacagcccgacaccagagccctgaaccagaagaactag

SEQ ID NO: 81188 - DNA, 1497 bp, Artificial Sequence
  Description of Artificial Sequence: Synthetic coding sequence
atgtacgtgatcgagagcgccagacagagaccccccaagagaaagtacctgagcagcggcagaaagagcgtgttccagaagctgtacgacctgtacatcgaggagtgcgagaaggagcccgaggtgaagaagctgagaagaaacgtgaacctgctggagaagctggtgatgcaggagaccctgagctgcctggtggtgaacctgtaccccggcaacgagggctacagcctgatgctgagaggcaagaacggcagcgacagcgagaccatcagactgccctacgaggagggcgagctgctggagtacctggacgccgaggagctgccccccatcctggtggacctgctggagaagagccaggtgaacatcttccactgcggctgcgtgatcgccgagatcagagactacagacagagcagcaacatgaagagccccggctaccagagcagacacatcctgctgagacccaccatgcagaccctgatctgcgacgtgcacagcatcaccagcgacaaccacaagtggacccaggaggacaagctgctgctggagagccagctgatcctggccaccgccgagcccctgtgcctggaccccagcatcgccgtgacctgcaccgccaacagactgctgtacaacaagcagaagatgaacaccagacccatgaagagatgcttcaagagatacagcagaagcagcctgaacagacagcaggacctgagccactgccccccccccccccagctgagactgctggacttcctgcagaagagaaaggagagaaaggccggccagcactacgacctgaagatcagcaaggccggcaactgcgtggacatgtggaagagaagcccctgcaacctggccatccccagcgaggtggacgacgtgaaggacgactacgtgttcgagtgcgaggccggcacccagtaccagaagaccaagctgaccatcctgcagagcctgggcgaccccctgtactacggcaagatccagccctgcaaggccgacgaggagagcgacagccagatgagccccagccacagcagcaccgacgaccacagcaactggttcatcatcggcagcaagaccgacgccgagagagtggtgaaccagtaccaggagctggtgcagaacgaggccaagtgccccgtgaagatgagccacagcagcagcggcagcgccagcctgagccaggtgagccccggcaaggagaccgaccagaccgagaccgtgagcgtgcagagcagcgtgctgggcaagggcgtgaagcacagacccccccccatcaagctgcccagcagcagcggcaacagcagcagcggcaactacttcaccccccagcagaccagcagcttcctgaagagccccacccccccccccagcagcaagcccagcagcatccccagaaagagcagcgtggacctgaaccaggtgagcatgctgagccccgccgccctgagccccgccagcagcagccagagacacgagagctag

SEQ ID NO: 81189 - DNA, 678 bp, Artificial Sequence
  Description of Artificial Sequence: Synthetic coding sequence
atgctgctgaccctggccggcggcgccctgttcttccccggcctgttcgccctgtgcacctgggccctgagaagaagccagcccggctggagcagaaccgactgcgtgatgatcagcaccagactggtgagcagcgtgcacgccgtgctggccaccggcagcggcatcgtgatcatcagaagctgcgacgacgtgatcaccggcagacactggctggccagagagtacgtgtggttcctgatcccctacatgatctacgacagctacgccatgtacctgtgcgagtggtgcagaaccagagaccagaacagagcccccagcctgaccctgagaaacttcctgagcagaaacagactgatgatcacccaccacgccgtgatcctgttcgtgctggtgcccgtggcccagctgaagcagcagcacaccctgctgtacaaggtgaacggcatcctgaccctggccaccttcctgagctgcagaatcctgctgttccccttcatgtactggagctacggcagacagcagggcctgagcctgctgcaggtgcccttcagcatccccttctactgcaacgtggccaacgccttcctggtggccccccagatctactggttctgcctgctgtgcagaaaggccgtgagactgttcgacaccccccaggccaagaaggacggctag

SEQ ID NO: 81190 - DNA, 774 bp, Artificial Sequence
  Description of Artificial Sequence: Synthetic coding sequence
atgctgctgaccctggccggcggcgccctgttcttccccggcctgttcgccctgtgcacctgggccctgagaagaagccagcccggctggagcagaaccgactgcgtgatgatcagcaccagactggtgagcagcgtgcacgccgtgctggccaccggcagcggcatcgtgatcatcagaagctgcgacgacgtgatcaccggcagacactggctggccagagagtacgtgtggttcctgatcccctacatgatctacgacagctacgccatgtacctgtgcgagtggtgcagaaccagagaccagaacagagcccccagcctgaccctgagaaacttcctgagcagaaacagactgatgatcacccaccacgccgtgatcctgttcgtgctggtgcccgtggcccagagactgagaggcgacctgggcgacttcttcgtgggctgcatcttcaccgccgagctgagcacccccttcgtgagcctgggcagagtgctgatccagctgaagcagcagcacaccctgctgtacaaggtgaacggcatcctgaccctggccaccttcctgagctgcagaatcctgctgttccccttcatgtactggagctacggcagacagcagggcctgagcctgctgcaggtgcccttcagcatccccttctactgcaacgtggccaacgccttcctggtggccccccagatctactggttctgcctgctgtgcagaaaggccgtgagactgttcgacaccccccaggccaagaaggacggctag

SEQ ID NO: 81191 - DNA, 993 bp, Artificial Sequence
  Description of Artificial Sequence: Synthetic coding sequence
atgatcagcaccagatacagaagaagaagagacgcccccagaggccccggcagatgccccccccaccccaccagacccagaggccccggcagaaagagaggcgccgccggcagccccggcgccgcccccagcgccagcagaagacccgagttccccaagcccctgagagtgctgccctggagagagagaggcagaggcggcagagagtggcccatgagcctgagaagccccctgcccaccagcgcctgcggctggggcgagagcggcagaagacccggcagagccccctgcggccccagaaccggcctgagcgccagagccgtgctgagcgccagagccagactggtgagcagcgtgcacgccgtgctggccaccggcagcggcatcgtgatcatcagaagctgcgacgacgtgatcaccggcagacactggctggccagagagtacgtgtggttcctgatcccctacatgatctacgacagctacgccatgtacctgtgcgagtggtgcagaaccagagaccagaacagagcccccagcctgaccctgagaaacttcctgagcagaaacagactgatgatcacccaccacgccgtgatcctgttcgtgctggtgcccgtggcccagagactgagaggcgacctgggcgacttcttcgtgggctgcatcttcaccgccgagctgagcacccccttcgtgagcctgggcagagtgctgatccagctgaagcagcagcacaccctgctgtacaaggtgaacggcatcctgaccctggccaccttcctgagctgcagaatcctgctgttccccttcatgtactggagctacggcagacagcagggcctgagcctgctgcaggtgcccttcagcatccccttctactgcaacgtggccaacgccttcctggtggccccccagatctactggttctgcctgctgtgcagaaaggccgtgagactgttcgacaccccccaggccaagaaggacggctag

SEQ ID NO: 81192 - DNA, 741 bp, Artificial Sequence
  Description of Artificial Sequence: Synthetic coding sequence
atggaggcccccgaggccgccgagggcggcctgcagagaggcgccagaagagccgccggcgccagaagccagggcgccctgcccagcggcgaggtgcaccacggcggcgtgaagctgggcatgagaagcatccccatcgccaccgcctgcaccatctaccacaagttcttctgcgagaccaacctggacgcctacgacccctacctgatcgccatgagcagcatctacctggccggcaaggtggaggagcagcacctgagaaccagagacatcatcaacgtgagcaacagatacttcaaccccagcggcgagcccctggagctggacagcagattctgggagctgagagacagcatcgtgcagtgcgagctgctgatgctgagagtgctgagattccaggtgagcttccagcacccccacaagtacctgctgcactacctggtgagcctgcagaactggctgaacagacacagctggcagagaacccccgtggccgtgaccgcctgggccctgctgagagacagctaccacggcgccctgtgcctgagattccaggcccagcacatcgccgtggccgtgctgtacctggccctgcaggtgtacggcgtggaggtgcccgccgaggtggaggccgagaagccctggtggcaggtgttcaacgacgacctgaccaagcccatcatcgacaacatcgtgagcgacctgatccagatctacaccatggacaccgagatcccctag

SEQ ID NO: 81193 - DNA, 585 bp, Artificial Sequence
  Description of Artificial Sequence: Synthetic coding sequence
atggaggccggcgtgaagctgggcatgagaagcatccccatcgccaccgcctgcaccatctaccacaagttcttctgcgagaccaacctggacgcctacgacccctacctgatcgccatgagcagcatctacctggccggcaaggtggaggagcagcacctgagaaccagagacatcatcaacgtgagcaacagatacttcaaccccagcggcgagcccctggagctggacagcagattctgggagctgagagacagcatcgtgcagtgcgagctgctgatgctgagagtgctgagattccaggtgagcttccagcacccccacaagtacctgctgcactacctggtgagcctgcagaactggctgaacagacacagctggcagagaacccccgtggccgtgaccgcctgggccctgctgagagacagctaccacggcgccctgtgcctgagattccaggcccagcacatcgccgtggccgtgctgtacctggccctgcaggtgtacggcgtggaggtgcccgccgaggtggaggccgagaagccctggtggcagatctacaccatggacaccgagatcccctag

SEQ ID NO: 81194 - DNA, 681 bp, Artificial Sequence
  Description of Artificial Sequence: Synthetic coding sequence
atggaggcccccgaggccgccgagggcggcctgcagagaggcgccagaagagccgccggcgccagaagccagggcgccctgcccagcggcgaggtgcaccacggcggcgtgaagctgggcatgagaagcatccccatcgccaccgcctgcaccatctaccacaagttcttctgcgagaccaacctggacgcctacgacccctacctgatcgccatgagcagcatctacctggccggcaaggtggaggagcagcacctgagaaccagagacatcatcaacgtgagcaacagatacttcaaccccagcggcgagcccctggagctggacagcagattctgggagctgagagacagcatcgtgcagtgcgagctgctgatgctgagagtgctgagattccaggtgagcttccagcacccccacaagtacctgctgcactacctggtgagcctgcagaactggctgaacagacacagctggcagagaacccccgtggccgtgaccgcctgggccctgctgagagacagctaccacggcgccctgtgcctgagattccaggcccagcacatcgccgtggccgtgctgtacctggccctgcaggtgtacggcgtggaggtgcccgccgaggtggaggccgagaagccctggtggcagatctacaccatggacaccgagatcccctag

SEQ ID NO: 81195 - DNA, 645 bp, Artificial Sequence
  Description of Artificial Sequence: Synthetic coding sequence
atggaggccggcgtgaagctgggcatgagaagcatccccatcgccaccgcctgcaccatctaccacaagttcttctgcgagaccaacctggacgcctacgacccctacctgatcgccatgagcagcatctacctggccggcaaggtggaggagcagcacctgagaaccagagacatcatcaacgtgagcaacagatacttcaaccccagcggcgagcccctggagctggacagcagattctgggagctgagagacagcatcgtgcagtgcgagctgctgatgctgagagtgctgagattccaggtgagcttccagcacccccacaagtacctgctgcactacctggtgagcctgcagaactggctgaacagacacagctggcagagaacccccgtggccgtgaccgcctgggccctgctgagagacagctaccacggcgccctgtgcctgagattccaggcccagcacatcgccgtggccgtgctgtacctggccctgcaggtgtacggcgtggaggtgcccgccgaggtggaggccgagaagccctggtggcaggtgttcaacgacgacctgaccaagcccatcatcgacaacatcgtgagcgacctgatccagatctacaccatggacaccgagatcccctag

SEQ ID NO: 81196 - DNA, 741 bp, Artificial Sequence
  Description of Artificial Sequence: Synthetic coding sequence
atggaggcccccgagggcggcggcggccccgccgccagaggccccgagggccccgcccccgaggccagagtgcacttcagagtggccagattcatcatggaggccggcgtgaagctgggcatgagaagcatccccatcgccaccgcctgcaccatctaccacaagttcttctgcgagaccaacctggacgcctacgacccctacctgatcgccatgagcagcatctacctggccggcaaggtggaggagcagcacctgagaaccagagacatcatcaacgtgagcaacagatacttcaaccccagcggcgagcccctggagctggacagcagattctgggagctgagagacagcatcgtgcagtgcgagctgctgatgctgagagtgctgagattccaggtgagcttccagcacccccacaagtacctgctgcactacctggtgagcctgcagaactggctgaacagacacagctggcagagaacccccgtggccgtgaccgcctgggccctgctgagagacagctaccacggcgccctgtgcctgagattccaggcccagcacatcgccgtggccgtgctgtacctggccctgcaggtgtacggcgtggaggtgcccgccgaggtggaggccgagaagccctggtggcaggtgttcaacgacgacctgaccaagcccatcatcgacaacatcgtgagcgacctgatccagatctacaccatggacaccgagatcccctag

SEQ ID NO: 81197 - DNA, 429 bp, Artificial Sequence
  Description of Artificial Sequence: Synthetic coding sequence
atggaggccggcgtgaagctgggcatgagaagcatccccatcgccaccgcctgcaccatctaccacaagttcttctgcgagaccaacctggacgcctacgacccctacctgatcgccatgagcagcatctacctggccggcaaggtggaggagcagcacctgagaaccagagacatcatcaacgtgagcaacagattcatcccctggacccagagaagccccaaggtgctggcccaggcctgccccaagagaagccccggctggagcgccgcctggggccactgccaccacgtggccatgaccgccggcccccacagaaccagctgggaggactggctgtgctgctggagaagagccggcgagggcaacggcatgctgcccctgtgccagagcctggaggtggccgtgcaggtgatggtgggcgcctag

SEQ ID NO: 81198 - DNA, 285 bp, Artificial Sequence
  Description of Artificial Sequence: Synthetic coding sequence
tgagccggcaaggtggaggagcagcacctgagaaccagagacatcatcaacgtgagcaacagatacttcaaccccagcggcgagcccctggagctggacagcagattctgggagctgagagacagcatcgtgcagtgcgagctgctgatgctgagagtgctgagattccaggtgagcttccagcacccccacaaggtgttcaacgacgacctgaccaagcccatcatcgacaacatcgtgagcgacctgatccagatctacaccatggacaccgagatcccctag

SEQ ID NO: 81199 - DNA, 366 bp, Artificial Sequence
  Description of Artificial Sequence: Synthetic coding sequence
tgaagatacttcaaccccagcggcgagcccctggagctggacagcagattctgggagctgagagacagcatcgtgcagtgcgagctgctgatgctgagagtgctgagattccaggtgagcttccagcacccccacaagaactggctgaacagacacagctggcagagaacccccgtggccgtgaccgcctgggccctgctgagagacagctaccacggcgccctgtgcctgagattccaggcccagcacatcgccgtggccgtgctgtacctggccctgcaggtgtacggcgtggaggtgcccgccgaggtggaggccgagaagccctggtggcagatctacaccatggacaccgagatcccctag

SEQ ID NO: 81200 - DNA, 3207 bp, Artificial Sequence
  Description of Artificial Sequence: Synthetic coding sequence
atgctggtgggcagccagagcttcagccccggcggccccaacggcatcatcagaagccagagcttcgccggcttcagcggcctgcaggagagaagaagcagatgcaacagcttcatcgagaacagcagcgccctgaagaagccccaggccaagctgaagaagatgcacaacctgggccacaagaacaacaacccccccaaggagccccagcccaagagagtggaggaggtgtacagagccctgaagaacggcctggacgagtacctggaggtgcaccagaccgagctggacaagctgaccgcccagctgaaggacatgaagagaaacagcagactgggcgtgctgtacgacctggacaagcagatcaagaccatcgagagatacatgagaagactggagttccacatcagcaaggtggacgagctgtacgaggcctactgcatccagagaagactgcaggacggcgccagcaagatgaagcaggccttcgccaccagccccgccagcaaggccgccagagagagcctgaccgagatcaacagaagcttcaaggagtacaccgagaacatgtgcaccatcgaggtggagctggagaacctgctgggcgagttcagcatcaagatgaagggcctggccggcttcgccagactgtgccccggcgaccagtacgagatcttcatgaagtacggcagacagagatggaagctgaagggcaagatcgaggtgaacggcaagcagagctgggacggcgaggagaccgtgttcctgcccctgatcgtgggcttcatcagcatcaaggtgaccgagctgaagggcctggccacccacatcctggtgggcagcgtgacctgcgagaccaaggagctgttcgccgccagaccccaggtggtggccgtggacatcaacgacctgggcaccatcaagctgaacctggagatcacctggtaccccttcgacgtggaggacatgaccgccagcagcggcgccggcaacaaggccgccgccctgcagagaagaatgagcatgtacagccagggcacccccgagacccccaccttcaaggaccacagcttcttcagatggctgcaccccagccccgacaagcccagaagactgagcgtgctgagcgccctgcaggacaccttcttcgccaagctgcacagaagcagaagcttcagcgacctgcccagcctgagacccagccccaaggccgtgctggagctgtacagcaacctgcccgacgacatcttcgagaacggcaaggccgccgaggagaagatgcccctgagcctgagcttcagcgacctgcccaacggcgactgcgccctgaccagccacagcaccggcagccccagcaacagcaccaaccccgagatcaccatcacccccgccgagttcaacctgagcagcctggccagccagaacgagggcatggacgacaccagcagcgccagcagcagaaacagcctgggcgagggccaggagcccaagagccacctgaaggaggaggaccccgaggagcccagaaagcccgccagcgcccccagcgaggcctgcagaagacagagcagcggcgccggcgccgagcacctgttcctggagaacgacgtggccgaggccctgctgcaggagagcgaggaggccagcgagctgaagcccgtggagctggacaccagcgagggcaacatcaccaagcagctggtgaagagactgaccagcgccgaggtgcccatggccaccgacagactgctgagcgagggcagcgtgggcggcgagagcgagggctgcagaagcttcctggacggcagcctggaggacgccttcaacggcctgctgctggccctggagccccacaaggagcagtacaaggagttccaggacctgaaccaggaggtgatgaacctggacgacatcctgaagtgcaagcccgccgtgagcagaagcagaagcagcagcctgagcctgaccgtggagagcgccctggagagcttcgacttcctgaacaccagcgacttcgacgaggaggaggacggcgacgaggtgtgcaacgtgggcggcggcgccgacagcgtgttcagcgacaccgagaccgagaagcacagctacagaagcgtgcaccccgaggccagaggccacctgagcgaggccctgaccgaggacaccggcgtgggcaccagcgtggccggcagccccctgcccctgaccaccggcaacgagagcctggacatcaccatcgtgagacacctgcagtactgcacccagctggtgcagcagatcgtgttcagcagcaagacccccttcgtggccagaagcctgctggagaagctgagcagacagatccaggtgatggagaagctggccgccgtgagcgacgagaacatcggcaacatcagcagcgtggtggaggccatccccgagttccacaagaagctgagcctgctgagcttctggaccaagtgctgcagccccgtgggcgtgtaccacagccccgccgacagagtgatgaagcagctggaggccagcttcgccagaaccgtgaacaaggagtaccccggcctggccgaccccgtgttcagaaccctggtgagccagatcctggacagagccgagcccctgctgagcagcagcctgagcagcgaggtggtgaccgtgttccagtactacagctacttcaccagccacggcgtgagcgacctggagagctacctgagccagctggccagacaggtgagcatggtgcagaccctgcagagcctgagagacgagaagctgctgcagaccatgagcgacctggcccccagcaacctgctggcccagcaggaggtgctgagaaccctggccctgctgctgaccagagaggacaacgaggtgagcgaggccgtgaccctgtacctggccgccgccagcaagaaccagcacttcagagagaaggccctgctgtactactgcgaggccctgaccaagaccaacctgcagctgcagaaggccgcctgcctggccctgaagatcctggaggccaccgagagcatcaagatgctggtgaccctgtgccagagcgacaccgaggagatcagaaacgtggccagcgagaccctgctgagcctgggcgaggacggcagactggcctacgagcagctggacaagttccccagagactgcgtgaaggtgggcggcagacacggcaccgaggtggccaccgccttctag

SEQ ID NO: 81201 - DNA, 1776 bp, Artificial Sequence
  Description of Artificial Sequence: Synthetic coding sequence
atgctggtgggcagccagagcttcagccccggcggccccaacggcatcatcagaagccagagcttcgccggcttcagcggcctgcaggagagaagaagcagatgcaacagcttcatcgagaacagcagcgccctgaagaagccccaggccaagctgaagaagatgcacaacctgggccacaagaacaacaacccccccaaggagccccagcccaagagagtggaggaggtgtacagagccctgaagaacggcctggacgagtacctggaggtgcaccagaccgagctggacaagctgaccgcccagctgaaggacatgaagagaaacagcagactgggcgtgctgtacgacctggacaagcagatcaagaccatcgagagatacatgagaagactggagttccacatcagcaaggtggacgagctgtacgaggcctactgcatccagagaagactgcaggacggcgccagcaagatgaagcaggccttcgccaccagccccgccagcaaggccgccagagagagcctgaccgagatcaacagaagcttcaaggagtacaccgagaacatgtgcaccatcgaggtggagctggagaacctgctgggcgagttcagcatcaagatgaagggcctggccggcttcgccagactgtgccccggcgaccagtacgagatcttcatgaagtacggcagacagagatggaagctgaagggcaagatcgaggtgaacggcaagcagagctgggacggcgaggagaccgtgttcctgcccctgatcgtgggcttcatcagcatcaaggtgaccgagctgaagggcctggccacccacatcctggtgggcagcgtgacctgcgagaccaaggagctgttcgccgccagaccccaggtggtggccgtggacatcaacgacctgggcaccatcaagctgaacctggagatcacctggtaccccttcgacgtggaggacatgaccgccagcagcggcgccggcaacaaggccgccgccctgcagagaagaatgagcatgtacagccagggcacccccgagacccccaccttcaaggaccacagcttcttcagcaacctgcccgacgacatcttcgagaacggcaaggccgccgaggagaagatgcccctgagcctgagcttcagcgacctgcccaacggcgactgcgccctgaccagccacagcaccggcagccccagcaacagcaccaaccccgagatcaccatcacccccgccgagttcaacctgagcagcctggccagccagaacgagggcatggacgacaccagcagcgccagcagcagaaacagcctgggcgagggccaggagcccaagagccacctgaaggaggaggaccccgaggagcccagaaagcccgccagcgcccccagcgaggcctgcagaagacagagcagcggcgccggcgccgagcacctgttcctggagaacgacgtggccgaggccctgctgcaggagagcgaggaggccagcgagctgaagcccgtggagctggacaccagcgagggcaacatcaccaagcagctggtgaagagactgaccagcgccgaggtgcccatggccaccgacagactgctgagcgagggcagcgtgggcggcgagagcgagggctgcagaagcttcctggacggcagcctggaggacgccttcaacggcctgctgctggccctggagccccacaaggagcagtacaaggagttccaggacctgaaccaggaggtgatgaacctggacgacatcctgaagaagtag

SEQ ID NO: 81202 - DNA, 1944 bp, Artificial Sequence
  Description of Artificial Sequence: Synthetic coding sequence
atggtgctgcccagcagactgcactggatcagaaacagaccctggagagacagaatcagaagaagacagctgaacagactgcccaccagactgcccgagatcatgctggtgggcagccagagcttcagccccggcggccccaacggcatcatcagaagccagagcttcgccggcttcagcggcctgcaggagagaagaagcagatgcaacagcttcatcgagaacagcagcgccctgaagaagccccaggccaagctgaagaagatgcacaacctgggccacaagaacaacaacccccccaaggagccccagcccaagagagtggaggaggtgtacagagccctgaagaacggcctggacgagtacctggaggtgcaccagaccgagctggacaagctgaccgcccagctgaaggacatgaagagaaacagcagactgggcgtgctgtacgacctggacaagcagatcaagaccatcgagagatacatgagaagactggagttccacatcagcaaggtggacgagctgtacgaggcctactgcatccagagaagactgcaggacggcgccagcaagatgaagcaggccttcgccaccagccccgccagcaaggccgccagagagagcctgaccgagatcaacagaagcttcaaggagtacaccgagaacatgtgcaccatcgaggtggagctggagaacctgctgggcgagttcagcatcaagatgaagggcctggccggcttcgccagactgtgccccggcgaccagtacgagatcttcatgaagtacggcagacagagatggaagctgaagggcaagatcgaggtgaacggcaagcagagctgggacggcgaggagaccgtgttcctgcccctgatcgtgggcttcatcagcatcaaggtgaccgagctgaagggcctggccacccacatcctggtgggcagcgtgacctgcgagaccaaggagctgttcgccgccagaccccaggtggtggccgtggacatcaacgacctgggcaccatcaagctgaacctggagatcacctggtaccccttcgacgtggaggacatgaccgccagcagcggcgccggcaacaaggccgccgccctgcagagaagaatgagcatgtacagccagggcacccccgagacccccaccttcaaggaccacagcttcttcagcaacctgcccgacgacatcttcgagaacggcaaggccgccgaggagaagatgcccctgagcctgagcttcagcgacctgcccaacggcgactgcgccctgaccagccacagcaccggcagccccagcaacagcaccaaccccgagatcaccatcacccccgccgagttcaacctgagcagcctggccagccagaacgagggcatggacgacaccagcagcgccagcagcagaaacagcctgggcgagggccaggagcccaagagccacctgaaggaggaggaccccgaggagcccagaaagcccgccagcgcccccagcgaggcctgcagaagacagagcagcggcgccggcgccgagcacctgttcctggagaacgacgtggccgaggccctgctgcaggagagcgaggaggccagcgagctgaagcccgtggagctggacaccagcgagggcaacatcaccaagcagctggtgaagagactgaccagcgccgaggtgcccatggccaccgacagactgctgagcgagggcagcgtgggcggcgagagcgagggctgcagaagcttcctggacggcagcctggaggacgccttcaacggcctgctgctggccctggagccccacaaggagcagtacaaggagttccaggacctgaaccaggaggtgatgaacctggacgacatcctgaaggacgccaagcacctggacgaccagaagctgaacggcgccgccagctggaccgagatcaccgagggcgagtag

SEQ ID NO: 81203 - DNA, 3144 bp, Artificial Sequence
  Description of Artificial Sequence: Synthetic coding sequence
atgcagttcttcgacgccgaggagctgctggtggacgaggaggacgacgtgttcggcgagggcctgcccaccagactgcccgagatcatgctggtgggcagccagagcttcagccccggcggccccaacggcatcatcagaagccagagcttcgccggcttcagcggcctgcaggagagaagaagcagatgcaacagcttcatcgagaacagcagcgccctgaagaagccccaggccaagctgaagaagatgcacaacctgggccacaagaacaacaacccccccaaggagccccagcccaagagagtggaggaggtgtacagagccctgaagaacggcctggacgagtacctggaggtgcaccagaccgagctggacaagctgaccgcccagctgaaggacatgaagagaaacagcagactgggcgtgctgtacgacctggacaagcagatcaagaccatcgagagatacatgagaagactggagttccacatcagcaaggtggacgagctgtacgaggcctactgcatccagagaagactgcaggacggcgccagcaagatgaagcaggccttcgccaccagccccgccagcaaggccgccagagagagcctgaccgagatcaacagaagcttcaaggagtacaccgagaacatgtgcaccatcgaggtggagctggagaacctgctgggcgagttcagcatcaagatgaagggcctggccggcttcgccagactgtgccccggcgaccagtacgagatcttcatgaagtacggcagacagagatggaagctgaagggcaagatcgaggtgaacggcaagcagagctgggacggcgaggagaccgtgttcctgcccctgatcgtgggcttcatcagcatcaaggtgaccgagctgaagggcctggccacccacatcctggtgggcagcgtgacctgcgagaccaaggagctgttcgccgccagaccccaggtggtggccgtggacatcaacgacctgggcaccatcaagctgaacctggagatcacctggtaccccttcgacgtggaggacatgaccgccagcagcggcgccggcaacaaggccgccgccctgcagagaagaatgagcatgtacagccagggcacccccgagacccccaccttcaaggaccacagcttcttcagcaacctgcccgacgacatcttcgagaacggcaaggccgccgaggagaagatgcccctgagcctgagcttcagcgacctgcccaacggcgactgcgccctgaccagccacagcaccggcagccccagcaacagcaccaaccccgagatcaccatcacccccgccgagttcaacctgagcagcctggccagccagaacgagggcatggacgacaccagcagcgccagcagcagaaacagcctgggcgagggccaggagcccaagagccacctgaaggaggaggaccccgaggagcccagaaagcccgccagcgcccccagcgaggcctgcagaagacagagcagcggcgccggcgccgagcacctgttcctggagaacgacgtggccgaggccctgctgcaggagagcgaggaggccagcgagctgaagcccgtggagctggacaccagcgagggcaacatcaccaagcagctggtgaagagactgaccagcgccgaggtgcccatggccaccgacagactgctgagcgagggcagcgtgggcggcgagagcgagggctgcagaagcttcctggacggcagcctggaggacgccttcaacggcctgctgctggccctggagccccacaaggagcagtacaaggagttccaggacctgaaccaggaggtgatgaacctggacgacatcctgaagtgcaagcccgccgtgagcagaagcagaagcagcagcctgagcctgaccgtggagagcgccctggagagcttcgacttcctgaacaccagcgacttcgacgaggaggaggacggcgacgaggtgtgcaacgtgggcggcggcgccgacagcgtgttcagcgacaccgagaccgagaagcacagctacagaagcgtgcaccccgaggccagaggccacctgagcgaggccctgaccgaggacaccggcgtgggcaccagcgtggccggcagccccctgcccctgaccaccggcaacgagagcctggacatcaccatcgtgagacacctgcagtactgcacccagctggtgcagcagatcgtgttcagcagcaagacccccttcgtggccagaagcctgctggagaagctgagcagacagatccaggtgatggagaagctggccgccgtgagcgacgagaacatcggcaacatcagcagcgtggtggaggccatccccgagttccacaagaagctgagcctgctgagcttctggaccaagtgctgcagccccgtgggcgtgtaccacagccccgccgacagagtgatgaagcagctggaggccagcttcgccagaaccgtgaacaaggagtaccccggcctggccgaccccgtgttcagaaccctggtgagccagatcctggacagagccgagcccctgctgagcagcagcctgagcagcgaggtggtgaccgtgttccagtactacagctacttcaccagccacggcgtgagcgacctggagagctacctgagccagctggccagacaggtgagcatggtgcagaccctgcagagcctgagagacgagaagctgctgcagaccatgagcgacctggcccccagcaacctgctggcccagcaggaggtgctgagaaccctggccctgctgctgaccagagaggacaacgaggtgagcgaggccgtgaccctgtacctggccgccgccagcaagaaccagcacttcagagagaaggccctgctgtactactgcgaggccctgaccaagaccaacctgcagctgcagaaggccgcctgcctggccctgaagatcctggaggccaccgagagcatcaagatgctggtgaccctgtgccagagcgacaccgaggagatcagaaacgtggccagcgagaccctgctgagcctgggcgaggacggcagactggcctacgagcagctggacaagttccccagagactgcgtgaaggtgggcggcagacacggcaccgaggtggccaccgccttctag

SEQ ID NO: 81204 - DNA, 1842 bp, Artificial Sequence
  Description of Artificial Sequence: Synthetic coding sequence
atgctggtgggcagccagagcttcagccccggcggccccaacggcatcatcagaagccagagcttcgccggcttcagcggcctgcaggagagaagaagcagatgcaacagcttcatcgagaacagcagcgccctgaagaagccccaggccaagctgaagaagatgcacaacctgggccacaagaacaacaacccccccaaggagccccagcccaagagagtggaggaggtgtacagagccctgaagaacggcctggacgagtacctggaggtgcaccagaccgagctggacaagctgaccgcccagctgaaggacatgaagagaaacagcagactgggcgtgctgtacgacctggacaagcagatcaagaccatcgagagatacatgagaagactggagttccacatcagcaaggtggacgagctgtacgaggcctactgcatccagagaagactgcaggacggcgccagcaagatgaagcaggccttcgccaccagccccgccagcaaggccgccagagagagcctgaccgagatcaacagaagcttcaaggagtacaccgagaacatgtgcaccatcgaggtggagctggagaacctgctgggcgagttcagcatcaagatgaagggcctggccggcttcgccagactgtgccccggcgaccagtacgagatcttcatgaagtacggcagacagagatggaagctgaagggcaagatcgaggtgaacggcaagcagagctgggacggcgaggagaccgtgttcctgcccctgatcgtgggcttcatcagcatcaaggtgaccgagctgaagggcctggccacccacatcctggtgggcagcgtgacctgcgagaccaaggagctgttcgccgccagaccccaggtggtggccgtggacatcaacgacctgggcaccatcaagctgaacctggagatcacctggtaccccttcgacgtggaggacatgaccgccagcagcggcgccggcaacaaggccgccgccctgcagagaagaatgagcatgtacagccagggcacccccgagacccccaccttcaaggaccacagcttcttcagcaacctgcccgacgacatcttcgagaacggcaaggccgccgaggagaagatgcccctgagcctgagcttcagcgacctgcccaacggcgactgcgccctgaccagccacagcaccggcagccccagcaacagcaccaaccccgagatcaccatcacccccgccgagttcaacctgagcagcctggccagccagaacgagggcatggacgacaccagcagcgccagcagcagaaacagcctgggcgagggccaggagcccaagagccacctgaaggaggaggaccccgaggagcccagaaagcccgccagcgcccccagcgaggcctgcagaagacagagcagcggcgccggcgccgagcacctgttcctggagaacgacgtggccgaggccctgctgcaggagagcgaggaggccagcgagctgaagcccgtggagctggacaccagcgagggcaacatcaccaagcagctggtgaagagactgaccagcgccgaggtgcccatggccaccgacagactgctgagcgagggcagcgtgggcggcgagagcgagggctgcagaagcttcctggacggcagcctggaggacgccttcaacggcctgctgctggccctggagccccacaaggagcagtacaaggagttccaggacctgaaccaggaggtgatgaacctggacgacatcctgaaggacgccaagcacctggacgaccagaagctgaacggcgccgccagctggaccgagatcaccgagggcgagtag

SEQ ID NO: 81205 - DNA, 2673 bp, Artificial Sequence
  Description of Artificial Sequence: Synthetic coding sequence
atgagcgccaacaacagcccccccagcgcccagaagagcgtgctgcccaccgccatccccgccgtgctgcccgccgccagcccctgcagcagccccaagaccggcctgagcgccagactgagcaacggcagcttcagcgcccccagcctgaccaacagcagaggcagcgtgcacaccgtgagcttcctgctgcagatcggcctgaccagagagagcgtgaccatcgaggcccaggagctgagcctgagcgccgtgaaggacctggtgtgcagcatcgtgtaccagaagttccccgagtgcggcttcttcggcatgtacgacaagatcctgctgttcagacacgacatgaacagcgagaacatcctgcagctgatcaccagcgccgacgagatccacgagggcgacctggtggaggtggtgctgagcgccctggccaccgtggaggacttccagatcagaccccacaccctgtacgtgcacagctacaaggcccccaccttctgcgactactgcggcgagatgctgtggggcctggtgagacagggcctgaagtgcgagggctgcggcctgaactaccacaagagatgcgccttcaagatccccaacaactgcagcggcgtgagaaagagaagactgagcaacgtgagcctgcccggccccggcctgagcgtgcccagacccctgcagcccgagtacgtggccctgcccagcgaggagagccacgtgcaccaggagcccagcaagagaatccccagctggagcggcagacccatctggatggagaagatggtgatgtgcagagtgaaggtgccccacaccttcgccgtgcacagctacaccagacccaccatctgccagtactgcaagagactgctgaagggcctgttcagacagggcatgcagtgcaaggactgcaagttcaactgccacaagagatgcgccagcaaggtgcccagagactgcctgggcgaggtgaccttcaacggcgagcccagcagcctgggcaccgacaccgacatccccatggacatcgacaacaacgacatcaacagcgacagcagcagaggcctggacgacaccgaggagcccagcccccccgaggacaagatgttcttcctggaccccagcgacctggacgtggagagagacgaggaggccgtgaagaccatcagccccagcaccagcaacaacatccccctgatgagagtggtgcagagcatcaagcacaccaagagaaagagcagcaccatggtgaaggagggctggatggtgcactacaccagcagagacaacctgagaaagagacactactggagactggacagcaagtgcctgaccctgttccagaacgagagcggcagcaagtactacaaggagatccccctgagcgagatcctgagaatcagcagccccagagacttcaccaacatcagccagggcagcaacccccactgcttcgagatcatcaccgacaccatggtgtacttcgtgggcgagaacaacggcgacagcagccacaaccccgtgctggccgccaccggcgtgggcctggacgtggcccagagctgggagaaggccatcagacaggccctgatgcccgtgaccccccaggccagcgtgtgcaccagccccggccagggcaaggaccacaaggacctgagcaccagcatcagcgtgagcaactgccagatccaggagaacgtggacatcagcaccgtgtaccagatcttcgccgacgaggtgctgggcagcggccagttcggcatcgtgtacggcggcaagcacagaaagaccggcagagacgtggccatcaaggtgatcgacaagatgagattccccaccaagcaggagagccagctgagaaacgaggtggccatcctgcagaacctgcaccaccccggcatcgtgaacctggagtgcatgttcgagacccccgagagagtgttcgtggtgatggagaagctgcacggcgacatgctggagatgatcctgagcagcgagaagagcagactgcccgagagaatcaccaagttcatggtgacccagatcctggtggccctgagaaacctgcacttcaagaacatcgtgcactgcgacctgaagcccgagaacgtgctgctggccagcgccgagcccttcccccaggtgaagctgtgcgacttcggcttcgccagaatcatcggcgagaagagcttcagaagaagcgtggtgggcacccccgcctacctggcccccgaggtgctgagaagcaagggctacaacagaagcctggacatgtggagcgtgggcgtgatcatctacgtgagcctgagcggcaccttccccttcaacgaggacgaggacatcaacgaccagatccagaacgccgccttcatgtacccccccaacccctggagagagatcagcggcgaggccatcgacctgatcaacaacctgctgcaggtgaagatgagaaagagatacagcgtggacaagagcctgagccacccctggctgcaggactaccagacctggctggacctgagagagttcgagaccagaatcggcgagagatacatcacccacgagagcgacgacgccagatgggagatccacgcctacacccacaacctggtgtaccccaagcacttcatcatggcccccaaccccgacgacatggaggaggacccctag

SEQ ID NO: 81206 - DNA, 1233 bp, Artificial Sequence
  Description of Artificial Sequence: Synthetic coding sequence
atgccctacagcaccaacaaggagctgatcctgggcatcatggtgggcaccgccggcatcagcctgctgctgctgtggtaccacaaggtgagaaagcccggcatcgccatgaagctgcccgagttcctgagcctgggcaacaccttcaacagcatcaccctgcaggacgagatccacgacgaccagggcaccaccgtgatcttccaggagagacagctgcagatcctggagaagctgaacgagctgctgaccaacatggaggagctgaaggaggagatcagattcctgaaggaggccatccccaagctggaggagtacatccaggacgagctgggcggcaagatcaccgtgcacaagatcagcccccagcacagagccagaaagagaagactgcccaccatccagagcagcgccaccagcaacagcagcgaggaggccgagagcgagggcggctacatcaccgccaacaccgacaccgaggagcagagcttccccgtgcccaaggccttcaacaccagagtggaggagctgaacctggacgtgctgctgcagaaggtggaccacctgagaatgagcgagagcggcaagagcgagagcttcgagctgctgagagaccacaaggagaagttcagagacgagatcgagttcatgtggagattcgccagagcctacggcgacatgtacgagctgagcaccaacacccaggagaagaagcactacgccaacatcggcaagaccctgagcgagagagccatcaacagagcccccatgaacggccactgccacctgtggtacgccgtgctgtgcggctacgtgagcgagttcgagggcctgcagaacaagatcaactacggccacctgttcaaggagcacctggacatcgccatcaagctgctgcccgaggagcccttcctgtactacctgaagggcagatactgctacaccgtgagcaagctgagctggatcgagaagaagatggccgccaccctgttcggcaagatccccagcagcaccgtgcaggaggccctgcacaacttcctgaaggccgaggagctgtgccccggctacagcaaccccaactacatgtacctggccaagtgctacaccgacctggaggagaaccagaacgccctgaagttctgcaacctggccctgctgctgcccaccgtgaccaaggaggacaaggaggcccagaaggagatgcagaagatcatgaccagcctgaagagatag

SEQ ID NO: 81207 - DNA, 1233 bp, Artificial Sequence; identical to SEQ ID NO: 81206
  Description of Artificial Sequence: Synthetic coding sequence

SEQ ID NO: 81208 - DNA, 528 bp, Artificial Sequence
  Description of Artificial Sequence: Synthetic coding sequence
atgccctacagcaccaacaaggagctgatcctgggcatcatggtgggcaccgccggcatcagcctgctgctgctgtggtaccacaaggtgagaaagcccggcatcgccatgaagctgcccgagttcctgagcctgggcaacaccttcaacagcatcaccctgcaggacgagatccacgacgaccagggcaccaccgtgatcttccaggagagacagctgcagatcctggagaagctgaacgagctgctgaccaacatggaggagctgaaggaggagatcagattcctgaaggaggccatccccaagctggaggagtacatccaggacgagctgggcggcaagatcaccgtgcacaagatcagcccccagcacagagccagaaagagaagactgcccaccatccagagcagcgccaccagcaacagcagcgaggaggccgagagcgagggcggctacatcaccgccaacaccgacaccgaggagcagagcttccccgtgcccaaggccttcaacaccagagtggagtag

SEQ ID NO: 81209 - DNA, 798 bp, Artificial Sequence
  Description of Artificial Sequence: Synthetic coding sequence
atgggcaagtgcctgagatacatcaccgccaacaccgacaccgaggagcagagcttccccgtgcccaaggccttcaacaccagagtggaggagctgaacctggacgtgctgctgcagaaggtggaccacctgagaatgagcgagagcggcaagagcgagagcttcgagctgctgagagaccacaaggagaagttcagagacgagatcgagttcatgtggagattcgccagagcctacggcgacatgtacgagctgagcaccaacacccaggagaagaagcactacgccaacatcggcaagaccctgagcgagagagccatcaacagagcccccatgaacggccactgccacctgtggtacgccgtgctgtgcggctacgtgagcgagttcgagggcctgcagaacaagatcaactacggccacctgttcaaggagcacctggacatcgccatcaagctgctgcccgaggagcccttcctgtactacctgaagggcagatactgctacaccgtgagcaagctgagctggatcgagaagaagatggccgccaccctgttcggcaagatccccagcagcaccgtgcaggaggccctgcacaacttcctgaaggccgaggagctgtgccccggctacagcaaccccaactacatgtacctggccaagtgctacaccgacctggaggagaaccagaacgccctgaagttctgcaacctggccctgctgctgcccaccgtgaccaaggaggacaaggaggcccagaaggagatgcagaagatcatgaccagcctgaagagatag

SEQ ID NO: 81210 - DNA, 453 bp, Artificial Sequence
  Description of Artificial Sequence: Synthetic coding sequence
tgagtgctgtgcggctacgtgagcgagttcgagggcctgcagaacaagatcaactacggccacctgttcaaggagcacctggacatcgccatcaagctgctgcccgaggagcccttcctgtactacctgaagggcagatactgctacaccgtgagcaagctgagctggatcgagaagaagatggccgccaccctgttcggcaagatccccagcagcaccgtgcaggaggccctgcacaacttcctgaaggccgaggagctgtgccccggctacagcaaccccaactacatgtacctggccaagtgctacaccgacctggaggagaaccagaacgccctgaagttctgcaacctggccctgctgctgcccaccgtgaccaaggaggacaaggaggcccagaaggagatgcagaagatcatgaccagcctgaagagactgagaaagaccaagtag

SEQ ID NO: 81211 - DNA, 717 bp, Artificial Sequence
  Description of Artificial Sequence: Synthetic coding sequence
atgggcaagtgcctgagatacatcaccgccaacaccgacaccgaggagcagagcttccccgtgcccaaggccttcaacaccagagtggaggagctgaacctggacgtgctgctgcagaaggtggaccacctgagaatgagcgagagcggcaagagcgagagcttcgagctgctgagagaccacaaggagaagttcagagacgagatcgagttcatgtggagattcgccagagcctacggcgacatgtacgagctgagcaccaacacccaggagaagaagcactacgccaacatcggcaagaccctgagcgagagagccatcaacagagcccccatgaacggccactgccacctgtggtacgccgtgctgtgcggctacgtgagcgagttcgagggcctgcagaacaagatcaactacggccacctgttcaaggagcacctggacatcgccatcaagctgctgcccgaggagcccttcctgtactacctgaagggcagatactgctacaccgtgagcaagctgagctggatcgagaagaagatggccgccaccctgttcggcaagatccccagcagcaccgtgcaggaggccctgcacaacttcctgaaggccgaggagctgtgccccggctacagcaaccccaactacatgtacctggccaagtgctacaccgacctggaggagaaccagaacgccctgaagttctgcaacctgtag

SEQ ID NO: 81212 - DNA, 1413 bp, Artificial Sequence
  Description of Artificial Sequence: Synthetic coding sequence
atgagcagactgggcgccctgggcggcgccagagccggcctgggcctgctgctgggcaccgccgccggcctgggcttcctgtgcctgctgtacagccagagatggaagagaacccagagacacggcagaagccagagcctgcccaacagcctggactacacccagaccagcgaccccggcagacacgtgatgctgctgagagccgtgcccggcggcgccggcgacgccagcgtgctgcccagcctgcccagagagggccaggagaaggtgctggacagactggacttcgtgctgaccagcctggtggccctgagaagagaggtggaggagctgagaagcagcctgagaggcctggccggcgagatcgtgggcgaggtgagatgccacatggaggagaaccagagagtggccagaagaagaagattccccttcgtgagagagagaagcgacagcaccggcagcagcagcgtgtacttcaccgccagcagcggcgccaccttcaccgacgccgagagcgagggcggctacaccaccgccaacgccgagagcgacaacgagagagacagcgacaaggagagcgaggacggcgaggacgaggtgagctgcgagaccgtgaagatgggcagaaaggacagcctggacctggaggaggaggccgccagcggcgccagcagcgccctggaggccggcggcagcagcggcctggaggacgtgctgcccctgctgcagcaggccgacgagctgcacagaggcgacgagcagggcaagagagagggcttccagctgctgctgaacaacaagctggtgtacggcagcagacaggacttcctgtggagactggccagagcctacagcgacatgtgcgagctgaccgaggaggtgagcgagaagaagagctacgccctggacggcaaggaggaggccgaggccgccctggagaagggcgacgagagcgccgactgccacctgtggtacgccgtgctgtgcggccagctggccgagcacgagagcatccagagaagaatccagagcggcttcagcttcaaggagcacgtggacaaggccatcgccctgcagcccgagaaccccatggcccacttcctgctgggcagatggtgctaccaggtgagccacctgagctggctggagaagaagaccgccaccgccctgctggagagccccctgagcgccaccgtggaggacgccctgcagagcttcctgaaggccgaggagctgcagcccggcttcagcaaggccggcagagtgtacatcagcaagtgctacagagagctgggcaagaacagcgaggccagatggtggatgaagctggccctggagctgcccgacgtgaccaaggaggacctggccatccagaaggacctggaggagctggaggtgatcctgagagactag

SEQ ID NO: 81213 - DNA, 1413 bp, Artificial Sequence; identical to SEQ ID NO: 81212
  Description of Artificial Sequence: Synthetic coding sequence

SEQ ID NO: 81214 - DNA, 1224 bp, Artificial Sequence
  Description of Artificial Sequence: Synthetic coding sequence
atgctgctgagagccgtgcccggcggcgccggcgacgccagcgtgctgcccagcctgcccagagagggccaggagaaggtgctggacagactggacttcgtgctgaccagcctggtggccctgagaagagaggtggaggagctgagaagcagcctgagaggcctggccggcgagatcgtgggcgaggtgagatgccacatggaggagaaccagagagtggccagaagaagaagattccccttcgtgagagagagaagcgacagcaccggcagcagcagcgtgtacttcaccgccagcagcggcgccaccttcaccgacgccgagagcgagggcggctacaccaccgccaacgccgagagcgacaacgagagagacagcgacaaggagagcgaggacggcgaggacgaggtgagctgcgagaccgtgaagatgggcagaaaggacagcctggacctggaggaggaggccgccagcggcgccagcagcgccctggaggccggcggcagcagcggcctggaggacgtgctgcccctgctgcagcaggccgacgagctgcacagaggcgacgagcagggcaagagagagggcttccagctgctgctgaacaacaagctggtgtacggcagcagacaggacttcctgtggagactggccagagcctacagcgacatgtgcgagctgaccgaggaggtgagcgagaagaagagctacgccctggacggcaaggaggaggccgaggccgccctggagaagggcgacgagagcgccgactgccacctgtggtacgccgtgctgtgcggccagctggccgagcacgagagcatccagagaagaatccagagcggcttcagcttcaaggagcacgtggacaaggccatcgccctgcagcccgagaaccccatggcccacttcctgctgggcagatggtgctaccaggtgagccacctgagctggctggagaagaagaccgccaccgccctgctggagagccccctgagcgccaccgtggaggacgccctgcagagcttcctgaaggccgaggagctgcagcccggcttcagcaaggccggcagagtgtacatcagcaagtgctacagagagctgggcaagaacagcgaggccagatggtggatgaagctggccctggagctgcccgacgtgaccaaggaggacctggccatccagaaggacctggaggagctggaggtgatcctgagagactag

SEQ ID NO: 81215 - DNA, 864 bp, Artificial Sequence
  Description of Artificial Sequence: Synthetic coding sequence
atgagcagactgggcgccctgggcggcgccagagccggcctgggcctgctgctgggcaccgccgccggcctgggcttcctgtgcctgctgtacagccagagatggaagagaacccagagacacggcagaagccagagcctgcccaacagcctggactacacccagaccagcgaccccggcagacacgtgatgctgctgagagccgtgcccggcggcgccggcgacgccagcgtgctgcccagcctgcccagagagggccaggagaaggtgctggacagactggacttcgtgctgaccagcctggtggccctgagaagagaggtggaggagctgagaagcagcctgagaggcctggccggcgagatcgtgggcgaggtgagatgccacatggaggagaaccagagagtggccagaagaagaagattccccttcgtgagagagagaagcgacagcaccggcagcagcagcgtgtacttcaccgccagcagcggcgccaccttcaccgacgccgagagcgagggcggctacaccaccgccaacgccgagagcgacaacgagagagacagcgacaaggagagcgaggacggcgaggacgaggtgagctgcgagaccgtgaagatgggcagaaaggacagcctggacctggaggaggaggccgccagcggcgccagcagcgccctggaggccggcggcagcagcggcctggaggacgtgctgcccctgctgcagcaggccgacgagctgcacagaggcgacgagcagggcaagagagagggcttccagctgctgctgaacaacaagctggtgtacggcagcagacaggacttcctgtggagactggccagagcctacagcgacatgtag

SEQ ID NO: 81216 - DNA, 945 bp, Artificial Sequence
  Description of Artificial Sequence: Synthetic coding sequence
atggccctggccgccagactgtggagactgctgcccttcagaagaggcgccgcccccggcagcagactgcccgccggcaccagcggcagcagaggccactgcggcccctgcagattcagaggcttcgaggtgatgggcaaccccggcaccttcaagagaggcctgctgctgagcgccctgagctacctgggcttcgagacctaccaggtgatcagccaggccgccgtggtgcacgccaccgccaaggtggaggagatcctggagcaggccgactacctgtacgagagcggcgagaccgagaagctgtaccagctgctgacccagtacaaggagagcgaggacgccgagctgctgtggagactggccagagccagcagagacgtggcccagctgagcagaaccagcgaggaggagaagaagctgctggtgtacgaggccctggagtacgccaagagagccctggagaagaacgagagcagcttcgccagccacaagtggtacgccatctgcctgagcgacgtgggcgactacgagggcatcaaggccaagatcgccaacgcctacatcatcaaggagcacttcgagaaggccatcgagctgaaccccaaggacgccaccagcatccacctgatgggcatctggtgctacaccttcgccgagatgccctggtaccagagaagaatcgccaagatgctgttcgccaccccccccagcagcacctacgagaaggccctgggctacttccacagagccgagcaggtggaccccaacttctacagcaagaacctgctgctgctgggcaagacctacctgaagctgcacaacaagaagctggccgccttctggctgatgaaggccaaggactaccccgcccacaccgaggaggacaagcagatccagaccgaggccgcccagctgctgaccagcttcagcgagaagaactag

SEQ ID NO: 81217 - DNA, 855 bp, Artificial Sequence
  Description of Artificial Sequence: Synthetic coding sequence
atggccctggccgccagactgtggagactgctgcccttcagaagaggcgccgcccccggcagcagactgcccgccggcaccagcggcagcagaggccactgcggcccctgcagattcagaggcttcgaggtgatgggcaaccccggcaccttcaagagaggcctgctgctgagcgccctgagctacctgggcttcgagacctaccaggtgatcagccaggccgccgtggtgcacgccaccgccaaggtggaggagatcctggagcaggccgactacctgtacgagagcggcgagaccgagaagctgtaccagctgctgacccagtacaaggagagcgaggacgccgagctgctgtggagactggccagagccagcagagacgtggcccagctgagcagaaccagcgaggaggagaagaagctgctggtgtacgaggccctggagtacgccaagagagccctggagaagaacgagagcagcttcgccagccacaagaaggccatcgagctgaaccccaaggacgccaccagcatccacctgatgggcatctggtgctacaccttcgccgagatgccctggtaccagagaagaatcgccaagatgctgttcgccaccccccccagcagcacctacgagaaggccctgggctacttccacagagccgagcaggtggaccccaacttctacagcaagaacctgctgctgctgggcaagacctacctgaagctgcacaacaagaagctggccgccttctggctgatgaaggccaaggactaccccgcccacaccgaggaggacaagcagatccagaccgaggccgcccagctgctgaccagcttcagcgagaagaactag

SEQ ID NO: 81218 - DNA, 3540 bp, Artificial Sequence
  Description of Artificial Sequence: Synthetic coding sequence
atggccagaagaagccagagcagcagccagggcgacaaccccctggcccccggctacctgcccccccactacaaggagtactacagactggccgtggacgccctggccgagggcggcagcgaggcctacagcagattcctggccaccgagggcgcccccgacttcctgtgccccgaggagctggagcacgtgagcagacacctgagacccccccagtacgtgaccagagagccccccgagggcagcctgctggacgtggacatggacggcagcagcggcacctactggcccgtgaacagcgaccaggccgtgcccgagctggacctgggctggcccctgaccttcggcttccagggcaccgaggtgaccaccctggtgcagccccccccccccgacagccccagcatcaaggacgaggccagaagaatgatcagaagcgcccagcaggtggtggccgtggtgatggacatgttcaccgacgtggacctgctgagcgaggtgctggaggccgccgccagaagagtgcccgtgtacatcctgctggacgagatgaacgcccagcacttcctggacatggccgacaagtgcagagtgaacctgcagcacgtggacttcctgagagtgagaaccgtggccggccccacctactactgcagaaccggcaagagcttcaagggccacgtgaaggagaagttcctgctggtggactgcgccgtggtgatgagcggcagctacagcttcatgtggagcttcgagaagatccacagaagcctggcccacgtgttccagggcgagctggtgagcagcttcgacgaggagttcagaatcctgttcgcccagagcgagcccctggtgcccagcgccgccgccctggccagaatggacgcctacgccctggccccctacgccggcgccggccccctggtgggcgtgcccggcgtgggcgcccccacccccttcagcttccccaagagagcccacctgctgttccccccccccagagaggagggcctgggcttccccagcttcctggaccccgacagacacttcctgagcgccttcagaagagaggagccccccagaatgcccggcggcgccctggagccccacgccggcctgagacccctgagcagaagactggaggccgaggccggccccgccggcgagctggccggcgccagaggcttcttccaggccagacacctggagatggacgccttcaagagacacagcttcgccaccgagggcgccggcgccgtggagaacttcgccgccgccagacaggtgagcagacagaccttcctgagccacggcgacgacttcagattccagaccagccacttccacagagaccagctgtaccagcagcagtaccagtgggacccccagctgacccccgccagaccccagggcctgttcgagaagctgagaggcggcagagccggcttcgccgaccccgacgacttcaccctgggcgccggccccagattccccgagctgggccccgacggccaccagagactggactacgtgcccagcagcgccagcagagaggtgagacacggcagcgaccccgccttcgcccccggccccagaggcctggagcccagcggcgcccccagacccaacctgacccagagattcccctgccaggccgccgccagacccggccccgaccccgcccccgaggccgagcccgagagaagaggcggccccgagggcagagccggcctgagaagatggagactggccagctacctgagcggctgccacggcgaggacggcggcgacgacggcctgcccgcccccatggaggccgaggcctacgaggacgacgtgctggcccccggcggcagagcccccgccggcgacctgctgcccagcgccttcagagtgcccgccgccttccccaccaaggtgcccgtgcccggccccggcagcggcggcaacggccccgagagagagggccccgaggagcccggcctggccaagcaggacagcttcagaagcagactgaaccccctggtgcagagaagcagcagactgagaagcagcctgatcttcagcaccagccaggccgagggcgccgccggcgccgccgccgccaccgagaaggtgcagctgctgcacaaggagcagaccgtgagcgagaccctgggccccggcggcgaggccgtgagaagcgccgccagcaccaaggtggccgagctgctggagaagtacaagggccccgccagagaccccggcggcggcgccggcgccatcaccgtggccagccacagcaaggccgtggtgagccaggcctggagagaggaggtggccgcccccggcgccgtgggcggcgagagaagaagcctggagagctgcctgctggacctgagagacagcttcgcccagcagctgcaccaggaggccgagagacagcccggcgccgccagcctgaccgccgcccagctgctggacaccctgggcagaagcggcagcgacagactgcccagcagattcctgagcgcccagagccacagcaccagcccccagggcctggacagccccctgcccctggagggcagcggcgcccaccaggtgctgcacaacgagagcaagggcagccccaccagcgcctaccccgagagaaagggcagccccacccccggcttcagcaccagaagaggcagccccaccaccggcttcatcgagcagaagggcagccccaccagcgcctaccccgagagaagaggcagccccgtgccccccgtgcccgagagaagaagcagccccgtgccccccgtgcccgagagaagaggcagcctgaccctgaccatcagcggcgagagccccaaggccggccccgccgaggagggccccagcggccccatggaggtgctgagaaagggcagcctgagactgagacagctgctgagccccaagggcgagagaagaatggaggacgagggcggcttccccgtgccccaggagaacggccagcccgagagccccagaagactgagcctgggccagggcgacagcaccgaggccgccaccgaggagagaggccccagagccagactgagcagcgccaccgccaacgccctgtacagcagcaacctgagagacgacaccaaggccatcctggagcagatcagcgcccacggccagaagcacagagccgtgcccgcccccagccccggccccacccacaacagccccgagctgggcagaccccccgccgccggcgtgctggcccccgacatgagcgacaaggacaagtgcagcgccatcttcagaagcgacagcctgggcacccagggcagactgagcagaaccctgcccgccagcgccgaggagagagacagactgctgagaagaatggagagcatgagaaaggagaagagagtgtacagcagattcgaggtgttctgcaagaaggaggaggccagcagccccggcgccggcgagggccccgccgaggagggcaccagagacagcaaggtgggcaagttcgtgcccaagatcctgggcaccttcaagagcaagaagtag

SEQ ID NO: 81219 - DNA, 933 bp, Artificial Sequence
  Description of Artificial Sequence: Synthetic coding sequence
atgggcaaccaggtggagaagctgacccacctgagctacaaggaggtgcccaccgccgaccccaccggcgtggacagagacgacggccccagaatcggcgtgagctacatcttcagcaacgacgacgaggacgtggagccccagccccccccccagggccccgacggcggcggcctgcccgacggcggcgacggccccccccccccccagccccagccctacgaccccagactgcacgaggtggagtgcagcgtgttctacagagacgagtgcatctaccagaagagcttcgcccccggcagcgccgccctgagcacctacacccccgagaacctgctgaacaagtgcaagcccggcgacctggtggagttcgtgagccaggcccagtacccccactgggccgtgtacgtgggcaacttccaggtggtgcacctgcacagactggaggtgatcaacagcttcctgaccgacgccagccagggcagaagaggcagagtggtgaacgacctgtacagatacaagcccctgagcagcagcgccgtggtgagaaacgccctggcccacgtgggcgccaaggagagagagctgagctggagaaacagcgagagcttcgccgcctggtgcagatacggcaagagagagttcaagatcggcggcgagctgagaatcggcaagcagccctacagactgcagatccagctgagcgcccagagaagccacaccctggagttccagagcctggaggacctgatcatggagaagagaagaaacgaccagatcggcagagccgccgtgctgcaggagctggccacccacctgcaccccgccgagcccgaggagggcgacagcaacgtggccagaaccacccccccccccggcagaccccccgcccccagcagcgaggaggaggacggcgaggccgtggcccactag

SEQ ID NO: 81220 - DNA, 999 bp, Artificial Sequence
  Description of Artificial Sequence: Synthetic coding sequence
atggagcccgtgggcagaaagagaagcagaaaggccgccaaggcccagctggaggcccaggtgaccgccgcccagggcgccaccaaggagggcagcggcatcgccagcaacttccccggccagcccaccatggagcccgtgggcagaaagagaagcagaaaggccgccaaggcccagctggaggcccaggtgagagccgcccccgccaagaagcacaccggcaaggaccccgtgagagacgagtgcgaggagagaaaccccttcaccgagaccagagaggaggacgtgaccgacgagcacggcgagagagagcccttcgccgagaaggacgagcacaccggcatccacaccatgaagctggagcacatcgccgccgacatcaagaagggcctggccgccaagagagagatgatcaagatcgacaaggccgcctacagaaagaccaagaacaccatcgagagagccctgaagaagaagcagctgaagagacagaagagagactacagacacaccagaaagctgctgaacgtgctgaaggagtacatcgccgagaagcagaaggacgacgaggccgaggaggccgaggccgccgccgccgccgccgaggccgccgccgccgccgaggccgccgccgccgccgccgaggtgatcgtggtggaggacgaggaggaggaggagaaggaggaggaggaggagaaggaggaggaggaggaggagggcgaggaggagggcggcggcgaggagggcgaggagggcggcggcggcggcgagggcgaggagaccgaggaggaggaggaggaggaggaggaggaggaggaggaggagcagatcaaggccttccaggagaagcagaagagatggcagcagcccaccggcgtgagaagctggagactgagagagatgaagcccctgctggagcagctgctgaaggccgccaaggacaccaaggacaactactgcatcatcagcagcagcgaggagagcgagctggacaactag

SEQ ID NO: 81221 - DNA, 999 bp, Artificial Sequence; identical to SEQ ID NO: 81220
  Description of Artificial Sequence: Synthetic coding sequence

SEQ ID NO: 81222 - DNA, 561 bp, Artificial Sequence
  Description of Artificial Sequence: Synthetic coding sequence
atggccgcctggggcaagaagcacgccggcaaggaccccgtgagagacgagtgcgaggagagaaacagattcaccgagaccagagaggaggacgtgaccgacgagcacggcgagagagagcccttcgccgagaccgacgagcacaccggcgccaacaccaagaagcccgaggacaccgccgaggacctgaccgccaagagaaagagaatgaagatggacaagacctgcagcaagaccaagaacaagagcaagcacgccctgagaaagaagcagctgaagagacagaagagagactacatccacagcctgaagctgctgaacgtgctggaggagtacatcaccgacgagcagaaggaggaggaggaggaggagggcgaggaggaggagctgatcagaatcttccaggagcagcagaagaagtggcagcagtacagaagcgtgagaagagagagactgaaggagatgaagctgctgagagaccagttcgtgaaggccctggaggacttcgaggacctgtgcgacagagtgttcagcgacgaggacagcgagctggacaactag

SEQ ID NO: 81223 - DNA, 681 bp, Artificial Sequence
  Description of Artificial Sequence: Synthetic coding sequence
atgcccggcttcctgagcttcctgagcgtgagcctgagaagccccggcagcggcatcgccagcagcttccccggccagcccgccaccgaccccgtgggcagaagagccgccaaggcccagctggaggcccagttcatggccgcctggggcaagaagcacgccggcaaggaccccgtgagagacgagtgcgaggagagaaacagattcaccgagaccagagaggaggacgtgaccgacgagcacggcgagagagagcccttcgccgagaccgacgagcacaccggcgccaacaccaagaagcccgaggacaccgccgtgggcgccaacaacttcaagaactaccccgtgcacatcggcgtgagcagcgagcagcacatcctgctggactgcagcctgagcagacagaagagagactacatccacagcctgaagctgctgaacgtgctggaggagtacatcaccgacgagcagaaggaggaggaggaggaggagggcgaggaggaggagctgatcagaatcttccaggagcagcagaagaagtggcagcagtacagaagcgtgagaagagagagactgaaggagatgaagctgctgagagaccagttcgtgaaggccctggaggacttcgaggacctgtgcgacagagtgttcagcgacgaggacagcgagctggacaactag

SEQ ID NO: 81224 - DNA, 561 bp, Artificial Sequence; identical to SEQ ID NO: 81222
  Description of Artificial Sequence: Synthetic coding sequence

SEQ ID NO: 81225 - DNA, 501 bp, Artificial Sequence
  Description of Artificial Sequence: Synthetic coding sequence
atggccgccaaggaccagctggaggtgcaggtgatggccgcccaggagatggagctggccggcaaggaccccgtgagccacgagcacgaggagagaaagcccgtgaccgagaccaaggagggcgacgtgaccgacgagcacggcgagagaggcagcttcgccgagaccgacgagcacaccggcgtggacaccaaggagctggaggacatcgccgccgacatcaaggagcacctggccgccaagagaaagagaatcgagaagatcgccaaggcctgcagcgagatcaagaacagaatcaagaacgtgctgagaaccacccagctgaagagacagaagagagactacagaatcagcctgaagctgcccaacgtgctggaggagttcatcaccgacgagcagaaggacgaggagggcgacggcgagaaggaggagcagatcaagatcttccaggagcagcagaagagatggcagcaggacggcaagggcaccgagagagactag

SEQ ID NO: 81226 - DNA, 501 bp, Artificial Sequence; identical to SEQ ID NO: 81225
  Description of Artificial Sequence: Synthetic coding sequence

SEQ ID NO: 81227 - DNA, 381 bp, Artificial Sequence
  Description of Artificial Sequence: Synthetic coding sequence
tgagacgtgaccgacgagcacggcgagagaggcagcttcgccgagaccgacgagcacaccggcgtggacaccaaggagctggaggacatcgccgccgacatcaaggagcacctggccgccaagagaaagagaatcgagaagatcgccaaggcctgcagcgagatcaagaacagaatcaagaacgtgctgagaaccacccagctgaagagacagaagagagactacagaatcagcctgaagctgcccaacgtgctggaggagttcatcaccgacgagcagaaggacgaggagggcgacggcgagaaggaggagcagatcaagatcttccaggagcagcagaagagatggcagcaggacggcaagggcaccgagagagactag

SEQ ID NO: 81228 - DNA, 387 bp, Artificial Sequence
  Description of Artificial Sequence: Synthetic coding sequence
atggccgccaaggaccagctggaggtgcaggtgatggccgcccaggagatggagctggccggcaaggaccccgtgagccacgagcacgaggagagaaagcccgtgaccgagaccaaggagggcgacgtgaccgacgagcacggcgagagaggcagcttcgccgagaccgacgagcacaccggcgtggacaccaaggagctggaggacatcgccggcatgttctacgagctgttcgtggtgtacgagaactgcttccagccctacaacccctacagcagactgtacgagctggtggacgacaagaccgtgctgaacgccttcttcagctacatcgccttcaacgtgatctgcctgatcatcttcctgacctacttcttcaactgctag

SEQ ID NO: 81229 - DNA, 1395 bp, Artificial Sequence
  Description of Artificial Sequence: Synthetic coding sequence
atgatggccagaagagaccccaagcccggcgccaagagactggtgagagcccagaccctgcagaagcagagaagagcccccgtgggccccagagcccccccccccgacgaggaggaccccagactgaagtgcaagaactgcgaggccttcggccacaccgccagaagcaccagatgccccatgaagtgctggaaggccgccctggtgccccccaacttcggcgagaaggagggcaaggagaacctgaagccctggaagccccaggtggaggccaaccccggccccctgaacaaggacaagggcgagaaggaggagagacccagaccccaggacccccagagaaaggccctgctgcacatcttcagcagaaagccccccgagaagcccctgcccaaccagaagggcagcaccgagagcagcgactacctgagagtggccagcggccccatgcccgtgcacaccaccagcaagagacccagagtggaccccgtgctgagcgacagaagcgccaccgagatgagcgacagaggcagcgtgctggccagcctgagccccctgagaaaggccagcctgagcagcagcagcagcctgggccccaaggagagacagaccggcgccgccgccgacatcccccagaccgccgtgagacaccagggccccgagcccctgctggtggtgaagcccacccacagcagccccgccggcggctgcagagaggtgccccaggccgccagcaagacccacggcctgctgcaggccgtgagcccccaggcccaggacaagagacccgccgtgaccagccagccctgcccccccgccgccacccacagcctgggcctgggcagcaacctgagcttcggccccggcgccaagagaagcgcccccgcccccatccaggcctgcctgaacttccccaagaagcccagactgggccccttccagatccccgagagcgccatccagggcggcgagctgggcgcccccgagaacctgcagcccccccccgccgccaccgagctgggccccagaaccagcccccagaccggcaccagaacccccgcccaggtgctgagcggcgacagacagcccccccacagcagaccctgcctgcccaccgcccaggcctgcaccatgagccaccaccccgccgccagccacgacggcgcccagcccctgagagtgctgttcagaagactggagaacggcagatggagcagcagcctgctgaccgcccccagcttccacagccccgagaagcccggcgccttcctggcccagagcccccacgtgagcgagaagagcgagggcccctgcgtgagagtgccccccagcgtgctgtacgaggacctgcaggtgcccagcagcagcgaggacagcgacagcgacctggagtag

SEQ ID NO: 81230 - DNA, 45 bp, Artificial Sequence
  Description of Artificial Sequence: Synthetic coding sequence
atgatggccagaagagaccccaagcccggcgccaagagactgtag

SEQ ID NO: 81231 - DNA, 1395 bp, Artificial Sequence; identical to SEQ ID NO: 81229
  Description of Artificial Sequence: Synthetic coding sequence

SEQ ID NO: 81232 - DNA, 1143 bp, Artificial Sequence
  Description of Artificial Sequence: Synthetic coding sequence
atggccgtgaccgaggccagcctgctgagacagtgccccctgctgctgccccagaacagaagcaagaccgtgtacgagggcttcatcagcgcccagggcagagacttccacctgagaatcgtgctgcccgaggacctgcagctgaagaacgccagactgctgtgcagctggcagctgagaaccatcctgagcggctaccacagaatcgtgcagcagagaatgcagcacagccccgacctgatgagcttcatgatggagctgaagatgctgctggaggtggccctgaagaacagacaggagctgtacgccctgcccccccccccccagttctacagcagcctgatcgaggagatcggcaccctgggctgggacaagctggtgtacgccgacacctgcttcagcaccatcaagctgaaggccgaggacgccagcggcagagagcacctgatcaccctgaagctgaaggccaagtaccccgccgagagccccgactacttcgtggacttccccgtgcccttctgcgccagctggaccccccaggtgaacagcccccagagcagcctgatcagcatctacagccagttcctggccgccatcgagagcctgaaggccttctgggacgtgatggacgagatcgacgagaagacctgggtgctggagcccgagaagccccccagaagcgccaccgccagaagaatcgccctgggcaacaacgtgagcatcaacatcgaggtggaccccagacaccccaccatgctgcccgagtgcttcttcctgggcgccgaccacgtggtgaagcccctgggcatcaagctgagcagaaacatccacctgtgggaccccgagaacagcgtgctgcagaacctgaaggacgtgctggagatcgacttccccgccagagccatcctggagaagagcgacttcaccatggactgcggcatctgctacgcctaccagctggacggcaccatccccgaccaggtgtgcgacaacagccagtgcggccagcccttccaccagatctgcctgtacgagtggctgagaggcctgctgaccagcagacagagcttcaacatcatcttcggcgagtgcccctactgcagcaagcccatcaccctgaagatgagcggcagaaagcactag

SEQ ID NO: 81233 - DNA, 2580 bp, Artificial Sequence
  Description of Artificial Sequence: Synthetic coding sequence
atgaccagcaagcaggccatgagcagcaacgagcaggagagactgctgtgctacaacggcgaggtgctggtgttccagctgagcaagggcaacttcgccgacaaggagcccaccaagacccccatcctgcacgtgagaagaatggtgttcgacagaggcaccaaggtgttcgtgcagaagagcaccggcttcttcaccatcaaggaggagaacagccacctgaagatcatgtgctgcaactgcgtgagcgacttcagaaccggcatcaacctgccctacatcgtgatcgagaagaacaagaagaacaacgtgttcgagtacttcctgctgatcctgcacagcaccaacaagttcgagatgagactgagcttcaagctgggctacgagatgaaggacggcctgagagtgctgaacggccccctgatcctgtggagacacgtgaaggccttcttcttcatcagcagccagaccggcaaggtggtgagcgtgagcggcaacttcagcagcatccagtgggccggcgagatcgagaacctgggcatggtgctgctgggcctgaaggagtgctgcctgagcgaggaggagtgcacccaggagcccagcaagagcgactacgccatctggaacaccaagttctgcgtgtacagcctggagagccaggaggtgctgagcgacatctacatcatcccccccgcctacagcagcgtggtgacctacgtgcacatctgcgccaccgagatcatcaagaaccagctgagaatcagcctgatcgccctgaccagaaagaaccagctgatcagcttccagaacggcacccccaagaacgtgtgccagctgcccttcggcgacccctgcgccgtgcagctgatggacagcggcggcggcaacctgttcttcgtggtgagcttcatcagcaacaacgcctgcgccgtgtggaaggagagcttccaggtggccgccaagtgggagaagctgagcctggtgctgatcgacgacttcatcggcagcggcaccgagcaggtgctgctgctgttcaaggacagcctgaacagcgactgcctgaccagcttcaagatcaccgacctgggcaagatcaactacagcagcgagcccagcgactgcaacgaggacgacctgttcgaggacaagcaggagaacagatacctggtggtgccccccctggagaccggcctgaaggtgtgcttcagcagcttcagagagctgagacagcacctgctgctgaaggagaagatcatcagcaagagctacaaggccctgatcaacctggtgcagggcaaggacgacaacaccagcagcgccgaggagaaggagtgcctggtgcccctgtgcggcgaggaggagaacagcgtgcacatcctggacgagaagctgagcgacaacttccaggacagcgagcagctggtggagaagatctggtacagagtgatcgacgacagcctggtggtgggcgtgaagaccaccagcagcctgaagctgagcctgaacgacgtgaccctgagcctgctgatggaccaggcccacgacagcagattcagactgctgaagtgccagaacagagtgatcaagctgagcaccaaccccttccccgccccctacctgatgccctgcgagatcggcctggaggccaagagagtgaccctgacccccgacagcaagaaggaggagagcttcgtgtgcgagcaccccagcaagaaggagtgcgtgcagatcatcaccgccgtgaccagcctgagccccctgctgaccttcagcaagttctgctgcaccgtgctgctgcagatcatggagagagagagcggcaactgccccaaggacagatacgtggtgtgcggcagagtgttcctgagcctggaggacctgagcaccggcaagtacctgctgaccttccccaagaagaagcccatcgagcacatggaggacctgttcgccctgctggccgccttccacaagagctgcttccagatcaccagccccggctacgccctgaacagcatgaaggtgtggctgctggagcacatgaagtgcgagatcatcaaggagttccccgaggtgtacttctgcgagagacccggcagcttctacggcaccctgttcacctggaagcagagaacccccttcgagggcatcctgatcatctacagcagaaaccagaccgtgatgttccagtgcctgcacaacctgatcagaatcctgcccatcaactgcttcctgaagaacctgaagagcggcagcgagaacttcctgatcgacaacatggccttcaccctggagaaggagctggtgaccctgagcagcctgagcagcgccatcgccaagcacgagagcaacttcatgcagagatgcgaggtgagcaagggcaagagcagcgtggtggccgccgccctgagcgacagaagagagaacatccacccctacagaaaggagctgcagagagagaagaagaagatgctgcagaccaacctgaaggtgagcggcgccctgtacagagagatcaccctgaaggtggccgaggtgcagctgaagagcgacttcgccgcccagaagctgagcaacctgtag

SEQ ID NO: 81234 - DNA, 2580 bp, Artificial Sequence; identical to SEQ ID NO: 81233
  Description of Artificial Sequence: Synthetic coding sequence

SEQ ID NO: 81235 - DNA, 2457 bp, Artificial Sequence
  Description of Artificial Sequence: Synthetic coding sequence
atgaccagcaagcaggccatgagcagcaacgagcaggagagactgctgtgctacaacggcgaggtgctggtgttccagctgagcaagggcaacttcgccgacaaggagcccaccaagacccccatcctgcacgtgagaagaatggtgttcgacagaggcaccaaggtgttcgtgcagaagagcaccggcttcttcaccatcaaggaggagaacagccacctgaagatcatgtgctgcaactgcgtgagcgacttcagaaccggcatcaacctgccctacatcgtgatcgagaagaacaagaagaacaacgtgttcgagtacttcctgctgatcctgcacagcaccaacaagttcgagatgagactgagcttcaagctgggctacgagatgaaggacggcctgagagtgctgaacggccccctgatcctgtggagacacgtgaaggccttcttcttcatcagcagccagaccggcaaggtggtgagcgtgagcggcaacttcagcagcatccagtgggccggcgagatcgagaacctgggcatggtgctgctgggcctgaaggagtgctgcctgagcgaggaggagtgcacccaggagcccagcaagagcgactacgccatctggaacaccaagttctgcgtgtacagcctggagagccaggaggtgctgagcgacatctacatcatcccccccgcctacagcagcgtggtgacctacgtgcacatctgcgccaccgagatcatcaagaaccagctgagaatcagcctgatcgccctgaccagaaagaaccagctgatcagcttccagaacggcacccccaagaacgtgtgccagctgcccttcggcgacccctgcgccgtgcagctgatggacagcggcggcggcaacctgttcttcgtggtgagcttcatcagcaacaacgcctgcgccgtgtggaaggagagcttccaggtggccgccaagtgggagaagctgagcctggtgctgatcgacgacttcatcggcagcggcaccgagcaggtgctgctgctgttcaaggacagcctgaacagcgactgcctgaccagcttcaagatcaccgacctgggcaagatcaactacagcagcgagcccagcgactgcaacgaggacgacctgttcgaggacaagcaggagaacagatacctggtggtgccccccctggagaccggcctgaaggtgtgcttcagcagcttcagagagctgagacagcacctgctgctgaaggagaagatcatcagcaagagctacaaggccctgatcaacctggtgcagggcaaggacgacaacaccagcagcgccgaggagaaggagtgcctggtgcccctgtgcggcgaggaggagaacagcgtgcacatcctggacgagaagctgagcgacaacttccaggacagcgagcagctggtggagaagatctggtacagagtgatcgacgacagcctggtggtgggcgtgaagaccaccagcagcctgaagctgagcctgaacgacgtgaccctgagcctgctgatggaccaggcccacgacagcagattcagactgctgaagtgccagaacagagtgatcaagctgagcaccaaccccttccccgccccctacctgatgccctgcgagatcggcctggaggccaagagagtgaccctgacccccgacagcaagaaggaggagagcttcgtgtgcgagcaccccagcaagaaggagtgcgtgcagatcatcaccgccgtgaccagcctgagccccctgctgaccttcagcaagttctgctgcaccgtgctgctgcagatcatggagagagagagcggcaactgccccaaggacagatacgtggtgtgcggcagagtgttcctgagcctggaggacctgagcaccggcaagtacctgctgaccttccccaagaagaagcccatcgagcacatggaggacctgttcgccctgctggccgccttccacaagagctgcttccagatcaccagccccggctacgccctgaacagcatgaaggtgtggctgctggagcacatgaagtgcgagatcatcaaggagttccccgaggtgtacttctgcgagagacccggcagcttctacggcaccctgttcacctggaagcagagaacccccttcgagggcatcctgatcatctacagcagaaaccagaccgtgatgttccagtgcctgcacaacctgatcagaatcctgcccatcaactgcttcctgaagaacctgaagagcggcagcgagaacttcctgatcgacaacatggccttcaccctggagaaggagctggtgaccctgagcagcctgagcagcgccatcgccaagcacgagagcaacttcatgcagagatgcgaggtgagcaagggcaagagcagcgtggtggccgccgccctgagcgacagaagagagaacatccacccctacagaaaggagctgcagagatag

SEQ ID NO: 81236 - DNA, 1677 bp, Artificial Sequence
  Description of Artificial Sequence: Synthetic coding sequence
atggcccaggacagcgtggacctgagctgcgactaccagttctggatgcagaagctgagcgtgtgggaccaggccagcaccctggagacccagcaggacacctgcctgcacgtggcccagttccaggagttcctgagaaagatgtacgaggccctgaaggagatggacagcaacaccgtgatcgagagattccccaccatcggccagctgctggccaaggcctgctggaaccccttcatcctggcctacgacgagagccagaagatcctgatctggtgcctgtgctgcctgatcaacaaggagccccagaacagcggccagagcaagctgaacagctggatccagggcgtgctgagccacatcctgagcgccctgagattcgacaaggaggtggccctgttcacccagggcctgggctacgcccccatcgactactaccccggcctgctgaagaacatggtgctgagcctggccagcgagctgagagagaaccacctgaacggcttcaacacccagagaagaatggcccccgagagagtggccagcctgagcagagtgtgcgtgcccctgatcaccctgaccgacgtggaccccctggtggaggccctgctgatctgccacggcagagagccccaggagatcctgcagcccgagttcttcgaggccgtgaacgaggccatcctgctgaagaagatcagcctgcccatgagcgccgtggtgtgcctgtggctgagacacctgcccagcctggagaaggccatgctgcacctgttcgagaagctgatcagcagcgagagaaactgcctgagaagaatcgagtgcttcatcaaggacagcagcctgccccaggccgcctgccaccccgccatcttcagagtggtggacgagatgttcagatgcgccctgctggagaccgacggcgccctggagatcatcgccaccatccaggtgttcacccagtgcttcgtggaggccctggagaaggccagcaagcagctgagattcgccctgaagacctacttcccctacaccagccccagcctggccatggtgctgctgcaggacccccaggacatccccagaggccactggctgcagaccctgaagcacatcagcgagctgctgagagaggccgtggaggaccagacccacggcagctgcggcggccccttcgagagctggttcctgttcatccacttcggcggctgggccgagatggtggccgagcagctgctgatgagcgccgccgagccccccaccgccctgctgtggctgctggccttctactacggccccagagacggcagacagcagagagcccagaccatggtgcaggtgaaggccgtgctgggccacctgctggccatgagcagaagcagcagcctgagcgcccaggacctgcagaccgtggccggccagggcaccgacaccgacctgagagcccccgcccagcagctgatcagacacctgctgctgaacttcctgctgtgggcccccggcggccacaccatcgcctgggacgtgatcaccctgatggcccacaccgccgagatcacccacgagatcatcggcttcctggaccagaccctgtacagatggaacagactgggcatcgagagccccagaagcgagaagctggccagagagctgctgaaggagctgagaacccaggtgtag

SEQ ID NO: 81237 - DNA, 1677 bp, Artificial Sequence; identical to SEQ ID NO: 81236
  Description of Artificial Sequence: Synthetic coding sequence

SEQ ID NO: 81238 - DNA, 453 bp, Artificial Sequence
  Description of Artificial Sequence: Synthetic coding sequence
atggcccaggacagcgtggacctgagctgcgactaccagttctggatgcagaagctgagcgtgtgggaccaggccagcaccctggagacccagcaggacacctgcctgcacgtggcccagttccaggagttcctgagaaagatgtacgaggccctgaaggagatggacagcaacaccgtgatcgagagattccccaccatcggccagctgctggccaaggcctgctggaaccccttcatcctggcctacgacgagagccagaagatcctgatctggtgcctgtgctgcctgatcaacaaggagccccagaacagcggccagagcaagctgaacagctggatccagggcgtgctgagccacatcctgagcgccctgagattcgacaaggaggtggccctgttcacccagggcctgggctacgcccccatcgactactaccccggcctgctgtag

SEQ ID NO: 81239 - DNA, 4416 bp, Artificial Sequence
  Description of Artificial Sequence: Synthetic coding sequence
atggtgagcaagagaagactgagcaagagcgaggacaaggagagcctgaccgaggacgccagcaagaccagaaagcagcccctgagcaagaagaccaagaagagccacatcgccaacgaggtggaggagaacgacagcatcttcgtgaagctgctgaagatcagcggcatcatcctgaagaccggcgagagccagaaccagctggccgtggaccagatcgccttccagaagaagctgttccagaccctgagaagacaccccagctaccccaagatcatcgaggagttcgtgagcggcctggagagctacatcgaggacgaggacagcttcagaaactgcctgctgagctgcgagagactgcaggacgaggaggccagcatgggcgccagctacagcaagagcctgatcaagctgctgctgggcatcgacatcctgcagcccgccatcatcaagaccctgttcgagaagctgcccgagtacttcttcgagaacaagaacagcgacgagatcaacatccccagactgatcgtgagccagctgaagtggctggacagagtggtggacggcaaggacctgaccaccaagatcatgcagctgatcagcatcgcccccgagaacctgcagcacgacatcatcaccagcctgcccgagatcctgggcgacagccagcacgccgacgtgggcaaggagctgagcgacctgctgatcgagaacaccagcctgaccgtgcccatcctggacgtgctgagcagcctgagactggaccccaacttcctgctgaaggtgagacagctggtgatggacaagctgagcagcatcagactggaggacctgcccgtgatcatcaagttcatcctgcacagcgtgaccgccatggacaccctggaggtgatcagcgagctgagagagaagctggacctgcagcactgcgtgctgcccagcagactgcaggccagccaggtgaagctgaagagcaagggcagagccagcagcagcggcaaccaggagagcagcggccagagctgcatcatcctgctgttcgacgtgatcaagagcgccatcagatacgagaagaccatcagcgaggcctggatcaaggccatcgagaacaccgccagcgtgagcgagcacaaggtgttcgacctggtgatgctgttcatcatctacagcaccaacacccagaccaagaagtacatcgacagagtgctgagaaacaagatcagaagcggctgcatccaggagcagctgctgcagagcaccttcagcgtgcactacctggtgctgaaggacatgtgcagcagcatcctgagcctggcccagagcctgctgcacagcctggaccagagcatcatcagcttcggcagcctgctgtacaagtacgccttcaagttcttcgacacctactgccagcaggaggtggtgggcgccctggtgacccacatctgcagcggcaacgaggccgaggtggacaccgccctggacgtgctgctggagctggtggtgctgaaccccagcgccatgatgatgaacgccgtgttcgtgaagggcatcctggactacctggacaacatcagcccccagcagatcagaaagctgttctacgtgctgagcaccctggccttcagcaagcagaacgaggccagcagccacatccaggacgacatgcacctggtgatcagaaagcagctgagcagcaccgtgttcaagtacaagctgatcggcatcatcggcgccgtgaccatggccggcatcatggccgccgacagaagcgagagccccagcctgacccaggagagagccaacctgagcgacgagcagtgcacccaggtgaccagcctgctgcagctggtgcacagctgcagcgagcagagcccccaggccagcgccctgtactacgacgagttcgccaacctgatccagcacgagaagctggaccccaaggccctggagtgggtgggccacaccatctgcaacgacttccaggacgccttcgtggtggacagctgcgtggtgcccgagggcgacttccccttccccgtgaaggccctgtacggcctggaggagtacgacacccaggacggcatcgccatcaacctgctgcccctgctgttcagccaggacttcgccaaggacggcggccccgtgaccagccaggagagcggccagaagctggtgagccccctgtgcctggccccctacttcagactgctgagactgtgcgtggagagacagcacaacggcaacctggaggagatcgacggcctgctggactgccccatcttcctgaccgacctggagcccggcgagaagctggagagcatgagcgccaaggagagaagcttcatgtgcagcctgatcttcctgaccctgaactggttcagagagatcgtgaacgccttctgccaggagaccagccccgagatgaagggcaaggtgctgaccagactgaagcacatcgtggagctgcagatcatcctggagaagtacctggccgtgacccccgactacgtgccccccctgggcaacttcgacgtggagaccctggacatcaccccccacaccgtgaccgccatcagcgccaagatcagaaagaagggcaagatcgagagaaagcagaagaccgacggcagcaagaccagcagcagcgacaccctgagcgaggagaagaacagcgagtgcgaccccacccccagccacagaggccagctgaacaaggagttcaccggcaaggaggagaagaccagcctgctgctgcacaacagccacgccttcttcagagagctggacatcgaggtgttcagcatcctgcactgcggcctggtgaccaagttcatcctggacaccgagatgcacaccgaggccaccgaggtggtgcagctgggcccccccgagctgctgttcctgctggaggacctgagccagaagctggagagcatgctgaccccccccatcgccagaagagtgcccttcctgaagaacaagggcagcagaaacatcggcttcagccacctgcagcagagaagcgcccaggagatcgtgcactgcgtgttccagctgctgacccccatgtgcaaccacctggagaacatccacaactacttccagtgcctggccgccgagaaccacggcgtggtggacggccccggcgtgaaggtgcaggagtaccacatcatgagcagctgctaccagagactgctgcagatcttccacggcctgttcgcctggagcggcttcagccagcccgagaaccagaacctgctgtacagcgccctgcacgtgctgagcagcagactgaagcagggcgagcacagccagcccctggaggagctgctgagccagagcgtgcactacctgcagaacttccaccagagcatccccagcttccagtgcgccctgtacctgatcagactgctgatggtgatcctggagaagagcaccgccagcgcccagaacaaggagaagatcgccagcctggccagacagttcctgtgcagagtgtggcccagcggcgacaaggagaagagcaacatcagcaacgaccagctgcacgccctgctgtgcatctacctggagcacaccgagagcatcctgaaggccatcgaggagatcgccggcgtgggcgtgcccgagctgatcaacagccccaaggacgccagcagcagcaccttccccaccctgaccagacacaccttcgtggtgttcttcagagtgatgatggccgagctggagaagaccgtgaagaagatcgagcccggcaccgccgccgacagccagcagatccacgaggagaagctgctgtactggaacatggccgtgagagacttcagcatcctgatcaacctgatcaaggtgttcgacagccaccccgtgctgcacgtgtgcctgaagtacggcagactgttcgtggaggccttcctgaagcagtgcatgcccctgctggacttcagcttcagaaagcacagagaggacgtgctgagcctgctggagaccttccagctggacaccagactgctgcaccacctgtgcggccacagcaagatccaccaggacaccagactgacccagcacgtgcccctgctgaagaagaccctggagctgctggtgtgcagagtgaaggccatgctgaccctgaacaactgcagagaggccttctggctgggcaacctgaagaacagagacctgcagggcgaggagatcaagagccagaacagccaggagagcaccgccgacgagagcgaggacgacatgagcagccaggccagcaagagcaaggccaccgaggtgagcctgcagaacccccccgagagcggcaccgacggctgcatcctgctgatcgtgctgagctggtggagcagaaccctgcccacctacgtgtactgccagatgctgctgtgccccttccccttccccccctag

SEQ ID NO: 81240 - DNA, 3750 bp, Artificial Sequence
  Description of Artificial Sequence: Synthetic coding sequence
atggtgagcaagagaagactgagcaagagcgaggacaaggagagcctgaccgaggacgccagcaagaccagaaagcagcccctgagcaagaagaccaagaagagccacatcgccaacgaggtggaggagaacgacagcatcttcgtgaagctgctgaagatcagcggcatcatcctgaagaccggcgagagccagaaccagctggccgtggaccagatcgccttccagaagaagctgttccagaccctgagaagacaccccagctaccccaagatcatcgaggagttcgtgagcggcctggagagctacatcgaggacgaggacagcttcagaaactgcctgctgagctgcgagagactgcaggacgaggaggccagcatgggcgccagctacagcaagagcctgatcaagctgctgctgggcatcgacatcctgcagcccgccatcatcaagaccctgttcgagaagctgcccgagtacttcttcgagaacaagaacagcgacgagatcaacatccccagactgatcgtgagccagctgaagtggctggacagagtggtggacggcaaggacctgaccaccaagatcatgcagctgatcagcatcgcccccgagaacctgcagcacgacatcatcaccagcctgcccgagatcctgggcgacagccagcacgccgacgtgggcaaggagctgagcgacctgctgatcgagaacaccagcctgaccgtgcccatcctggacgtgctgagcagcctgagactggaccccaacttcctgctgaaggtgagacagctggtgatggacaagctgagcagcatcagactggaggacctgcccgtgatcatcaagttcatcctgcacagcgtgaccgccatggacaccctggaggtgatcagcgagctgagagagaagctggacctgcagcactgcgtgctgcccagcagactgcaggccagccaggtgaagctgaagagcaagggcagagccagcagcagcggcaaccaggagagcagcggccagagctgcatcatcctgctgttcgacgtgatcaagagcgccatcagatacgagaagaccatcagcgaggcctggatcaaggccatcgagaacaccgccagcgtgagcgagcacaaggtgttcgacctggtgatgctgttcatcatctacagcaccaacacccagaccaagaagtacatcgacagagtgctgagaaacaagatcagaagcggctgcatccaggagcagctgctgcagagcaccttcagcgtgcactacctggtgctgaaggacatgtgcagcagcatcctgagcctggcccagagcctgctgcacagcctggaccagagcatcatcagcttcggcagcctgctgtacaagtacgccttcaagttcttcgacacctactgccagcaggaggtggtgggcgccctggtgacccacatctgcagcggcaacgaggccgaggtggacaccgccctggacgtgctgctggagctggtggtgctgaaccccagcgccatgatgatgaacgccgtgttcgtgaagggcatcctggactacctggacaacatcagcccccagcagatcagaaagctgttctacgtgctgagcaccctggccttcagcaagcagaacgaggccagcagccacatccaggacgacatgcacctggtgatcagaaagcagctgagcagcaccgtgttcaagtacaagctgatcggcatcatcggcgccgtgaccatggccggcatcatggccgccgacagaagcgagagccccagcctgacccaggagagagccaacctgagcgacgagcagtgcacccaggtgaccagcctgctgcagctggtgcacagctgcagcgagcagagcccccaggccagcgccctgtactacgacgagttcgccaacctgatccagcacgagaagctggaccccaaggccctggagtgggtgggccacaccatctgcaacgacttccaggacgccttcgtggtggacagctgcgtggtgcccgagggcgacttccccttccccgtgaaggccctgtacggcctggaggagtacgacacccaggacggcatcgccatcaacctgctgcccctgctgttcagccaggacttcgccaaggacggcggccccgtgaccagccaggagagcggccagaagctggtgagccccctgtgcctggccccctacttcagactgctgagactgtgcgtggagagacagcacaacggcaacctggaggagatcgacggcctgctggactgccccatcttcctgaccgacctggagcccggcgagaagctggagagcatgagcgccaaggagagaagcttcatgtgcagcctgatcttcctgaccctgaactggttcagagagatcgtgaacgccttctgccaggagaccagccccgagatgaagggcaaggtgctgaccagactgaagcacatcgtggagctgcagatcatcctggagaagtacctggccgtgacccccgactacgtgccccccctgggcaacttcgacgtggagaccctggacatcaccccccacaccgtgaccgccatcagcgccaagatcagaaagaagggcaagatcgagagaaagcagaagaccgacggcagcaagaccagcagcagcgacaccctgagcgaggagaagaacagcgagtgcgaccccacccccagccacagaggccagctgaacaaggagttcaccggcaaggaggagaagaccagcctgctgctgcacaacagccacgccttcttcagagagctggacatcgaggtgttcagcatcctgcactgcggcctggtgaccaagttcatcctggacaccgagatgcacaccgaggccaccgaggtggtgcagctgggcccccccgagctgctgttcctgctggaggacctgagccagaagctggagagcatgctgaccccccccatcgccagaagagtgcccttcctgaagaacaagggcagcagaaacatcggcttcagccacctgcagcagagaagcgcccaggagatcgtgcactgcgtgttccagctgctgacccccatgtgcaaccacctggagaacatccacaactacttccagtgcctggccgccgagaaccacggcgtggtggacggccccggcgtgaaggtgcaggagtaccacatcatgagcagctgctaccagagactgctgcagatcttccacggcctgttcgcctggagcggcttcagccagcccgagaaccagaacctgctgtacagcgccctgcacgtgctgagcagcagactgaagcagggcgagcacagccagcccctggaggagctgctgagccagagcgtgcactacctgcagaacttccaccagagcatccccagcttccagtgcgccctgtacctgatcagactgctgatggtgatcctggagaagagcaccgccagcgcccagaacaaggagaagatcgccagcctggccagacagttcctgtgcagagtgtggcccagcggcgacaaggagaagagcaacatcagcaacgaccagctgcacgccctgctgtgcatctacctggagcacaccgagagcatcctgaaggccatcgaggagatcgccggcgtgggcgtgcccgagctgatcaacagccccaaggacgccagcagcagcaccttccccaccctgaccagattcatgaagagaaacagcagcaccggcacctggctgttcgagaccagcgtgagcagcagcacctag

SEQ ID NO: 81241 - DNA, 4356 bp, Artificial Sequence
  Description of Artificial Sequence: Synthetic coding sequence
atggtgagcaagagaagactgagcaagagcgaggacaaggagagcctgaccgaggacgccagcaagaccagaaagcagcccctgagcaagaagaccaagaagagccacatcgccaacgaggtggaggagaacgacagcatcttcgtgaagctgctgaagatcagcggcatcatcctgaagaccggcgagagccagaaccagctggccgtggaccagatcgccttccagaagaagctgttccagaccctgagaagacaccccagctaccccaagatcatcgaggagttcgtgagcggcctggagagctacatcgaggacgaggacagcttcagaaactgcctgctgagctgcgagagactgcaggacgaggaggccagcatgggcgccagctacagcaagagcctgatcaagctgctgctgggcatcgacatcctgcagcccgccatcatcaagaccctgttcgagaagctgcccgagtacttcttcgagaacaagaacagcgacgagatcaacatccccagactgatcgtgagccagctgaagtggctggacagagtggtggacggcaaggacctgaccaccaagatcatgcagctgatcagcatcgcccccgagaacctgcagcacgacatcatcaccagcctgcccgagatcctgggcgacagccagcacgccgacgtgggcaaggagctgagcgacctgctgatcgagaacaccagcctgaccgtgcccatcctggacgtgctgagcagcctgagactggaccccaacttcctgctgaaggtgagacagctggtgatggacaagctgagcagcatcagactggaggacctgcccgtgatcatcaagttcatcctgcacagcgtgaccgccatggacaccctggaggtgatcagcgagctgagagagaagctggacctgcagcactgcgtgctgcccagcagactgcaggccagccaggtgaagctgaagagcaagggcagagccagcagcagcggcaaccaggagagcagcggccagagctgcatcatcctgctgttcgacgtgatcaagagcgccatcagatacgagaagaccatcagcgaggcctggatcaaggccatcgagaacaccgccagcgtgagcgagcacaaggtgttcgacctggtgatgctgttcatcatctacagcaccaacacccagaccaagaagtacatcgacagagtgctgagaaacaagatcagaagcggctgcatccaggagcagctgctgcagagcaccttcagcgtgcactacctggtgctgaaggacatgtgcagcagcatcctgagcctggcccagagcctgctgcacagcctggaccagagcatcatcagcttcggcagcctgctgtacaagtacgccttcaagttcttcgacacctactgccagcaggaggtggtgggcgccctggtgacccacatctgcagcggcaacgaggccgaggtggacaccgccctggacgtgctgctggagctggtggtgctgaaccccagcgccatgatgatgaacgccgtgttcgtgaagggcatcctggactacctggacaacatcagcccccagcagatcagaaagctgttctacgtgctgagcaccctggccttcagcaagcagaacgaggccagcagccacatccaggacgacatgcacctggtgatcagaaagcagctgagcagcaccgtgttcaagtacaagctgatcggcatcatcggcgccgtgaccatggccggcatcatggccgccgacagaagcgagagccccagcctgacccaggagagagccaacctgagcgacgagcagtgcacccaggtgaccagcctgctgcagctggtgcacagctgcagcgagcagagcccccaggccagcgccctgtactacgacgagttcgccaacctgatccagcacgagaagctggaccccaaggccctggagtgggtgggccacaccatctgcaacgacttccaggacgccttcgtggtggacagctgcgtggtgcccgagggcgacttccccttccccgtgaaggccctgtacggcctggaggagtacgacacccaggacggcatcgccatcaacctgctgcccctgctgttcagccaggacttcgccaaggacggcggccccgtgaccagccaggagagcggccagaagctggtgagccccctgtgcctggccccctacttcagactgctgagactgtgcgtggagagacagcacaacggcaacctggaggagatcgacggcctgctggactgccccatcttcctgaccgacctggagcccggcgagaagctggagagcatgagcgccaaggagagaagcttcatgtgcagcctgatcttcctgaccctgaactggttcagagagatcgtgaacgccttctgccaggagaccagccccgagatgaagggcaaggtgctgaccagactgaagcacatcgtggagctgcagatcatcctggagaagtacctggccgtgacccccgactacgtgccccccctgggcaacttcgacgtggagaccctggacatcaccccccacaccgtgaccgccatcagcgccaagatcagaaagaagggcaagatcgagagaaagcagaagaccgacggcagcaagaccagcagcagcgacaccctgagcgaggagaagaacagcgagtgcgaccccacccccagccacagaggccagctgaacaaggagttcaccggcaaggaggagaagaccagcctgctgctgcacaacagccacgccttcttcagagagctggacatcgaggtgttcagcatcctgcactgcggcctggtgaccaagttcatcctggacaccgagatgcacaccgaggccaccgaggtggtgcagctgggcccccccgagctgctgttcctgctggaggacctgagccagaagctggagagcatgctgaccccccccatcgccagaagagtgcccttcctgaagaacaagggcagcagaaacatcggcttcagccacctgcagcagagaagcgcccaggagatcgtgcactgcgtgttccagctgctgacccccatgtgcaaccacctggagaacatccacaactacttccagtgcctggccgccgagaaccacggcgtggtggacggccccggcgtgaaggtgcaggagtaccacatcatgagcagctgctaccagagactgctgcagatcttccacggcctgttcgcctggagcggcttcagccagcccgagaaccagaacctgctgtacagcgccctgcacgtgctgagcagcagactgaagcagggcgagcacagccagcccctggaggagctgctgagccagagcgtgcactacctgcagaacttccaccagagcatccccagcttccagtgcgccctgtacctgatcagactgctgatggtgatcctggagaagagcaccgccagcgcccagaacaaggagaagatcgccagcctggccagacagttcctgtgcagagtgtggcccagcggcgacaaggagaagagcaacatcagcaacgaccagctgcacgccctgctgtgcatctacctggagcacaccgagagcatcctgaaggccatcgaggagatcgccggcgtgggcgtgcccgagctgatcaacagccccaaggacgccagcagcagcaccttccccaccctgaccagacacaccttcgtggtgttcttcagagtgatgatggccgagctggagaagaccgtgaagaagatcgagcccggcaccgccgccgacagccagcagatccacgaggagaagctgctgtactggaacatggccgtgagagacttcagcatcctgatcaacctgatcaaggtgttcgacagccaccccgtgctgcacgtgtgcctgaagtacggcagactgttcgtggaggccttcctgaagcagtgcatgcccctgctggacttcagcttcagaaagcacagagaggacgtgctgagcctgctggagaccttccagctggacaccagactgctgcaccacctgtgcggccacagcaagatccaccaggacaccagactgacccagcacgtgcccctgctgaagaagaccctggagctgctggtgtgcagagtgaaggccatgctgaccctgaacaactgcagagaggccttctggctgggcaacctgaagaacagagacctgcagggcgaggagatcaagagccagaacagccaggagagcaccgccgacgagagcgaggacgacatgagcagccaggccagcaagagcaaggccaccgaggacggcgaggaggacgaggtgagcgccggcgagaaggagcaggacagcgacgagagctacgacgacagcgactag

SEQ ID NO: 81242 - DNA, 4356 bp, Artificial Sequence; identical to SEQ ID NO: 81241
  Description of Artificial Sequence: Synthetic coding sequence

SEQ ID NO: 81243 - DNA, 1341 bp, Artificial Sequence
  Description of Artificial Sequence: Synthetic coding sequence
atggacagcagcgccgcccccaccaacgccagcaactgcaccgacgccctggcctacagcagctgcagccccgcccccagccccggcagctgggtgaacctgagccacctggacggcaacctgagcgacccctgcggccccaacagaaccgacctgggcggcagagacagcctgtgcccccccaccggcagccccagcatgatcaccgccatcaccatcatggccctgtacagcatcgtgtgcgtggtgggcctgttcggcaacttcctggtgatgtacgtgatcgtgagatacaccaagatgaagaccgccaccaacatctacatcttcaacctggccctggccgacgccctggccaccagcaccctgcccttccagagcgtgaactacctgatgggcacctggcccttcggcaccatcctgtgcaagatcgtgatcagcatcgactactacaacatgttcaccagcatcttcaccctgtgcaccatgagcgtggacagatacatcgccgtgtgccaccccgtgaaggccctggacttcagaacccccagaaacgccaagatcatcaacgtgtgcaactggatcctgagcagcgccatcggcctgcccgtgatgttcatggccaccaccaagtacagacagggcagcatcgactgcaccctgaccttcagccaccccacctggtactgggagaacctgctgaagatctgcgtgttcatcttcgccttcatcatgcccgtgctgatcatcaccgtgtgctacggcctgatgatcctgagactgaagagcgtgagaatgctgagcggcagcaaggagaaggacagaaacctgagaagaatcaccagaatggtgctggtggtggtggccgtgttcatcgtgtgctggacccccatccacatctacgtgatcatcaaggccctggtgaccatccccgagaccaccttccagaccgtgagctggcacttctgcatcgccctgggctacaccaacagctgcctgaaccccgtgctgtacgccttcctggacgagaacttcaagagatgcttcagagagttctgcatccccaccagcagcaacatcgagcagcagaacagcaccagaatcagacagaacaccagagaccaccccagcaccgccaacaccgtggacagaaccaaccaccagtgcctgcccatccccagcctgagctgctgggccctggagcagggctgcctggtggtgtaccccggccccctgcagggccccctggtgagatacgacctgcccgccatcctgcacagcagctgcctgagaggcaacaccgcccccagccccagcggcggcgccttcctgctgagctag

SEQ ID NO: 81244 - DNA, 1125 bp, Artificial Sequence
  Description of Artificial Sequence: Synthetic coding sequence
atggagagcctgctgcagcacctggacagattcagcgagctgctggccgtgagcagcaccacctacgtgagcacctgggaccccgccaccgtgagaagagccctgcagtgggccagatacctgagacacatccacagaagattcggcagacacggccccatcagaaccgccctggagagaagactgcacaaccagtggagacaggagggcggcttcggcagaggccccgtgcccggcctggccaacttccaggccctgggccactgcgacgtgctgctgagcctgagactgctggagaacagagccctgggcgacgccgccagataccacctggtgcagcagctgttccccggccccggcgtgagagacgccgacgaggagaccctgcaggagagcctggccagactggccagaagaagaagcgccgtgcacatgctgagattcaacggctacagagagaaccccaacctgcaggaggacagcctgatgaagacccaggccgagctgctgctggagagactgcaggaggtgggcaaggccgaggccgagagacccgccagattcctgagcagcctgtgggagagactgccccagaacaacttcctgaaggtgatcgccgtggccctgctgcagccccccctgagcagaagaccccaggaggagctggagcccggcatccacaagagccccggcgagggcagccaggtgctggtgcactggctgctgggcaacagcgaggtgttcgccgccttctgcagagccctgcccgccggcctgctgaccctggtgaccagcagacaccccgccctgagccccgtgtacctgggcctgctgaccgactggggccagagactgcactacgacctgcagaagggcatctgggtgggcaccgagagccaggacgtgccctgggaggagctgcacaacagattccagagcctgtgccaggcccccccccccctgaaggacaaggtgctgaccgccctggagacctgcaaggcccaggacggcgacttcgaggtgcccggcctgagcatctggaccgacctgctgctggccctgagaagcggcgccttcagaaagagacaggtgctgggcctgagcgccggcctgagcagcgtgtag

SEQ ID NO: 81245 - DNA, 3807 bp, Artificial Sequence
  Description of Artificial Sequence: Synthetic coding sequence
atggaccagaagatcctgagcctggccgccgagaagaccgccgacaagctgcaggagttcctgcagaccctgagagagggcgacctgaccaacctgctgcagaaccaggccgtgaagggcaaggtggccggcgccctgctgagagccatcttcaagggcagcccctgcagcgaggaggccggcaccctgagaagaagaaagatctacacctgctgcatccagctggtggagagcggcgacctgcagaaggagatcgccagcgagatcatcggcctgctgatgctggaggcccaccacttccccggccccctgctggtggagctggccaacgagttcatcagcgccgtgagagagggcagcctggtgaacggcaagagcctggagctgctgcccatcatcctgaccgccctggccaccaagaaggagaacctggcctacggcaagggcgtgctgagcggcgaggagtgcaagaagcagctgatcaacaccctgtgcagcggcagatgggaccagcagtacgtgatccagctgaccagcatgttcaaggacgtgcccctgaccgccgaggaggtggagttcgtggtggagaaggccctgagcatgttcagcaagatgaacctgcaggagatcccccccctggtgtaccagctgctggtgctgagcagcaagggcagcagaaagagcgtgctggagggcatcatcgccttcttcagcgccctggacaagcagcacaacgaggagcagagcggcgacgagctgctggacgtggtgaccgtgcccagcggcgagctgagacacgtggagggcaccatcatcctgcacatcgtgttcgccatcaagctggactacgagctgggcagagagctggtgaagcacctgaaggtgggccagcagggcgacagcaacaacaacctgagccccttcagcatcgccctgctgctgagcgtgaccagaatccagagattccaggaccaggtgctggacctgctgaagaccagcgtggtgaagagcttcaaggacctgcagctgctgcagggcagcaagttcctgcagaacctggtgccccacagaagctacgtgagcaccatgatcctggaggtggtgaagaacagcgtgcacagctgggaccacgtgacccagggcctggtggagctgggcttcatcctgatggacagctacggccccaagaaggtgctggacggcaagaccatcgagaccagccccagcctgagcagaatgcccaaccagcacgcctgcaagctgggcgccaacatcctgctggagaccttcaagatccacgagatgatcagacaggagatcctggagcaggtgctgaacagagtggtgaccagagccagcagccccatcagccacttcctggacctgctgagcaacatcgtgatgtacgcccccctggtgctgcagagctgcagcagcaaggtgaccgaggccttcgactacctgagcttcctgcccctgcagaccgtgcagagactgctgaaggccgtgcagcccctgctgaaggtgagcatgagcatgagagactgcctgatcctggtgctgagaaaggccatgttcgccaaccagctggacgccagaaagagcgccgtggccggcttcctgctgctgctgaagaacttcaaggtgctgggcagcctgagcagcagccagtgcagccagagcctgagcgtgagccaggtgcacgtggacgtgcacagccactacaacagcgtggccaacgagaccttctgcctggagatcatggacagcctgagaagatgcctgagccagcaggccgacgtgagactgatgctgtacgagggcttctacgacgtgctgagaagaaacagccagctggccaacagcgtgatgcagaccctgctgagccagctgaagcagttctacgagcccaagcccgacctgctgccccccctgaagctggaggcctgcatcctgacccagggcgacaagatcagcctgcaggagcccctggactacctgctgtgctgcatccagcactgcctggcctggtacaagaacaccgtgatccccctgcagcagggcgaggaggaggaggaggaggaggaggccttctacgaggacctggacgacatcctggagagcatcaccaacagaatgatcaagagcgagctggaggacttcgagctggacaagagcgccgacttcagccagagcaccagcatcggcatcaagaacaacatctgcgccttcctggtgatgggcgtgtgcgaggtgctgatcgagtacaacttcagcatcagcagcttcagcaagaacagattcgaggacatcctgagcctgttcatgtgctacaagaagctgagcgacatcctgaacgagaaggccggcaaggccaagaccaagatggccaacaagaccagcgacagcctgctgagcatgaagttcgtgagcagcctgctgaccgccctgttcagagtgctgctgtggagatacaccagcatccccaccagcgtggaggagagcggcaagaaggagaagggcaagagcatcagcctgctgtgcctggagggcctgcagaagatcttcagcgccgtgcagcagttctaccagcccaagatccagcagttcctgagagccctggacgtgaccgacaaggagggcgaggagagagaggacgccgacgtgagcgtgacccagagaaccgccttccagatcagacagttccagagaagcctgctgaacctgctgagcagccaggaggaggacttcaacagcaaggaggccctgctgctggtgaccgtgctgaccagcctgagcaagctgctggagcccagcagcccccagttcgtgcagatgctgagctggaccagcaagatctgcaaggagaacagcagagaggacgccctgttctgcaagagcctgatgaacctgctgttcagcctgcacgtgagctacaagagccccgtgatcctgctgagagacctgagccaggacatccacggccacctgggcgacatcgaccaggacgtggaggtggagaagaccaaccacttcgccatcgtgaacctgagaaccgccgcccccaccgtgtgcctgctggtgctgagccaggccgagaaggtgctggaggaggtggactggctgatcaccaagctgaagggccaggtgagccaggagaccctgagcgaggaggccagcagccaggccaccctgcccaaccagcccgtggagaaggccatcatcatgcagctgggcaccctgctgaccttcttccacgagctggtgcagaccgccctgcccagcggcagctgcgtggacaccctgctgaaggacctgtgcaagatgtacaccaccctgaccgccctggtgagatactacctgcaggtgtgccagagcagcggcggcatccccaagaacatggagaagctggtgaagctgagcggcagccacctgacccccctgtgctacagcttcatcagctacgtgcagaacaagagcaagagcctgaactacaccggcgagaagaaggagaagcccgccgccgtggccaccgccatggccagagtgctgagagagaccaagcccatccccaacctgatcttcgccatcgagcagtacgagaagttcctgatccacctgagcaagaagagcaaggtgaacctgatgcagcacatgaagctgagcaccagcagagacttcaagatcaagggcaacatcctggacatggtgctgagagaggacggcgaggacgagaacgaggagggcaccgccagcgagcacggcggccagaacaaggagcccgccaagaagaagagaaagaagtag

SEQ ID NO: 81246 - DNA, 3987 bp, Artificial Sequence
  Description of Artificial Sequence: Synthetic coding sequence
atggaccagaagatcctgagcctggccgccgagaagaccgccgacaagctgcaggagttcctgcagaccctgagagagggcgacctgaccaacctgctgcagaaccaggccgtgaagggcaaggtggccggcgccctgctgagagccatcttcaagggcagcccctgcagcgaggaggccggcaccctgagaagaagaaagatctacacctgctgcatccagctggtggagagcggcgacctgcagaaggagatcgccagcgagatcatcggcctgctgatgctggaggcccaccacttccccggccccctgctggtggagctggccaacgagttcatcagcgccgtgagagagggcagcctggtgaacggcaagagcctggagctgctgcccatcatcctgaccgccctggccaccaagaaggagaacctggcctacggcaagggcgtgctgagcggcgaggagtgcaagaagcagctgatcaacaccctgtgcagcggcagatgggaccagcagtacgtgatccagctgaccagcatgttcaaggacgtgcccctgaccgccgaggaggtggagttcgtggtggagaaggccctgagcatgttcagcaagatgaacctgcaggagatcccccccctggtgtaccagctgctggtgctgagcagcaagggcagcagaaagagcgtgctggagggcatcatcgccttcttcagcgccctggacaagcagcacaacgaggagcagagcggcgacgagctgctggacgtggtgaccgtgcccagcggcgagctgagacacgtggagggcaccatcatcctgcacatcgtgttcgccatcaagctggactacgagctgggcagagagctggtgaagcacctgaaggtgggccagcagggcgacagcaacaacaacctgagccccttcagcatcgccctgctgctgagcgtgaccagaatccagagattccaggaccaggtgctggacctgctgaagaccagcgtggtgaagagcttcaaggacctgcagctgctgcagggcagcaagttcctgcagaacctggtgccccacagaagctacgtgagcaccatgatcctggaggtggtgaagaacagcgtgcacagctgggaccacgtgacccagggcctggtggagctgggcttcatcctgatggacagctacggccccaagaaggtgctggacggcaagaccatcgagaccagccccagcctgagcagaatgcccaaccagcacgcctgcaagctgggcgccaacatcctgctggagaccttcaagatccacgagatgatcagacaggagatcctggagcaggtgctgaacagagtggtgaccagagccagcagccccatcagccacttcctggacctgctgagcaacatcgtgatgtacgcccccctggtgctgcagagctgcagcagcaaggtgaccgaggccttcgactacctgagcttcctgcccctgcagaccgtgcagagactgctgaaggccgtgcagcccctgctgaaggtgagcatgagcatgagagactgcctgatcctggtgctgagaaaggccatgttcgccaaccagctggacgccagaaagagcgccgtggccggcttcctgctgctgctgaagaacttcaaggtgctgggcagcctgagcagcagccagtgcagccagagcctgagcgtgagccaggtgcacgtggacgtgcacagccactacaacagcgtggccaacgagaccttctgcctggagatcatggacagcctgagaagatgcctgagccagcaggccgacgtgagactgatgctgtacgagggcttctacgacgtgctgagaagaaacagccagctggccaacagcgtgatgcagaccctgctgagccagctgaagcagttctacgagcccaagcccgacctgctgccccccctgaagctggaggcctgcatcctgacccagggcgacaagatcagcctgcaggagcccctggactacctgctgtgctgcatccagcactgcctggcctggtacaagaacaccgtgatccccctgcagcagggcgaggaggaggaggaggaggaggaggccttctacgaggacctggacgacatcctggagagcatcaccaacagaatgatcaagagcgagctggaggacttcgagctggacaagagcgccgacttcagccagagcaccagcatcggcatcaagaacaacatctgcgccttcctggtgatgggcgtgtgcgaggtgctgatcgagtacaacttcagcatcagcagcttcagcaagaacagattcgaggacatcctgagcctgttcatgtgctacaagaagctgagcgacatcctgaacgagaaggccggcaaggccaagaccaagatggccaacaagaccagcgacagcctgctgagcatgaagttcgtgagcagcctgctgaccgccctgttcagagacagcatccagagccaccaggagagcctgagcgtgctgagaagcagcaacgagttcatgagatacgccgtgaacgtggccctgcagaaggtgcagcagctgaaggagaccggccacgtgagcggccccgacggccagaaccccgagaagatcttccagaacctgtgcgacatcaccagagtgctgctgtggagatacaccagcatccccaccagcgtggaggagagcggcaagaaggagaagggcaagagcatcagcctgctgtgcctggagggcctgcagaagatcttcagcgccgtgcagcagttctaccagcccaagatccagcagttcctgagagccctggacgtgaccgacaaggagggcgaggagagagaggacgccgacgtgagcgtgacccagagaaccgccttccagatcagacagttccagagaagcctgctgaacctgctgagcagccaggaggaggacttcaacagcaaggaggccctgctgctggtgaccgtgctgaccagcctgagcaagctgctggagcccagcagcccccagttcgtgcagatgctgagctggaccagcaagatctgcaaggagaacagcagagaggacgccctgttctgcaagagcctgatgaacctgctgttcagcctgcacgtgagctacaagagccccgtgatcctgctgagagacctgagccaggacatccacggccacctgggcgacatcgaccaggacgtggaggtggagaagaccaaccacttcgccatcgtgaacctgagaaccgccgcccccaccgtgtgcctgctggtgctgagccaggccgagaaggtgctggaggaggtggactggctgatcaccaagctgaagggccaggtgagccaggagaccctgagcgaggaggccagcagccaggccaccctgcccaaccagcccgtggagaaggccatcatcatgcagctgggcaccctgctgaccttcttccacgagctggtgcagaccgccctgcccagcggcagctgcgtggacaccctgctgaaggacctgtgcaagatgtacaccaccctgaccgccctggtgagatactacctgcaggtgtgccagagcagcggcggcatccccaagaacatggagaagctggtgaagctgagcggcagccacctgacccccctgtgctacagcttcatcagctacgtgcagaacaagagcaagagcctgaactacaccggcgagaagaaggagaagcccgccgccgtggccaccgccatggccagagtgctgagagagaccaagcccatccccaacctgatcttcgccatcgagcagtacgagaagttcctgatccacctgagcaagaagagcaaggtgaacctgatgcagcacatgaagctgagcaccagcagagacttcaagatcaagggcaacatcctggacatggtgctgagagaggacggcgaggacgagaacgaggagggcaccgccagcgagcacggcggccagaacaaggagcccgccaagaagaagagaaagaagtag

SEQ ID NO: 81247 - DNA, 3288 bp, Artificial Sequence
  Description of Artificial Sequence: Synthetic coding sequence
atggaccagaagatcctgagcctggccgccgagaagaccgccgacaagctgcaggagttcctgcagaccctgagagagggcgacctgaccaacctgctgcagaaccaggccgtgaagggcaaggtggccggcgccctgctgagagccatcttcaagggcagcccctgcagcgaggaggccggcaccctgagaagaagaaagatctacacctgctgcatccagctggtggagagcggcgacctgcagaaggagatcgccagcgagatcatcggcctgctgatgctggaggcccaccacttccccggccccctgctggtggagctggccaacgagttcatcagcgccgtgagagagggcagcctggtgaacggcaagagcctggagctgctgcccatcatcctgaccgccctggccaccaagaaggagaacctggcctacggcaagggcgtgctgagcggcgaggagtgcaagaagcagctgatcaacaccctgtgcagcggcagatgggaccagcagtacgtgatccagctgaccagcatgttcaaggacgtgcccctgaccgccgaggaggtggagttcgtggtggagaaggccctgagcatgttcagcaagatgaacctgcaggagatcccccccctggtgtaccagctgctggtgctgagcagcaagggcagcagaaagagcgtgctggagggcatcatcgccttcttcagcgccctggacaagcagcacaacgaggagcagagcggcgacgagctgctggacgtggtgaccgtgcccagcggcgagctgagacacgtggagggcaccatcatcctgcacatcgtgttcgccatcaagctggactacgagctgggcagagagctggtgaagcacctgaaggtgggccagcagggcgacagcaacaacaacctgagccccttcagcatcgccctgctgctgagcgtgaccagaatccagagattccaggaccaggtgctggacctgctgaagaccagcgtggtgaagagcttcaaggacctgcagctgctgcagggcagcaagttcctgcagaacctggtgccccacagaagctacgtgagcaccatgatcctggaggtggtgaagaacagcgtgcacagctgggaccacgtgacccagggcctggtggagctgggcttcatcctgatggacagctacggccccaagaaggtgctggacggcaagaccatcgagaccagccccagcctgagcagaatgcccaaccagcacgcctgcaagctgggcgccaacatcctgctggagaccttcaagatccacgagatgatcagacaggagatcctggagcaggtgctgaacagagtggtgaccagagccagcagccccatcagccacttcctggacctgctgagcaacatcgtgatgtacgcccccctggtgctgcagagctgcagcagcaaggtgaccgaggccttcgactacctgagcttcctgcccctgcagaccgtgcagagactgctgaaggccgtgcagcccctgctgaaggtgagcatgagcatgagagactgcctgatcctggtgctgagaaaggccatgttcgccaaccagctggacgccagaaagagcgccgtggccggcttcctgctgctgctgaagaacttcaaggtgctgggcagcctgagcagcagccagtgcagccagagcctgagcgtgagccaggtgcacgtggacgtgcacagccactacaacagcgtggccaacgagaccttctgcctggagatcatggacagcctgagaagatgcctgagccagcaggccgacgtgagactgatgctgtacgagggcttctacgacgtgctgagaagaaacagccagctggccaacagcgtgatgcagaccctgctgagccagctgaagcagttctacgagcccaagcccgacctgctgccccccctgaagctggaggcctgcatcctgacccagggcgacaagatcagcctgcaggagcccctggactacctgctgtgctgcatccagcactgcctggcctggtacaagaacaccgtgatccccctgcagcagggcgaggaggaggaggaggaggaggaggccttctacgaggacctggacgacatcctggagagcatcaccaacagaatgatcaagagcgagctggaggacttcgagctggacaagagcgccgacttcagccagagcaccagcatcggcatcaagaacaacatctgcgccttcctggtgatgggcgtgtgcgaggtgctgatcgagtacaacttcagcatcagcagcttcagcaagaacagattcgaggacatcctgagcctgttcatgtgctacaagaagctgagcgacatcctgaacgagaaggccggcaaggccaagaccaagatggccaacaagaccagcgacagcctgctgagcatgaagttcgtgagcagcctgctgaccgccctgttcagagtgctgctgtggagatacaccagcatccccaccagcgtggaggagagcggcaagaaggagaagggcaagagcatcagcctgctgtgcctggagggcctgcagaagatcttcagcgccgtgcagcagttctaccagcccaagatccagcagttcctgagagccctggacgtgaccgacaaggagggcgaggagagagaggacgccgacgtgagcgtgacccagagaaccgccttccagatcagacagttccagagaagcctgctgaacctgctgagcagccaggaggaggacttcaacagcaaggaggccctgctgctggtgaccgtgctgaccagcctgagcaagctgctggagcccagcagcccccagttcgtgcagatgctgagctggaccagcaagatctgcaaggagaacagcagagaggacgccctgttctgcaagagcctgatgaacctgctgttcagcctgcacgtgagctacaagagccccgtgatcctgctgagagacctgagccaggacatccacggccacctgggcgacatcgaccaggacgtggaggtggagaagaccaaccacttcgccatcgtgaacctgagaaccgccgcccccaccgtgtgcctgctggtgctgagccaggccgagaaggtgctggaggaggtggactggctgatcaccaagctgaagggccaggtgagccaggagaccctgagcgtgagccccggcgtgagcgagctgagaagaaacagcaagaagtacggcaaggccggcgaggccgtgtggttcagcagcgacccccccgtgctgttcttccacttcctgagaaccgagtag

SEQ ID NO: 81248 - DNA, 222 bp, Artificial Sequence
  Description of Artificial Sequence: Synthetic coding sequence
atgttcaaggacgtgcccctgaccgccgaggaggtggagttcgtggtggagaaggccctgagcatgttcagcaagatgaacctgcaggagatcccccccctggtgtaccagctgctggtgctgagcagcaagggcagcagaaagagcgtgctggagggcatcatcgccttcttcagcgccctggacaagcagcacaacgaggagcagagcggcgacgagtag

SEQ ID NO: 81249 - DNA, 501 bp, Artificial Sequence
  Description of Artificial Sequence: Synthetic coding sequence
atggcccagaccagcagctacttcatgctgatcagctgcctgatgttcctgagccagagccagggccaggaggcccagaccgagctgccccaggccagaatcagctgccccgagggcaccaacgcctacagaagctactgctactacttcaacgaggacagagagacctgggtggacgccgacctgtactgccagaacatgaacagcggcaacctggtgagcgtgctgacccaggccgagggcgccttcgtggccagcctgatcaaggagagcggcaccgacgacttcaacgtgtggatcggcctgcacgaccccaagaagaacagaagatggcactggagcagcggcagcctggtgagctacaagagctggggcatcggcgcccccagcagcgtgaaccccggctactgcgtgagcctgaccagcagcaccggcttccagaagtggaaggacgtgccctgcgaggacaagttcagcttcgtgtgcaagttcaagaactag

SEQ ID NO: 81250 - DNA, 384 bp, Artificial Sequence
  Description of Artificial Sequence: Synthetic coding sequence
atggccgtgaccgaggccagcctgctgagacagtgccccctgctgctgccccagaacagaagcaagaccgtgtacgagggcttcatcagcgcccagggcagagacttccacctgagaatcgtgctgcccgaggacctgcagctgaagaacgccagactgctgtgcagctggcagctgagaaccatcctgagcggctaccacagaatcgtgcagcagagaatgcagcacagccccgacctgatgagcttcatgatggagctgaagatgctgctggaggtggccctgaagaacagacaggagctgtacgccctgcccccccccccccagttctacagcagcctgatcgaggagatcggcaccctgggctgggacaaggccccctag

SEQ ID NO: 81251 - DNA, 6147 bp, Artificial Sequence
  Description of Artificial Sequence: Synthetic coding sequence
atgagcggcagacagagaaccctgttccagacctggggcagcagcatcagcagaagcagcggcacccccggctgcagcagcggcaccgagagaccccagagccccggcagcagcaaggcccccctgcccgccgccgccgaggcccagctggagagcgacgacgacgtgctgctggtggccgcctacgaggccgagagacagctgtgcctggagaacggcggcttctgcaccagcgccggcgccctgtggatctaccccaccaactgccccgtgagagactaccagctgcacatcagcagagccgccctgttctgcaacaccctggtgtgcctgcccaccggcctgggcaagaccttcatcgccgccgtggtgatgtacaacttctacagatggttccccagcggcaaggtggtgttcatggcccccaccaagcccctggtgacccagcagatcgaggcctgctaccaggtgatgggcatcccccagagccacatggccgagatgaccggcagcacccaggccagcaccagaaaggagatctggtgcagcaagagagtgctgttcctgaccccccaggtgatggtgaacgacctgagcagaggcgcctgccccgccgccgagatcaagtgcctggtgatcgacgaggcccacaaggccctgggcaactacgcctactgccaggtggtgagagagctggtgaagtacaccaaccacttcagaatcctggccctgagcgccacccccggcagcgacatcaaggccgtgcagcaggtgatcaccaacctgctgatcggccagatcgagctgagaagcgaggacagccccgacatcctgacctacagccacgagagaaaggtggagaagctgatcgtgcccctgggcgaggagctggccgccatccagaagacctacatccagatcctggagagcttcgccagaagcctgatccagagaaacgtgctgatgagaagagacatccccaacctgaccaagtaccagatcatcctggccagagaccagttcagaaagaaccccagccccaacatcgtgggcatccagcagggcatcatcgagggcgagttcgccatctgcatcagcctgtaccacggctacgagctgctgcagcagatgggcatgagaagcctgtacttcttcctgtgcggcatcatggacggcaccaagggcatgaccagaagcaagaacgagctgggcagaaacgaggacttcatgaagctgtacaaccacctggagtgcatgttcgccagaaccagaagcaccagcgccaacggcatcagcgccatccagcagggcgacaagaacaagaagttcgtgtacagccaccccaagctgaagaagctggaggaggtggtgatcgagcacttcaagagctggaacgccgagaacaccaccgagaagaagagagacgagaccagagtgatgatcttcagcagcttcagagacagcgtgcaggagatcgccgagatgctgagccagcaccagcccatcatcagagtgatgaccttcgtgggccacgccagcggcaagagcaccaagggcttcacccagaaggagcagctggaggtggtgaagcagttcagagacggcggctacaacaccctggtgagcacctgcgtgggcgaggagggcctggacatcggcgaggtggacctgatcatctgcttcgacagccagaagagccccatcagactggtgcagagaatgggcagaaccggcagaaagagacagggcagaatcgtgatcatcctgagcgagggcagagaggagagaatctacaaccagagccagagcaacaagagaagcatctacaaggccatcagcagcaacagacaggtgctgcacttctaccagagaagccccagaatggtgcccgacggcatcaaccccaagctgcacaagatgttcatcacccacggcgtgtacgagcccgagaagcccagcagaaacctgcagagaaagagcagcatcttcagctacagagacggcatgagacagagcagcctgaagaaggactggttcctgagcgaggaggagttcaagctgtggaacagactgtacagactgagagacagcgacgagatcaaggagatcaccctgccccaggtgcagttcagcagcctgcagaacgaggagaacaagcccgcccaggagagcaccaccggcatccaccagctgagcctgagcgagtggagactgtggcaggaccaccccctgcccacccaccaggtggaccacagcgacagatgcagacacttcatcggcctgatgcagatgatcgagggcatgagacacgaggagggcgagtgcagctacgagctggaggtggagagctacctgcagatggaggacgtgaccagcaccttcatcgcccccagaaacgagagcaacaacctggccagcgacaccttcatcacccacaagaagagcagcttcatcaagaacatcaaccagggcagcagcagcagcgtgatcgagagcgacgaggagtgcgccgagatcgtgaagcagacccacatcaagcccaccaagatcgtgagcctgaagaagaaggtgagcaaggagatcaagaaggaccagctgaagaaggagaacaaccacggcatcatcgacagcgtggacaacgacagaaacagcaccgtggagaacatcttccaggaggacctgcccaacgacaagagaaccagcgacaccgacgagatcgccgccacctgcaccatcaacgagaacgtgatcaaggagccctgcgtgctgctgaccgagtgccagttcaccaacaagagcaccagcagcctggccggcaacgtgctggacagcggctacaacagcttcaacgacgagaagagcgtgagcagcaacctgttcctgcccttcgaggaggagctgtacatcgtgagaaccgacgaccagttctacaactgccacagcctgaccaaggaggtgctggccaacgtggagagattcctgagctacagccccccccccctgagcggcctgagcgacctggagtacgagatcgccaagggcaccgccctggagaacctgctgttcctgccctgcgccgagcacctgagaagcgacaagtgcacctgcctgctgagccacagcgccgtgaacagccagcagaacctggagctgaacagcctgaagtgcatcaactaccccagcgagaagagctgcctgtacgacatccccaacgacaacatcagcgacgagcccagcctgtgcgactgcgacgtgcacaagcacaaccagaacgagaacctggtgcccaacaacagagtgcagatccacagaagccccgcccagaacctggtgggcgagaacaaccacgacgtggacaacagcgacctgcccgtgctgagcaccgaccaggacgagagcctgctgctgttcgaggacgtgaacaccgagttcgacgacgtgagcctgagccccctgaacagcaagagcgagagcctgcccgtgagcgacaagaccgccatcagcgagacccccctggtgagccagttcctgatcagcgacgagctgctgctggacaacaacagcgagctgcaggaccagatcaccagagacgccaacagcttcaagagcagagaccagagaggcgtgcaggaggagaaggtgaagaaccacgaggacatcttcgactgcagcagagacctgttcagcgtgaccttcgacctgggcttctgcagccccgacagcgacgacgagatcctggagcacaccagcgacagcaacagacccctggacgacctgtacggcagatacctggagatcaaggagatcagcgacgccaactacgtgagcaaccaggccctgatccccagagaccacagcaagaacttcaccagcggcaccgtgatcatccccagcaacgaggacatgcagaaccccaactacgtgcacctgcccctgagcgccgccaagaacgaggagctgctgagccccggctacagccagttcagcctgcccgtgcagaagaaggtgatgagcacccccctgagcaagagcaacaccctgaacagcttcagcaagatcagaaaggagatcctgaagacccccgacagcagcaaggagaaggtgaacctgcagagattcaaggaggccctgaacagcaccttcgactacagcgagttcagcctggagaagagcaagagcagcggccccatgtacctgcacaagagctgccacagcgtggaggacggccagctgctgaccagcaacgagagcgaggacgacgagatcttcagaagaaaggtgaagagagccaagggcaacgtgctgaacagccccgaggaccagaagaacagcgaggtggacagccccctgcacgccgtgaagaagagaagattccccatcaacagaagcgagctgagcagcagcgacgagagcgagaacttccccaagccctgcagccagctggaggacttcaaggtgtgcaacggcaacgccagaagaggcatcaaggtgcccaagagacagagccacctgaagcacgtggccagaaagttcctggacgacgaggccgagctgagcgaggaggacgccgagtacgtgagcagcgacgagaacgacgagagcgagaacgagcaggacagcagcctgctggacttcctgaacgacgagacccagctgagccaggccatcaacgacagcgagatgagagccatctacatgaagagcctgagaagccccatgatgaacaacaagtacaagatgatccacaagacccacaagaacatcaacatcttcagccagatccccgagcaggacgagacctacctggaggacagcttctgcgtggacgaggaggagagctgcaagggccagagcagcgaggaggaggtgtgcgtggacttcaacctgatcaccgacgactgcttcgccaacagcaagaagtacaagaccagaagagccgtgatgctgaaggagatgatggagcagaactgcgcccacagcaagaagaagctgagcagaatcatcctgcccgacgacagcagcgaggaggagaacaacgtgaacgacaagagagagagcaacatcgccgtgaaccccagcaccgtgaagaagaacaagcagcaggaccactgcctgaacagcgtgcccagcggcagcagcgcccagagcaaggtgagaagcacccccagagtgaaccccctggccaagcagagcaagcagaccagcctgaacctgaaggacaccatcagcgaggtgagcgacttcaagccccagaaccacaacgaggtgcagagcaccaccccccccttcaccaccgtggacagccagaaggactgcagaaagttccccgtgccccagaaggacggcagcgccctggaggacagcagcaccagcggcgccagctgcagcaagagcagaccccacctggccggcacccacaccagcctgagactgccccaggagggcaagggcacctgcatcctggtgggcggccacgagatcaccagcggcctggaggtgatcagcagcctgagagccatccacggcctgcaggtggaggtgtgccccctgaacggctgcgactacatcgtgagcaacagaatggtggtggagagaagaagccagagcgagatgctgaacagcgtgaacaagaacaagttcatcgagcagatccagcacctgcagagcatgttcgagagaatctgcgtgatcgtggagaaggacagagagaagaccggcgacaccagcagaatgttcagaagaaccaagagctacgacagcctgctgaccaccctgatcggcgccggcatcagaatcctgttcagcagctgccaggaggagaccgccgacctgctgaaggagctgagcctggtggagcagagaaagaacgtgggcatccacgtgcccaccgtggtgaacagcaacaagagcgaggccctgcagttctacctgagcatccccaacatcagctacatcaccgccctgaacatgtgccaccagttcagcagcgtgaagagaatggccaacagcagcctgcaggagatcagcatgtacgcccaggtgacccaccagaaggccgaggagatctacagatacatccactacgtgttcgacatccagatgctgcccaacgacctgaaccaggacagactgaagagcgacatctag

SEQ ID NO: 81252 - DNA, 2010 bp, Artificial Sequence
  Description of Artificial Sequence: Synthetic coding sequence
atgagcggcagacagagaaccctgttccagacctggggcagcagcatcagcagaagcagcggcacccccggctgcagcagcggcaccgagagaccccagagccccggcagcagcaaggcccccctgcccgccgccgccgaggcccagctggagagcgacgacgacgtgctgctggtggccgcctacgaggccgagagacagctgtgcctggagaacggcggcttctgcaccagcgccggcgccctgtggatctaccccaccaactgccccgtgagagactaccagctgcacatcagcagagccgccctgttctgcaacaccctggtgtgcctgcccaccggcctgggcaagaccttcatcgccgccgtggtgatgtacaacttctacagatggttccccagcggcaaggtggtgttcatggcccccaccaagcccctggtgacccagcagatcgaggcctgctaccaggtgatgggcatcccccagagccacatggccgagatgaccggcagcacccaggccagcaccagaaaggagatctggtgcagcaagagagtgctgttcctgaccccccaggtgatggtgaacgacctgagcagaggcgcctgccccgccgccgagatcaagtgcctggtgatcgacgaggcccacaaggccctgggcaactacgcctactgccaggtggtgagagagctggtgaagtacaccaaccacttcagaatcctggccctgagcgccacccccggcagcgacatcaaggccgtgcagcaggtgatcaccaacctgctgatcggccagatcgagctgagaagcgaggacagccccgacatcctgacctacagccacgagagaaaggtggagaagctgatcgtgcccctgggcgaggagctggccgccatccagaagacctacatccagatcctggagagcttcgccagaagcctgatccagagaaacgtgctgatgagaagagacatccccaacctgaccaagtaccagatcatcctggccagagaccagttcagaaagaaccccagccccaacatcgtgggcatccagcagggcatcatcgagggcgagttcgccatctgcatcagcctgtaccacggctacgagctgctgcagcagatgggcatgagaagcctgtacttcttcctgtgcggcatcatggacggcaccaagggcatgaccagaagcaagaacgagctgggcagaaacgaggacttcatgaagctgtacaaccacctggagtgcatgttcgccagaaccagaagcaccagcgccaacggcatcagcgccatccagcagggcgacaagaacaagaagttcgtgtacagccaccccaagctgaagaagctggaggaggtggtgatcgagcacttcaagagctggaacgccgagaacaccaccgagaagaagagagacgagaccagagtgatgatcttcagcagcttcagagacagcgtgcaggagatcgccgagatgctgagccagcaccagcccatcatcagagtgatgaccttcgtgggccacgccagcggcaagagcaccaagggcttcacccagaaggagcagctggaggtggtgaagcagttcagagacggcggctacaacaccctggtgagcacctgcgtgggcgaggagggcctggacatcggcgaggtggacctgatcatctgcttcgacagccagaagagccccatcagactggtgcagagaatgggcagaaccggcagaaagagacagggcagaatcgtgatcatcctgagcgagggcagagaggagagaatctacaaccagagccagagcaacaagagaagcatctacaaggccatcagcagcaacagacaggtgctgcacttctaccagagaagccccagaatggtgcccgacggcatcaaccccaagctgcacaagatgttcatcacccacggcgtgtacgagcccgagaagcccagcagaaacctgcagagaaagagcagcatcttcagctacagagacggcaagtag

SEQ ID NO: 81253 - DNA, 1968 bp, Artificial Sequence
  Description of Artificial Sequence: Synthetic coding sequence
atggccgactacagcaccgtgcccccccccagcagcggcagcgccggcggcggcggcggcggcggcggcggcggcggcgtgaacgacgccttcaaggacgccctgcagagagccagacagatcgccgccaagatcggcggcgacgccggcaccagcctgaacagcaacgactacggctacggcggccagaagagacccctggaggacggcgaccagcccgacgccaagaaggtggccccccagaacgacagcttcggcacccagctgccccccatgcaccagcagcagagcagaagcgtgatgaccgaggagtacaaggtgcccgacggcatggtgggcttcatcatcggcagaggcggcgagcagatcagcagaatccagcaggagagcggctgcaagatccagatcgcccccgacagcggcggcctgcccgagagaagctgcatgctgaccggcacccccgagagcgtgcagagcgccaagagactgctggaccagatcgtggagaagggcagacccgcccccggcttccaccacggcgacggccccggcaacgccgtgcaggagatcatgatccccgccagcaaggccggcctggtgatcggcaagggcggcgagaccatcaagcagctgcaggagagagccggcgtgaagatggtgatgatccaggacggcccccagaacaccggcgccgacaagcccctgagaatcaccggcgacccctacaaggtgcagcaggccaaggagatggtgctggagctgatcagagaccagggcggcttcagagaggtgagaaacgagtacggcagcagaatcggcggcaacgagggcatcgacgtgcccatccccagattcgccgtgggcatcgtgatcggcagaaacggcgagatgatcaagaagatccagaacgacgccggcgtgagaatccagttcaagcccgacgacggcaccacccccgagagaatcgcccagatcaccggcccccccgacagatgccagcacgccgccgagatcatcaccgacctgctgagaagcgtgcaggccggcaaccccggcggccccggccccggcggcagaggcagaggcagaggccagggcaactggaacatgggcccccccggcggcctgcaggagttcaacttcatcgtgcccaccggcaagaccggcctgatcatcggcaagggcggcgagaccatcaagagcatcagccagcagagcggcgccagaatcgagctgcagagaaaccccccccccaacgccgaccccaacatgaagctgttcaccatcagaggcaccccccagcagatcgactacgccagacagctgatcgaggagaagatcggcggccccgtgaaccccctgggcccccccgtgccccacggcccccacggcgtgcccggcccccacggcccccccggcccccccggccccggcacccccatgggcccctacaaccccgccccctacaaccccggcccccccggccccgccccccacggcccccccgccccctacgccccccagggctggggcaacgcctacccccactggcagcagcaggccccccccgaccccgccaaggccggcaccgaccccaacagcgccgcctgggccgcctactacgcccactactaccagcagcaggcccagcccccccccgccgcccccgccggcgcccccaccaccacccagaccaacggccagggcgaccagcagaaccccgcccccgccggccaggtggactacaccaaggcctgggaggagtactacaagaagatgggccaggccgtgcccgcccccaccggcgccccccccggcggccagcccgactacagcgccgcctgggccgagtactacagacagcaggccgcctactacgcccagaccagcccccagggcatgccccagcacccccccgccccccagggcttcgccaaccacgccagaagccaccaccacctgtactag

SEQ ID NO: 81254 - DNA, 1935 bp, Artificial Sequence
  Description of Artificial Sequence: Synthetic coding sequence
atggccgactacagcaccgtgcccccccccagcagcggcagcgccggcggcggcggcggcggcggcggcggcggcggcgtgaacgacgccttcaaggacgccctgcagagagccagacagatcgccgccaagatcggcggcgacgccggcaccagcctgaacagcaacgactacggctacggcggccagaagagacccctggaggacggcgaccagcccgacgccaagaaggtggccccccagaacgacagcttcggcacccagctgccccccatgcaccagcagcagagcagaagcgtgatgaccgaggagtacaaggtgcccgacggcatggtgggcttcatcatcggcagaggcggcgagcagatcagcagaatccagcaggagagcggctgcaagatccagatcgcccccgacagcggcggcctgcccgagagaagctgcatgctgaccggcacccccgagagcgtgcagagcgccaagagactgctggaccagatcgtggagaagggcagacccgcccccggcttccaccacggcgacggccccggcaacgccgtgcaggagatcatgatccccgccagcaaggccggcctggtgatcggcaagggcggcgagaccatcaagcagctgcaggagagagccggcgtgaagatggtgatgatccaggacggcccccagaacaccggcgccgacaagcccctgagaatcaccggcgacccctacaaggtgcagcaggccaaggagatggtgctggagctgatcagagaccagggcggcttcagagaggtgagaaacgagtacggcagcagaatcggcggcaacgagggcatcgacgtgcccatccccagattcgccgtgggcatcgtgatcggcagaaacggcgagatgatcaagaagatccagaacgacgccggcgtgagaatccagttcaagcccgacgacggcaccacccccgagagaatcgcccagatcaccggcccccccgacagatgccagcacgccgccgagatcatcaccgacctgctgagaagcgtgcaggccggcaaccccggcggccccggccccggcggcagaggcagaggcagaggccagggcaactggaacatgggcccccccggcggcctgcaggagttcaacttcatcgtgcccaccggcaagaccggcctgatcatcggcaagggcggcgagaccatcaagagcatcagccagcagagcggcgccagaatcgagctgcagagaaaccccccccccaacgccgaccccaacatgaagctgttcaccatcagaggcaccccccagcagatcgactacgccagacagctgatcgaggagaagatcggcggccccgtgaaccccctgggcccccccgtgccccacggcccccacggcgtgcccggcccccacggcccccccggcccccccggccccggcacccccatgggcccctacaaccccgccccctacaaccccggcccccccggccccgccccccacggcccccccgccccctacgccccccagggctggggcaacgcctacccccactggcagcagcaggccccccccgaccccgccaaggccggcaccgaccccaacagcgccgcctgggccgcctactacgcccactactaccagcagcaggcccagcccccccccgccgcccccgccggcgcccccaccaccacccagaccaacggccagggcgaccagcagaaccccgcccccgccggccaggtggactacaccaaggcctgggaggagtactacaagaagatgggccaggccgtgcccgcccccaccggcgccccccccggcggccagcccgactacagcgccgcctgggccgagtactacagacagcaggccgcctactacgcccagaccagcccccagggcatgccccagcacccccccgccccccagggccagtag

SEQ ID NO: 81255 - DNA, 1965 bp, Artificial Sequence
  Description of Artificial Sequence: Synthetic coding sequence
atggccgactacagcaccgtgcccccccccagcagcggcagcgccggcggcggcggcggcggcggcggcggcggcggcgtgaacgacgccttcaaggacgccctgcagagagccagacagatcgccgccaagatcggcggcgacgccggcaccagcctgaacagcaacgactacggctacggcggccagaagagacccctggaggacggcgaccagcccgacgccaagaaggtggccccccagaacgacagcttcggcacccagctgccccccatgcaccagcagcagagaagcgtgatgaccgaggagtacaaggtgcccgacggcatggtgggcttcatcatcggcagaggcggcgagcagatcagcagaatccagcaggagagcggctgcaagatccagatcgcccccgacagcggcggcctgcccgagagaagctgcatgctgaccggcacccccgagagcgtgcagagcgccaagagactgctggaccagatcgtggagaagggcagacccgcccccggcttccaccacggcgacggccccggcaacgccgtgcaggagatcatgatccccgccagcaaggccggcctggtgatcggcaagggcggcgagaccatcaagcagctgcaggagagagccggcgtgaagatggtgatgatccaggacggcccccagaacaccggcgccgacaagcccctgagaatcaccggcgacccctacaaggtgcagcaggccaaggagatggtgctggagctgatcagagaccagggcggcttcagagaggtgagaaacgagtacggcagcagaatcggcggcaacgagggcatcgacgtgcccatccccagattcgccgtgggcatcgtgatcggcagaaacggcgagatgatcaagaagatccagaacgacgccggcgtgagaatccagttcaagcccgacgacggcaccacccccgagagaatcgcccagatcaccggcccccccgacagatgccagcacgccgccgagatcatcaccgacctgctgagaagcgtgcaggccggcaaccccggcggccccggccccggcggcagaggcagaggcagaggccagggcaactggaacatgggcccccccggcggcctgcaggagttcaacttcatcgtgcccaccggcaagaccggcctgatcatcggcaagggcggcgagaccatcaagagcatcagccagcagagcggcgccagaatcgagctgcagagaaaccccccccccaacgccgaccccaacatgaagctgttcaccatcagaggcaccccccagcagatcgactacgccagacagctgatcgaggagaagatcggcggccccgtgaaccccctgggcccccccgtgccccacggcccccacggcgtgcccggcccccacggcccccccggcccccccggccccggcacccccatgggcccctacaaccccgccccctacaaccccggcccccccggccccgccccccacggcccccccgccccctacgccccccagggctggggcaacgcctacccccactggcagcagcaggccccccccgaccccgccaaggccggcaccgaccccaacagcgccgcctgggccgcctactacgcccactactaccagcagcaggcccagcccccccccgccgcccccgccggcgcccccaccaccacccagaccaacggccaggagggcgaccagcagaaccccgcccccgccggccaggtggactacaccaaggcctgggaggagtactacaagaagatgggccaggccgtgcccgcccccaccggcgccccccccggcggccagcccgactacagcgccgcctgggccgagtactacagacagcaggccgcctactacgcccagaccagcccccagggcatgccccagcacccccccgccccccagtgcagattcgaccccgccagcatcgagctggccctgtag

SEQ ID NO: 81256 - DNA, 1890 bp, Artificial Sequence
  Description of Artificial Sequence: Synthetic coding sequence
atggccgactacagcaccgtgcccccccccagcagcggcagcgccggcggcggcggcggcggcggcggcggcggcggcgtgaacgacgccttcaaggacgccctgcagagagccagacagatcgccgccaagatcggcggcgacgccggcaccagcctgaacagcaacgactacggctacggcggccagaagagacccctggaggacggcgaccagcccgacgccaagaaggtggccccccagaacgacagcttcggcacccagctgccccccatgcaccagcagcagagaagcgtgatgaccgaggagtacaaggtgcccgacggcatggtgggcttcatcatcggcagaggcggcgagcagatcagcagaatccagcaggagagcggctgcaagatccagatcgcccccgacagcggcggcctgcccgagagaagctgcatgctgaccggcacccccgagagcgtgcagagcgccaagagactgctggaccagatcgtggagaagggcagacccgcccccggcttccaccacggcgacggccccggcaacgccgtgcaggagatcatgatccccgccagcaaggccggcctggtgatcggcaagggcggcgagaccatcaagcagctgcaggagagagccggcgtgaagatggtgatgatccaggacggcccccagaacaccggcgccgacaagcccctgagaatcaccggcgacccctacaaggtgcagcaggccaaggagatggtgctggagctgatcagagaccagggcggcttcagagaggtgagaaacgagtacggcagcagaatcggcggcaacgagggcatcgacgtgcccatccccagattcgccgtgggcatcgtgatcggcagaaacggcgagatgatcaagaagatccagaacgacgccggcgtgagaatccagttcaagcccgacgacggcaccacccccgagagaatcgcccagatcaccggcccccccgacagatgccagcacgccgccgagatcatcaccgacctgctgagaagcgtgcaggccggcaaccccggcggccccggccccggcggcagaggcagaggcagaggccagggcaactggaacatgggcccccccggcggcctgcaggagttcaacttcatcgtgcccaccggcaagaccggcctgatcatcggcaagggcggcgagaccatcaagagcatcagccagcagagcggcgccagaatcgagctgcagagaaaccccccccccaacgccgaccccaacatgaagctgttcaccatcagaggcaccccccagcagatcgactacgccagacagctgatcgaggagaagatcggcggccccgtgaaccccctgggcccccccgtgccccacggcccccccggcacccccatgggcccctacaaccccgccccctacaaccccggcccccccggccccgccccccacggcccccccgccccctacgccccccagggctggggcaacgcctacccccactggcagcagcaggccccccccgaccccgccaaggccggcaccgaccccaacagcgccgcctgggccgcctactacgcccactactaccagcagcaggcccagcccccccccgccgcccccgccggcgcccccaccaccacccagaccaacggccagggcgaccagcagaaccccgcccccgccggccaggtggactacaccaaggcctgggaggagtactacaagaagatgggccaggccgtgcccgcccccaccggcgccccccccggcggccagcccgactacagcgccgcctgggccgagtactacagacagcaggccgcctactacgcccagaccagcccccagggcatgccccagcacccccccgccccccagggccagtag

SEQ ID NO: 81257 - DNA, 699 bp, Artificial Sequence
  Description of Artificial Sequence: Synthetic coding sequence
atggccgactacagcaccgtgcccccccccagcagcggcagcgccggcggcggcggcggcggcggcggcggcggcggcgtgaacgacgccttcaaggacgccctgcagagagccagacagatcgccgccaagatcggcggcgacgccggcaccagcctgaacagcaacgactacggctacggcggccagaagagacccctggaggacggcgacggcagctggaccagccccagcagcaccacccactgggagggcatgcccagccccttcaaggaccagcccgacgccaagaaggtggccccccagaacgacagcttcggcacccagctgccccccatgcaccagcagcagagaagcgtgatgaccgaggagtacaaggtgcccgacggcatggtgggcttcatcatcggcagaggcggcgagcagatcagcagaatccagcaggagagcggctgcaagatccagatcgcccccgacagcggcggcctgcccgagagaagctgcatgctgaccggcacccccgagagcgtgcagagcgccaagagactgctggaccagatcgtggagaagggcagacccgcccccggcttccaccacggcgacggccccggcaacgccgtgcaggagatcatgatccccgccagcaaggccggcctggtgatcggcaagggcggcgagaccatcaagcagctgcagtag

SEQ ID NO: 81258 - DNA, 1998 bp, Artificial Sequence
  Description of Artificial Sequence: Synthetic coding sequence
atggccgactacagcaccgtgcccccccccagcagcggcagcgccggcggcggcggcggcggcggcggcggcggcggcgtgaacgacgccttcaaggacgccctgcagagagccagacagatcgccgccaagatcggcggcgacgccggcaccagcctgaacagcaacgactacggctacggcggccagaagagacccctggaggacggcgacggcagctggaccagccccagcagcaccacccactgggagggcatgcccagccccttcaaggaccagcccgacgccaagaaggtggccccccagaacgacagcttcggcacccagctgccccccatgcaccagcagcagagcagaagcgtgatgaccgaggagtacaaggtgcccgacggcatggtgggcttcatcatcggcagaggcggcgagcagatcagcagaatccagcaggagagcggctgcaagatccagatcgcccccgacagcggcggcctgcccgagagaagctgcatgctgaccggcacccccgagagcgtgcagagcgccaagagactgctggaccagatcgtggagaagggcagacccgcccccggcttccaccacggcgacggccccggcaacgccgtgcaggagatcatgatccccgccagcaaggccggcctggtgatcggcaagggcggcgagaccatcaagcagctgcaggagagagccggcgtgaagatggtgatgatccaggacggcccccagaacaccggcgccgacaagcccctgagaatcaccggcgacccctacaaggtgcagcaggccaaggagatggtgctggagctgatcagagaccagggcggcttcagagaggtgagaaacgagtacggcagcagaatcggcggcaacgagggcatcgacgtgcccatccccagattcgccgtgggcatcgtgatcggcagaaacggcgagatgatcaagaagatccagaacgacgccggcgtgagaatccagttcaagcccgacgacggcaccacccccgagagaatcgcccagatcaccggcccccccgacagatgccagcacgccgccgagatcatcaccgacctgctgagaagcgtgcaggccggcaaccccggcggccccggccccggcggcagaggcagaggcagaggccagggcaactggaacatgggcccccccggcggcctgcaggagttcaacttcatcgtgcccaccggcaagaccggcctgatcatcggcaagggcggcgagaccatcaagagcatcagccagcagagcggcgccagaatcgagctgcagagaaaccccccccccaacgccgaccccaacatgaagctgttcaccatcagaggcaccccccagcagatcgactacgccagacagctgatcgaggagaagatcggcggccccgtgaaccccctgggcccccccgtgccccacggcccccacggcgtgcccggcccccacggcccccccggcccccccggccccggcacccccatgggcccctacaaccccgccccctacaaccccggcccccccggccccgccccccacggcccccccgccccctacgccccccagggctggggcaacgcctacccccactggcagcagcaggccccccccgaccccgccaaggccggcaccgaccccaacagcgccgcctgggccgcctactacgcccactactaccagcagcaggcccagcccccccccgccgcccccgccggcgcccccaccaccacccagaccaacggccagggcgaccagcagaaccccgcccccgccggccaggtggactacaccaaggcctgggaggagtactacaagaagatgggccaggccgtgcccgcccccaccggcgccccccccggcggccagcccgactacagcgccgcctgggccgagtactacagacagcaggccgcctactacgcccagaccagcccccagggcatgccccagcacccccccgccccccagggccagtag

SEQ ID NO: 81259 - DNA, 1260 bp, Artificial Sequence
  Description of Artificial Sequence: Synthetic coding sequence
atgcccctgagcagatggctgagaagcgtgggcgtgttcctgctgcccgccccctactgggcccccagagagagatggctgggcagcctgagaagacccagcctggtgcacggctaccccgtgctggcctggcacagcgccagatgctggtgccaggcctggaccgaggagcccagagccctgtgcagcagcctgagaatgaacggcgaccagaacagcgacgtgtacgcccaggagaagcaggacttcgtgcagcacttcagccagatcgtgagagtgctgaccgaggacgagatgggccaccccgagatcggcgacgccatcgccagactgaaggaggtgctggagtacaacgccatcggcggcaagtacaacagaggcctgaccgtggtggtggccttcagagagctggtggagcccagaaagcaggacgccgacagcctgcagagagcctggaccgtgggctggtgcgtggagctgctgcaggccttcttcctggtggccgacgacatcatggacagcagcctgaccagaagaggccagatctgctggtaccagaagcccggcgtgggcctggacgccatcaacgacgccaacctgctggaggcctgcatctacagactgctgaagctgtactgcagagagcagccctactacctgaacctgatcgagctgttcctgcagagcagctaccagaccgagatcggccagaccctggacctgctgaccgccccccagggcaacgtggacctggtgagattcaccgagaagagatacaagagcatcgtgaagtacaagaccgccttctacagcttctacctgcccatcgccgccgccatgtacatggccggcatcgacggcgagaaggagcacgccaacgccaagaagatcctgctggagatgggcgagttcttccagatccaggacgactacctggacctgttcggcgaccccagcgtgaccggcaagatcggcaccgacatccaggacaacaagtgcagctggctggtggtgcagtgcctgcagagagccacccccgagcagtaccagatcctgaaggagaactacggccagaaggaggccgagaaggtggccagagtgaaggccctgtacgaggagctggacctgcccgccgtgttcctgcagtacgaggaggacagctacagccacatcatggccctgatcgagcagtacgccgcccccctgccccccgccgtgttcctgggcctggccagaaagatctacaagagaagaaagtag

SEQ ID NO: 81260 - DNA, 1260 bp, Artificial Sequence; identical to SEQ ID NO: 81259
  Description of Artificial Sequence: Synthetic coding sequence

SEQ ID NO: 81261 - DNA, 1062 bp, Artificial Sequence
  Description of Artificial Sequence: Synthetic coding sequence
atgaacggcgaccagaacagcgacgtgtacgcccaggagaagcaggacttcgtgcagcacttcagccagatcgtgagagtgctgaccgaggacgagatgggccaccccgagatcggcgacgccatcgccagactgaaggaggtgctggagtacaacgccatcggcggcaagtacaacagaggcctgaccgtggtggtggccttcagagagctggtggagcccagaaagcaggacgccgacagcctgcagagagcctggaccgtgggctggtgcgtggagctgctgcaggccttcttcctggtggccgacgacatcatggacagcagcctgaccagaagaggccagatctgctggtaccagaagcccggcgtgggcctggacgccatcaacgacgccaacctgctggaggcctgcatctacagactgctgaagctgtactgcagagagcagccctactacctgaacctgatcgagctgttcctgcagagcagctaccagaccgagatcggccagaccctggacctgctgaccgccccccagggcaacgtggacctggtgagattcaccgagaagagatacaagagcatcgtgaagtacaagaccgccttctacagcttctacctgcccatcgccgccgccatgtacatggccggcatcgacggcgagaaggagcacgccaacgccaagaagatcctgctggagatgggcgagttcttccagatccaggacgactacctggacctgttcggcgaccccagcgtgaccggcaagatcggcaccgacatccaggacaacaagtgcagctggctggtggtgcagtgcctgcagagagccacccccgagcagtaccagatcctgaaggagaactacggccagaaggaggccgagaaggtggccagagtgaaggccctgtacgaggagctggacctgcccgccgtgttcctgcagtacgaggaggacagctacagccacatcatggccctgatcgagcagtacgccgcccccctgccccccgccgtgttcctgggcctggccagaaagatctacaagagaagaaagtag

SEQ ID NO: 81262 - DNA, 2760 bp, Artificial Sequence
  Description of Artificial Sequence: Synthetic coding sequence
atgaccggctacaccatgctgagaaacggcggcgccggcaacggcggccagacctgcatgctgagatggagcaacagaatcagactgacctggctgagcttcaccctgttcgtgatcctggtgttcttccccctgatcgcccactactacctgaccaccctggacgaggccgacgaggccggcaagagaatcttcggccccagagtgggcaacgagctgtgcgaggtgaagcacgtgctggacctgtgcagaatcagagagagcgtgagcgaggagctgctgcagctggaggccaagagacaggagctgaacagcgagatcgccaagctgaacctgaagatcgaggcctgcaagaagagcatcgagaacgccaagcaggacctgctgcagctgaagaacgtgatcagccagaccgagcacagctacaaggagctgatggcccagaaccagcccaagctgagcctgcccatcagactgctgcccgagaaggacgacgccggcctgcccccccccaaggccaccagaggctgcagactgcacaactgcttcgactacagcagatgccccctgaccagcggcttccccgtgtacgtgtacgacagcgaccagttcgtgttcggcagctacctggaccccctggtgaagcaggccttccaggccaccgccagagccaacgtgtacgtgaccgagaacgccgacatcgcctgcctgtacgtgatcctggtgggcgagatgcaggagcccgtggtgctgagacccgccgagctggagaagcagctgtacagcctgccccactggagaaccgacggccacaaccacgtgatcatcaacctgagcagaaagagcgacacccagaacctgctgtacaacgtgagcaccggcagagccatggtggcccagagcaccttctacaccgtgcagtacagacccggcttcgacctggtggtgagccccctggtgcacgccatgagcgagcccaacttcatggagatccccccccaggtgcccgtgaagagaaagtacctgttcaccttccagggcgagaagatcgagagcctgagaagcagcctgcaggaggccagaagcttcgaggaggagatggagggcgacccccccgccgactacgacgacagaatcatcgccaccctgaaggccgtgcaggacagcaagctggaccaggtgctggtggagttcacctgcaagaaccagcccaagcccagcctgcccaccgagtgggccctgtgcggcgagagagaggacagactggagctgctgaagctgagcaccttcgccctgatcatcacccccggcgaccccagactggtgatcagcagcggctgcgccaccagactgttcgaggccctggaggtgggcgccgtgcccgtggtgctgggcgagcaggtgcagctgccctaccaggacatgctgcagtggaacgaggccgccctggtggtgcccaagcccagagtgaccgaggtgcacttcctgctgagaagcctgagcgacagcgacctgctggccatgagaagacagggcagattcctgtgggagacctacttcagcaccgccgacagcatcttcaacaccgtgctggccatgatcagaaccagaatccagatccccgccgcccccatcagagaggaggccgccgccgagatcccccacagaagcggcaaggccgccggcaccgaccccaacatggccgacaacggcgacctggacctgggccccgtggagaccgagcccccctacgccagccccagatacctgagaaacttcaccctgaccgtgaccgacttctacagaagctggaactgcgcccccggccccttccacctgttcccccacacccccttcgaccccgtgctgcccagcgaggccaagttcctgggcagcggcaccggcttcagacccatcggcggcggcgccggcggcagcggcaaggagttccaggccgccctgggcggcaacgtgcccagagagcagttcaccgtggtgatgctgacctacgagagagaggaggtgctgatgaacagcctggagagactgaacggcctgccctacctgaacaaggtggtggtggtgtggaacagccccaagctgcccagcgaggacctgctgtggcccgacatcggcgtgcccatcatggtggtgagaaccgagaagaacagcctgaacaacagattcctgccctggaacgagatcgagaccgaggccatcctgagcatcgacgacgacgcccacctgagacacgacgagatcatgttcggcttcagagtgtggagagaggccagagacagaatcgtgggcttccccggcagataccacgcctgggacatcccccaccagagctggctgtacaacagcaactacagctgcgagctgagcatggtgctgaccggcgccgccttcttccacaagtactacgcctacctgtacagctacgtgatgccccaggccatcagagacatggtggacgagtacatcaactgcgaggacatcgccatgaacttcctggtgagccacatcaccagaaagccccccatcaaggtgaccagcagatggaccttcagatgccccggctgcccccaggccctgagccacgacgacagccacttccacgagagacacaagtgcatcaacttcttcgtgaaggtgtacggctacatgcccctgctgtacacccagttcagagtggacagcgtgctgttcaagaccagactgccccacgacaagaccaagtgcttcaagttcatctag

SEQ ID NO: 81263 - DNA, 1125 bp, Artificial Sequence
  Description of Artificial Sequence: Synthetic coding sequence
atggagttcgtgaagtgcctgggccaccccgaggagttctacaacctggtgagattcagaatcggcggcaagagaaaggtgatgcccaagatggaccaggacagcctgagcagcagcctgaagacctgctacaagtacctgaaccagaccagcagaagcttcgccgccgtgatccaggccctggacggcgagatgagaaacgccgtgtgcatcttctacctggtgctgagagccctggacaccctggaggacgacatgaccatcagcgtggagaagaaggtgcccctgctgcacaacttccacagcttcctgtaccagcccgactggagattcatggagagcaaggagaaggacagacaggtgctggaggacttccccacctactgccactacgtggccggcctggtgggcatcggcctgagcagactgttcagcgccagcgagttcgaggaccccctggtgggcgaggacaccgagagagccaacagcatgggcctgttcctgcagaagaccaacatcatcagagactacctggaggaccagcagggcggcagagagttctggccccaggaggtgtggagcagatacgtgaagaagctgggcgacttcgccaagcccgagaacatcgacctggccgtgcagtgcctgaacgagctgatcaccaacgccctgcaccacatccccgacgtgatcacctacctgagcagactgagaaaccagagcgtgttcaacttctgcgccatcccccaggtgatggccatcgccaccctggccgcctgctacaacaaccagcaggtgttcaagggcgccgtgaagatcagaaagggccaggccgtgaccctgatgatggacgccaccaacatgcccgccgtgaaggccatcatctaccagtacatggaggagatctaccacagaatccccgacagcgaccccagcagcagcaagaccagacagatcatcagcaccatcagaacccagaacctgcccaactgccagctgatcagcagaagccactacagccccatctacctgagcttcgtgatgctgctggccgccctgagctggcagtacctgaccaccctgagccaggtgaccgaggactacgtgcagaccggcgagcactag

SEQ ID NO: 81264 - DNA, 999 bp, Artificial Sequence
  Description of Artificial Sequence: Synthetic coding sequence
atgaccatcagcgtggagaagaaggtgcccctgctgcacaacttccacagcttcctgtaccagcccgactggagattcatggagagcaaggagaaggacagacaggtgctggaggacttccccaccatcagcctggagttcagaaacctggccgagaagtaccagaccgtgatcgccgacatctgcagaagaatgggcatcggcatggccgagttcctggacaagcacgtgaccagcgagcaggagtgggacaagtactgccactacgtggccggcctggtgggcatcggcctgagcagactgttcagcgccagcgagttcgaggaccccctggtgggcgaggacaccgagagagccaacagcatgggcctgttcctgcagaagaccaacatcatcagagactacctggaggaccagcagggcggcagagagttctggccccaggaggtgtggagcagatacgtgaagaagctgggcgacttcgccaagcccgagaacatcgacctggccgtgcagtgcctgaacgagctgatcaccaacgccctgcaccacatccccgacgtgatcacctacctgagcagactgagaaaccagagcgtgttcaacttctgcgccatcccccaggtgatggccatcgccaccctggccgcctgctacaacaaccagcaggtgttcaagggcgccgtgaagatcagaaagggccaggccgtgaccctgatgatggacgccaccaacatgcccgccgtgaaggccatcatctaccagtacatggaggagatctaccacagaatccccgacagcgaccccagcagcagcaagaccagacagatcatcagcaccatcagaacccagaacctgcccaactgccagctgatcagcagaagccactacagccccatctacctgagcttcgtgatgctgctggccgccctgagctggcagtacctgaccaccctgagccaggtgaccgaggactacgtgcagaccggcgagcactag

SEQ ID NO: 81265 - DNA, 1233 bp, Artificial Sequence
  Description of Artificial Sequence: Synthetic coding sequence
atggagttcgtgaagtgcctgggccaccccgaggagttctacaacctggtgagattcagaatcggcggcaagagaaaggacagcctgagcagcagcctgaagacctgctacaagtacctgaaccagaccagcagaagcttcgccgccgtgatccaggccctggacggcgagatgagaaacgccgtgtgcatcttctacctggtgctgagagccctggacaccctggaggacgacatgaccatcagcgtggagaagaaggtgcccctgctgcacaacttccacagcttcctgtaccagcccgactggagattcatggagagcaaggagaaggacagacaggtgctggaggacttccccaccatcagcctggagttcagaaacctggccgagaagtaccagaccgtgatcgccgacatctgcagaagaatgggcatcggcatggccgagttcctggacaagcacgtgaccagcgagcaggagtgggacaagtactgccactacgtggccggcctggtgggcatcggcctgagcagactgttcagcgccagcgagttcgaggaccccctggtgggcgaggacaccgagagagccaacagcatgggcctgttcctgcagaagaccaacatcatcagagactacctggaggaccagcagggcggcagagagttctggccccaggaggtgtggagcagatacgtgaagaagctgggcgacttcgccaagcccgagaacatcgacctggccgtgcagtgcctgaacgagctgatcaccaacgccctgcaccacatccccgacgtgatcacctacctgagcagactgagaaaccagagcgtgttcaacttctgcgccatcccccaggtgatggccatcgccaccctggccgcctgctacaacaaccagcaggtgttcaagggcgccgtgaagatcagaaagggccaggccgtgaccctgatgatggacgccaccaacatgcccgccgtgaaggccatcatctaccagtacatggaggagatctaccacagaatccccgacagcgaccccagcagcagcaagaccagacagatcatcagcaccatcagaacccagaacctgcccaactgccagctgatcagcagaagccactacagccccatctacctgagcttcgtgatgctgctggccgccctgagctggcagtacctgaccaccctgagccaggtgaccgaggactacgtgcagaccggcgagcactag

SEQ ID NO: 81266 - DNA, 999 bp, Artificial Sequence; identical to SEQ ID NO: 81264
  Description of Artificial Sequence: Synthetic coding sequence

SEQ ID NO: 81267 - DNA, 1062 bp, Artificial Sequence
  Description of Artificial Sequence: Synthetic coding sequence
atgagaaacgccgtgtgcatcttctacctggtgctgagagccctggacaccctggaggacgacatgaccatcagcgtggagaagaaggtgcccctgctgcacaacttccacagcttcctgtaccagcccgactggagattcatggagagcaaggagaaggacagacaggtgctggaggacttccccaccatcagcctggagttcagaaacctggccgagaagtaccagaccgtgatcgccgacatctgcagaagaatgggcatcggcatggccgagttcctggacaagcacgtgaccagcgagcaggagtgggacaagtactgccactacgtggccggcctggtgggcatcggcctgagcagactgttcagcgccagcgagttcgaggaccccctggtgggcgaggacaccgagagagccaacagcatgggcctgttcctgcagaagaccaacatcatcagagactacctggaggaccagcagggcggcagagagttctggccccaggaggtgtggagcagatacgtgaagaagctgggcgacttcgccaagcccgagaacatcgacctggccgtgcagtgcctgaacgagctgatcaccaacgccctgcaccacatccccgacgtgatcacctacctgagcagactgagaaaccagagcgtgttcaacttctgcgccatcccccaggtgatggccatcgccaccctggccgcctgctacaacaaccagcaggtgttcaagggcgccgtgaagatcagaaagggccaggccgtgaccctgatgatggacgccaccaacatgcccgccgtgaaggccatcatctaccagtacatggaggagatctaccacagaatccccgacagcgaccccagcagcagcaagaccagacagatcatcagcaccatcagaacccagaacctgcccaactgccagctgatcagcagaagccactacagccccatctacctgagcttcgtgatgctgctggccgccctgagctggcagtacctgaccaccctgagccaggtgaccgaggactacgtgcagaccggcgagcactag

SEQ ID NO: 81268 - DNA, 1062 bp, Artificial Sequence; identical to SEQ ID NO: 81267
  Description of Artificial Sequence: Synthetic coding sequence

SEQ ID NO: 81269 - DNA, 921 bp, Artificial Sequence
  Description of Artificial Sequence: Synthetic coding sequence
atggagagcaaggagaaggacagacaggtgctggaggacttccccaccatcagcctggagttcagaaacctggccgagaagtaccagaccgtgatcgccgacatctgcagaagaatgggcatcggcatggccgagttcctggacaagcacgtgaccagcgagcaggagtgggacaagtactgccactacgtggccggcctggtgggcatcggcctgagcagactgttcagcgccagcgagttcgaggaccccctggtgggcgaggacaccgagagagccaacagcatgggcctgttcctgcagaagaccaacatcatcagagactacctggaggaccagcagggcggcagagagttctggccccaggaggtgtggagcagatacgtgaagaagctgggcgacttcgccaagcccgagaacatcgacctggccgtgcagtgcctgaacgagctgatcaccaacgccctgcaccacatccccgacgtgatcacctacctgagcagactgagaaaccagagcgtgttcaacttctgcgccatcccccaggtgatggccatcgccaccctggccgcctgctacaacaaccagcaggtgttcaagggcgccgtgaagatcagaaagggccaggccgtgaccctgatgatggacgccaccaacatgcccgccgtgaaggccatcatctaccagtacatggaggagatctaccacagaatccccgacagcgaccccagcagcagcaagaccagacagatcatcagcaccatcagaacccagaacctgcccaactgccagctgatcagcagaagccactacagccccatctacctgagcttcgtgatgctgctggccgccctgagctggcagtacctgaccaccctgagccaggtgaccgaggactacgtgcagaccggcgagcactag

SEQ ID NO: 81270 - DNA, 1140 bp, Artificial Sequence
  Description of Artificial Sequence: Synthetic coding sequence
atggccgccaccgagggcgtgggcgaggccgcccagggcggcgagcccggccagcccgcccagccccccccccagccccaccccccccccccccagcagcagcacaaggaggagatggccgccgaggccggcgaggccgtggccagccccatggacgacggcttcgtgagcctggacagccccagctacgtgctgtacagagacagagccgagtgggccgacatcgaccccgtgccccagaacgacggccccaaccccgtggtgcagatcatctacagcgacaagttcagagacgtgtacgactacttcagagccgtgctgcagagagacgagagaagcgagagagccttcaagctgaccagagacgccatcgagctgaacgccgccaactacaccgtgtggcacttcagaagagtgctgctgaagagcctgcagaaggacctgcacgaggagatgaactacatcaccgccatcatcgaggagcagcccaagaactaccaggtgtggcaccacagaagagtgctggtggagtggctgagagaccccagccaggagctggagttcatcgccgacatcctgaaccaggacgccaagaactaccacgcctggcagcacagacagtgggtgatccaggagttcaagctgtgggacaacgagctgcagtacgtggaccagctgctgaaggaggacgtgagaaacaacagcgtgtggaaccagagatacttcgtgatcagcaacaccaccggctacaacgacagagccgtgctggagagagaggtgcagtacaccctggagatgatcaagctggtgccccacaacgagagcgcctggaactacctgaagggcatcctgcaggacagaggcctgagcaagtaccccaacctgctgaaccagctgctggacctgcagcccagccacagcagcccctacctgatcgccttcctggtggacatctacgaggacatgctggagaaccagtgcgacaacaaggaggacatcctgaacaaggccctggagctgtgcgagatcctggccaaggagaaggacaccatcagaaaggagtactggagatacatcggcagaagcctgcagagcaagcacagcaccgagaacgacagccccaccaacgtgcagcagtag

SEQ ID NO: 81271 - DNA, 939 bp, Artificial Sequence
  Description of Artificial Sequence: Synthetic coding sequence
atggccgccaccgagggcgtgggcgaggccgcccagggcggcgagcccggccagcccgcccagccccccccccagccccaccccccccccccccagcagcagcacaaggaggagatggccgccgaggccggcgaggccgtggccagccccatggacgacggcttcgtgagcctggacagccccagctacgtgctgtacagacacttcagaagagtgctgctgaagagcctgcagaaggacctgcacgaggagatgaactacatcaccgccatcatcgaggagcagcccaagaactaccaggtgtggcaccacagaagagtgctggtggagtggctgagagaccccagccaggagctggagttcatcgccgacatcctgaaccaggacgccaagaactaccacgcctggcagcacagacagtgggtgatccaggagttcaagctgtgggacaacgagctgcagtacgtggaccagctgctgaaggaggacgtgagaaacaacagcgtgtggaaccagagatacttcgtgatcagcaacaccaccggctacaacgacagagccgtgctggagagagaggtgcagtacaccctggagatgatcaagctggtgccccacaacgagagcgcctggaactacctgaagggcatcctgcaggacagaggcctgagcaagtaccccaacctgctgaaccagctgctggacctgcagcccagccacagcagcccctacctgatcgccttcctggtggacatctacgaggacatgctggagaaccagtgcgacaacaaggaggacatcctgaacaaggccctggagctgtgcgagatcctggccaaggagaaggacaccatcagaaaggagtactggagatacatcggcagaagcctgcagagcaagcacagcaccgagaacgacagccccaccaacgtgcagcagtag

SEQ ID NO: 81272 - DNA, 1314 bp, Artificial Sequence
  Description of Artificial Sequence: Synthetic coding sequence
atggccagccccagcagcttcacctactactgcccccccagcagcagccccgtgtggagcgagcccctgtacagcctgagacccgagcacgccagagagagactgcaggacgacagcgtggagaccgtgaccagcatcgagcaggccaaggtggaggagaagatccaggaggtgttcagcagctacaagttcaaccacctggtgcccagactggtgctgcagagagagaagcacttccactacctgaagagaggcctgagacagctgaccgacgcctacgagtgcctggacgccagcagaccctggctgtgctactggatcctgcacagcctggagctgctggacgagcccatcccccagatcgtggccaccgacgtgtgccagttcctggagctgtgccagagccccgagggcggcttcggcggcggccccggccagtacccccacctggcccccacctacgccgccgtgaacgccctgtgcatcatcggcaccgaggaggcctacgacatcatcaacagagagaagctgctgcagtacctgtacagcctgaagcagcccgacggcagcttcctgatgcacgtgggcggcgaggtggacgtgagaagcgcctactgcgccgccagcgtggccagcctgaccaacatcatcacccccgacctgttcgagggcaccgccgagtggatcgccagatgccagaactgggagggcggcatcggcggcgtgcccggcatggaggcccacggcggctacaccttctgcggcctggccgccctggtgatcctgaagagagagagaagcctgaacctgaagagcctgctgcagtgggtgaccagcagacagatgagattcgagggcggcttccagggcagatgcaacaagctggtggacggctgctacagcttctggcaggccggcctgctgcccctgctgcacagagccctgcacgcccagggcgaccccgccctgagcatgagccactggatgttccaccagcaggccctgcaggagtacatcctgatgtgctgccagtgccccgccggcggcctgctggacaagcccggcaagagcagagacttctaccacacctgctactgcctgagcggcctgagcatcgcccagcacttcggcagcggcgccatgctgcacgacgtggtgctgggcgtgcccgagaacgccctgcagcccacccaccccgtgtacaacatcggccccgacaaggtgatccaggccaccacctacttcctgcagaagcccgtgcccggcttcgaggagctgaaggacgagaccagcgccgagcccgccaccgactag

SEQ ID NO: 81273 - DNA, 1953 bp, Artificial Sequence
  Description of Artificial Sequence: Synthetic coding sequence
atggccagcaacatggacagagagatgatcctggccgacttccaggcctgcaccggcatcgagaacatcgacgaggccatcaccctgctggagcagaacaactgggacctggtggccgccatcaacggcgtgatcccccaggagaacggcatcctgcagagcgagtacggcggcgagaccatccccggccccgccttcaaccccgccagccaccccgccagcgcccccaccagcagcagcagcagcgccttcagacccgtgatgcccagcagacagatcgtggagagacagcccagaatgctggacttcagagtggagtacagagacagaaacgtggacgtggtgctggaggacacctgcaccgtgggcgagatcaagcagatcctggagaacgagctgcagatccccgtgagcaagatgctgctgaagggctggaagaccggcgacgtggaggacagcaccgtgctgaagagcctgcacctgcccaagaacaacagcctgtacgtgctgacccccgacctgcccccccccagcagcagcagccacgccggcgccctgcaggagagcctgaaccagaacttcatgctgatcatcacccacagagaggtgcagagagagtacaacctgaacttcagcggcagcagcaccatccaggaggtgaagagaaacgtgtacgacctgaccagcatccccgtgagacaccagctgtgggagggctggcccaccagcgccaccgacgacagcatgtgcctggccgagagcggcctgagctacccctgccacagactgaccgtgggcagaagaagcagccccgcccagaccagagagcagagcgaggagcagatcaccgacgtgcacatggtgagcgacagcgacggcgacgacttcgaggacgccaccgagttcggcgtggacgacggcgaggtgttcggcatggccagcagcgccctgagaaagagccccatgatgcccgagaacgccgagaacgagggcgacgccctgctgcagttcaccgccgagttcagcagcagatacggcgactgccaccccgtgttcttcatcggcagcctggaggccgccttccaggaggccttctacgtgaaggccagagacagaaagctgctggccatctacctgcaccacgacgagagcgtgctgaccaacgtgttctgcagccagatgctgtgcgccgagagcatcgtgagctacctgagccagaacttcatcacctgggcctgggacctgaccaaggacagcaacagagccagattcctgaccatgtgcaacagacacttcggcagcgtggtggcccagaccatcagaacccagaagaccgaccagttccccctgttcctgatcatcatgggcaagagaagcagcaacgaggtgctgaacgtgatccagggcaacaccaccgtggacgagctgatgatgagactgatggccgccatggagatcttcaccgcccagcagcaggaggacatcaaggacgaggacgagagagaggccagagagaacgtgaagagagagcaggacgaggcctacagactgagcctggaggccgacagagccaagagagaggcccacgagagagagatggccgagcagttcagactggagcagatcagaaaggagcaggaggaggagagagaggccatcagactgagcctggagcaggccctgccccccgagcccaaggaggagaacgccgagcccgtgagcaagctgagaatcagaacccccagcggcgagttcctggagagaagattcctggccagcaacaagctgcagatcgtgttcgacttcgtggccagcaagggcttcccctgggacgagtacaagctgctgagcaccttccccagaagagacgtgacccagctggaccccaacaagagcctgctggaggtgaagctgttcccccaggagaccctgttcctggaggccaaggagtag

SEQ ID NO: 81274 - DNA, 1473 bp, Artificial Sequence
  Description of Artificial Sequence: Synthetic coding sequence
atgatcctggccgacttccaggcctgcaccggcatcgagaacatcgacgaggccatcaccctgctggagcagaacaactgggacctggtggccgccatcaacggcgtgatcccccaggagaacggcatcctgcagagcgagtacggcggcgagaccatccccggccccgccttcaaccccgccagccaccccgccagcgcccccaccagcagcagcagcagcgccttcagacccgtgatgcccagcagacagatcgtggagagacagcccagaatgctggacttcagagtggagtacagagacagaaacgtggacgtggtgctggaggacacctgcaccgtgggcgagatcaagcagatcctggagaacgagctgcagatccccgtgagcaagatgctgctgaagggctggaagaccggcgacgtggaggacagcaccgtgctgaagagcctgcacctgcccaagaacaacagcctgtacgtgctgacccccgacctgcccccccccagcagcagcagccacgccggcgccctgcaggagttcagcagcagatacggcgactgccaccccgtgttcttcatcggcagcctggaggccgccttccaggaggccttctacgtgaaggccagagacagaaagctgctggccatctacctgcaccacgacgagagcgtgctgaccaacgtgttctgcagccagatgctgtgcgccgagagcatcgtgagctacctgagccagaacttcatcacctgggcctgggacctgaccaaggacagcaacagagccagattcctgaccatgtgcaacagacacttcggcagcgtggtggcccagaccatcagaacccagaagaccgaccagttccccctgttcctgatcatcatgggcaagagaagcagcaacgaggtgctgaacgtgatccagggcaacaccaccgtggacgagctgatgatgagactgatggccgccatggagatcttcaccgcccagcagcaggaggacatcaaggacgaggacgagagagaggccagagagaacgtgaagagagagcaggacgaggcctacagactgagcctggaggccgacagagccaagagagaggcccacgagagagagatggccgagcagttcagactggagcagatcagaaaggagcaggaggaggagagagaggccatcagactgagcctggagcaggccctgccccccgagcccaaggaggagaacgccgagcccgtgagcaagctgagaatcagaacccccagcggcgagttcctggagagaagattcctggccagcaacaagctgcagatcgtgttcgacttcgtggccagcaagggcttcccctgggacgagtacaagctgctgagcaccttccccagaagagacgtgacccagctggaccccaacaagagcctgctggaggtgaagctgttcccccaggagaccctgttcctggaggccaaggagtag

SEQ ID NO: 81275 - DNA, 1953 bp, Artificial Sequence; identical to SEQ ID NO: 81273
  Description of Artificial Sequence: Synthetic coding sequence

SEQ ID NO: 81276 - DNA, 1497 bp, Artificial Sequence
  Description of Artificial Sequence: Synthetic coding sequence
atggccagcaacatggacagagagatgatcctggccgacttccaggcctgcaccggcatcgagaacatcgacgaggccatcaccctgctggagcagaacaactgggacctggtggccgccatcaacggcgtgatcccccaggagaacggcatcctgcagagcgagtacggcggcgagaccatccccggccccgccttcaaccccgccagccaccccgccagcgcccccaccagcagcagcagcagcgccttcagacccgtgatgcccagcagacagatcgtggagagacagcccagaatgctggacttcagagtggagtacagagacagaaacgtggacgtggtgctggaggacacctgcaccgtgggcgagatcaagcagatcctggagaacgagctgcagatccccgtgagcaagatgctgctgaagggctggaagaccggcgacgtggaggacagcaccgtgctgaagagcctgcacctgcccaagaacaacagcctgtacgtgctgacccccgacctgcccccccccagcagcagcagccacgccggcaccctgcagcagttcagctacagatacggcgactgccaccccgtgttcttcatcggcagcctggaggccgccttccaggaggccttctacgtgaaggccagagacagaaagctgctggccatctacctgcaccacgacgagagcgtgctgaccaacgtgttctgcagccagatgctgtgcgccgagagcatcgtgagctacctgagccagaacttcatcacctgggcctgggacctgaccaaggacagcaacagagccagattcctgaccatgtgcaacagacacttcggcagcgtggtggcccagaccatcagaacccagaagaccgaccagttccccctgttcctgatcatcatgggcaagagaagcagcaacgaggtgctgaacgtgatccagggcaacaccaccgtggacgagctgatgatgagactgatggccgccatggagatcttcaccgcccagcagcaggaggacatcaaggacgaggacgagagagaggccagagagaacgtgaagagagagcaggacgaggcctacagactgagcctggaggccgacagagccaagagagaggcccacgagagagagatggccgagcagttcagactggagcagatcagaaaggagcaggaggaggagagagaggccatcagactgagcctggagcaggccctgccccccgagcccaaggaggagaacgccgagcccgtgagcaagctgagaatcagaacccccagcggcgagttcctggagagaagattcctggccagcaacaagctgcagatcgtgttcgacttcgtggccagcaagggcttcccctgggacgagtacaagctgctgagcaccttccccagaagagacgtgacccagctggaccccaacaagagcctgctggaggtgaagctgttcccccaggagaccctgttcctggaggccaaggagtag

SEQ ID NO: 81277 - DNA, 1227 bp, Artificial Sequence
  Description of Artificial Sequence: Synthetic coding sequence
atgagaaacctgctggagatgtgcctggccgagagcggcctgagctacccctgccacagactgaccgtgggcagaagaagcagccccgcccagaccagagagcagagcgaggagcagatcaccgacgtgcacatggtgagcgacagcgacggcgacgacttcgaggacgccaccgagttcggcgtggacgacggcgaggtgttcggcatggccagcagcgccctgagaaagagccccatgatgcccgagaacgccgagaacgagggcgacgccctgctgcagttcaccgccgagttcagcagcagatacggcgactgccaccccgtgttcttcatcggcagcctggaggccgccttccaggaggccttctacgtgaaggccagagacagaaagctgctggccatctacctgcaccacgacgagagcgtgctgaccaacgtgttctgcagccagatgctgtgcgccgagagcatcgtgagctacctgagccagaacttcatcacctgggcctgggacctgaccaaggacagcaacagagccagattcctgaccatgtgcaacagacacttcggcagcgtggtggcccagaccatcagaacccagaagaccgaccagttccccctgttcctgatcatcatgggcaagagaagcagcaacgaggtgctgaacgtgatccagggcaacaccaccgtggacgagctgatgatgagactgatggccgccatggagatcttcaccgcccagcagcaggaggacatcaaggacgaggacgagagagaggccagagagaacgtgaagagagagcaggacgaggcctacagactgagcctggaggccgacagagccaagagagaggcccacgagagagagatggccgagcagttcagactggagcagatcagaaaggagcaggaggaggagagagaggccatcagactgagcctggagcaggccctgccccccgagcccaaggaggagaacgccgagcccgtgagcaagctgagaatcagaacccccagcggcgagttcctggagagaagattcctggccagcaacaagctgcagatcgtgttcgacttcgtggccagcaagggcttcccctgggacgagtacaagctgctgagcaccttccccagaagagacgtgacccagctggaccccaacaagagcctgctggaggtgaagctgttcccccaggagaccctgttcctggaggccaaggagtag

SEQ ID NO: 81278 - DNA, 951 bp, Artificial Sequence
  Description of Artificial Sequence: Synthetic coding sequence
atgacccagggcaagctgagcgtggccaacaaggcccccggcaccgagggccagcagcaggtgcacggcgagaagaaggaggcccccgccgtgcccagcgccccccccagctacgaggaggccaccagcggcgagggcatgaaggccggcgccttcccccccgcccccaccgccgtgcccctgcaccccagctgggcctacgtggaccccagcagcagcagcagctacgacaacggcttccccaccggcgaccacgagctgttcaccaccttcagctgggacgaccagaaggtgagaagagtgttcgtgagaaaggtgtacaccatcctgctgatccagctgctggtgaccctggccgtggtggccctgttcaccttctgcgaccccgtgaaggactacgtgcaggccaaccccggctggtactgggccagctacgccgtgttcttcgccacctacctgaccctggcctgctgcagcggccccagaagacacttcccctggaacctgatcctgctgaccgtgttcaccctgagcatggcctacctgaccggcatgctgagcagctactacaacaccaccagcgtgctgctgtgcctgggcatcaccgccctggtgtgcctgagcgtgaccgtgttcagcttccagaccaagttcgacttcaccagctgccagggcgtgctgttcgtgctgctgatgaccctgttcttcagcggcctgatcctggccatcctgctgcccttccagtacgtgccctggctgcacgccgtgtacgccgccctgggcgccggcgtgttcaccctgttcctggccctggacacccagctgctgatgggcaacagaagacacagcctgagccccgaggagtacatcttcggcgccctgaacatctacctggacatcatctacatcttcaccttcttcctgcagctgttcggcaccaacagagagtag

SEQ ID NO: 81279 - DNA, 951 bp, Artificial Sequence; identical to SEQ ID NO: 81278
  Description of Artificial Sequence: Synthetic coding sequence

SEQ ID NO: 81280 - DNA, 813 bp, Artificial Sequence
  Description of Artificial Sequence: Synthetic coding sequence
atgaaggccggcgccttcccccccgcccccaccgccgtgcccctgcaccccagctgggcctacgtggaccccagcagcagcagcagctacgacaacggcttccccaccggcgaccacgagctgttcaccaccttcagctgggacgaccagaaggtgagaagagtgttcgtgagaaaggtgtacaccatcctgctgatccagctgctggtgaccctggccgtggtggccctgttcaccttctgcgaccccgtgaaggactacgtgcaggccaaccccggctggtactgggccagctacgccgtgttcttcgccacctacctgaccctggcctgctgcagcggccccagaagacacttcccctggaacctgatcctgctgaccgtgttcaccctgagcatggcctacctgaccggcatgctgagcagctactacaacaccaccagcgtgctgctgtgcctgggcatcaccgccctggtgtgcctgagcgtgaccgtgttcagcttccagaccaagttcgacttcaccagctgccagggcgtgctgttcgtgctgctgatgaccctgttcttcagcggcctgatcctggccatcctgctgcccttccagtacgtgccctggctgcacgccgtgtacgccgccctgggcgccggcgtgttcaccctgttcctggccctggacacccagctgctgatgggcaacagaagacacagcctgagccccgaggagtacatcttcggcgccctgaacatctacctggacatcatctacatcttcaccttcttcctgcagctgttcggcaccaacagagagtag

SEQ ID NO: 81281 - DNA, 1173 bp, Artificial Sequence
  Description of Artificial Sequence: Synthetic coding sequence
atggacttctggctgtggcccctgtacttcctgcccgtgagcggcgccctgagaatcctgcccgaggtgaaggtggagggcgagctgggcggcagcgtgaccatcaagtgccccctgcccgagatgcacgtgagaatctacctgtgcagagagatggccggcagcggcacctgcggcaccgtggtgagcaccaccaacttcatcaaggccgagtacaagggcagagtgaccctgaagcagtaccccagaaagaacctgttcctggtggaggtgacccagctgaccgagagcgacagcggcgtgtacgcctgcggcgccggcatgaacaccgacagaggcaagacccagaaggtgaccctgaacgtgcacagcgagtacgagcccagctgggaggagcagcccatgcccgagacccccaagtggttccacctgccctacctgttccagatgcccgcctacgccagcagcagcaagttcgtgaccagagtgaccacccccgcccagagaggcaaggtgccccccgtgcaccacagcagccccaccacccagatcacccacagacccagagtgagcagagccagcagcgtggccggcgacaagcccagaaccttcctgcccagcaccaccgccagcaagatcagcgccctggagggcctgctgaagccccagacccccagctacaaccaccacaccagactgcacagacagagagccctggactacggcagccagagcggcagagagggccagggcttccacatcctgatccccaccatcctgggcctgttcctgctggccctgctgggcctggtggtgaagagagccgtggagagaagaaaggccctgagcagaagagccagaagactggccgtgagaatgagagccctggagagcagccagagacccagaggcagccccagacccagaagccagaacaacatctacagcgcctgccccagaagagccagaggcgccgacgccgccggcaccggcgaggcccccgtgcccggccccggcgcccccctgccccccgcccccctgcaggtgagcgagagcccctggctgcacgcccccagcctgaagaccagctgcgagtacgtgagcctgtaccaccagcccgccgccatgatggaggacagcgacagcgacgactacatcaacgtgcccgcctag

SEQ ID NO: 81282 - DNA, 921 bp, Artificial Sequence
  Description of Artificial Sequence: Synthetic coding sequence
atggacttctggctgtggcccctgtacttcctgcccgtgagcggcgccctgagaatcctgcccgaggtgaaggtggagggcgagctgggcggcagcgtgaccatcaagtgccccctgcccgagatgcacgtgagaatctacctgtgcagagagatggccggcagcggcacctgcggcaccgtggtgagcaccaccaacttcatcaaggccgagtacaagggcagagtgaccctgaagcagtaccccagaaagaacctgttcctggtggaggtgacccagctgaccgagagcgacagcggcgtgtacgcctgcggcgccggcatgaacaccgacagaggcaagacccagaaggtgaccctgaacgtgcacagcgagtacgagcccagctgggaggagcagcccatgcccgagacccccaagtggttccacctgccctacctgttccagatgcccgcctacgccagcagcagcaagttcgtgaccagagtgaccacccccgcccagagaggcaaggtgccccccgtgcaccacagcagccccaccacccagatcacccacagacccagagtgagcagagccagcagcgtggccggcgacaagcccagaaccttcctgcccagcaccaccgccagcaagatcagcgccctggagggcctgctgaagccccagacccccagctacaaccaccacaccagactgcacagacagagccccctgcaggccggcccccccaccggcagagaggacgccagacccggcgagctgcccgaggcccccagagtggccgccaccgccctgcccaagcagcacctgcagagactgcccgccgccagaagctggagcggcagatgcagacacagaggcggccccagaagcagacccagaagcgccgtggcccccagacccgccgccggcgtgtag

SEQ ID NO: 81283 - DNA, 837 bp, Artificial Sequence
  Description of Artificial Sequence: Synthetic coding sequence
atggacttctggctgtggcccctgtacttcctgcccgagtacgagcccagctgggaggagcagcccatgcccgagacccccaagtggttccacctgccctacctgttccagatgcccgcctacgccagcagcagcaagttcgtgaccagagtgaccacccccgcccagagaggcaaggtgccccccgtgcaccacagcagccccaccacccagatcacccacagacccagagtgagcagagccagcagcgtggccggcgacaagcccagaaccttcctgcccagcaccaccgccagcaagatcagcgccctggagggcctgctgaagccccagacccccagctacaaccaccacaccagactgcacagacagagagccctggactacggcagccagagcggcagagagggccagggcttccacatcctgatccccaccatcctgggcctgttcctgctggccctgctgggcctggtggtgaagagagccgtggagagaagaaaggccctgagcagaagagccagaagactggccgtgagaatgagagccctggagagcagccagagacccagaggcagccccagacccagaagccagaacaacatctacagcgcctgccccagaagagccagaggcgccgacgccgccggcaccggcgaggcccccgtgcccggccccggcgcccccctgccccccgcccccctgcaggtgagcgagagcccctggctgcacgcccccagcctgaagaccagctgcgagtacgtgagcctgtaccaccagcccgccgccatgatggaggacagcgacagcgacgactacatcaacgtgcccgcctag

SEQ ID NO: 81284 - DNA, 456 bp, Artificial Sequence
  Description of Artificial Sequence: Synthetic coding sequence
atggacttctggctgtggcccctgtacttcctgcccgtgagcggcgccctgagaatcctgcccgaggtgaaggtggagggcgagctgggcggcagcgtgaccatcaagtgccccctgcccgagatgcacgtgagaatctacctgtgcagagagatggccggcagcggcacctgcggcaccgtggtgagcaccaccaacttcatcaaggccgagtacaagggcagagtgaccctgaagcagtaccccagaaagaacctgttcctggtggaggtgacccagctgaccgagagcgacagcggcgtgtacgcctgcggcgccggcatgaacaccgacagaggcaagacccagaaggtgaccctgaacgtgcacagcgagtacgagcccagctgggaggagcagcccatgcccgagacccccaagtggttccacctgccctacctgttccagatgccctag

SEQ ID NO: 81285 - DNA, 444 bp, Artificial Sequence
  Description of Artificial Sequence: Synthetic coding sequence
atggacttctggctgtggcccctgtacttcctgcccgtgagcggcgccctgagaatcctgcccgaggtgaaggtggagggcgagctgggcggcagcgtgaccatcaagtgccccctgcccgagatgcacgtgagaatctacctgtgcagagagatggccggcagcggcacctgcggcaccgtggtgagcaccaccaacttcatcaaggccgagtacaagggcagagtgaccctgaagcagtaccccagaaagaacctgttcctggtggaggtgacccagctgaccgagagcgacagcggcgtgtacgcctgcggcgccggcatgaacaccgacagaggcaagacccagaaggtgaccctgaacgtgcacagcgagtacgagcccagctgggaggagcagcccatgcccgagacccccaagtggttccacctgccctacctgtag

SEQ ID NO: 81286 - DNA, 426 bp, Artificial Sequence
  Description of Artificial Sequence: Synthetic coding sequence
atggacttctggctgtggcccctgtacttcctgcccgagatggagagctgctgcgtggcccaggacggcctggagctggtggccctgagcgacccccccggcagcgccagccagagcgccggcatcaccgtgagcggcgccctgagaatcctgcccgaggtgaaggtggagggcgagctgggcggcagcgtgaccatcaagtgccccctgcccgagatgcacgtgagaatctacctgtgcagagagatggccggcagcggcacctgcggcaccgtggtgagcaccaccaacttcatcaaggccgagtacaagggcagagtgaccctgaagcagtaccccagaaagaacctgttcctggtggaggtgacccagctgaccgagagcgacagcggcgtgtacgcctgcggcgccggcatgaacacctag

SEQ ID NO: 81287 - DNA, 1398 bp, Artificial Sequence
  Description of Artificial Sequence: Synthetic coding sequence
atgagaagacccagaggcgagcccggccccagagcccccagacccaccgagggcgccacctgcgccggccccggcgagagctggagccccagccccaacagcatgctgagagtgctgctgagcgcccagaccagccccgccagactgagcggcctgctgctgatcccccccgtgcagccctgctgcctgggccccagcaagtggggcgacagacccgtgggcggcggccccagcgccggccccgtgcagggcctgcagagactgctggagcaggccaagagccccggcgagctgctgagatggctgggccagaaccccagcaaggtgagagcccaccactacagcgtggccctgagaagactgggccagctgctgggcagcagacccagacccccccccgtggagcaggtgaccctgcaggacctgagccagctgatcatcagaaactgccccagcttcgacatccacaccatccacgtgtgcctgcacctggccgtgctgctgggcttccccagcgacggccccctggtgtgcgccctggagcaggagagaagactgagactgccccccaagccccccccccccctgcagcccctgctgagaggcggccagggcctggaggccgccctgagctgccccagattcctgagataccccagacagcacctgatcagcagcctggccgaggccagacccgaggagctgaccccccacgtgatggtgctgctggcccagcacctggccagacacagactgagagagccccagctgctggaggccatcgcccacttcctggtggtgcaggagacccagctgagcagcaaggtggtgcagaagctggtgctgcccttcggcagactgaactacctgcccctggagcagcagttcatgccctgcctggagagaatcctggccagagaggccggcgtggcccccctggccaccgtgaacatcctgatgagcctgtgccagctgagatgcctgcccttcagagccctgcacttcgtgttcagccccggcttcatcaactacatcagcggcaccccccacgccctgatcgtgagaagatacctgagcctgctggacaccgccgtggagctggagctgcccggctacagaggccccagactgcccagaagacagcaggtgcccatcttcccccagcccctgatcaccgacagagccagatgcaagtacagccacaaggacatcgtggccgagggcctgagacagctgctgggcgaggagaagtacagacaggacctgaccgtgccccccggctactgcaccgacttcctgctgtgcgccagcagcagcggcgccgtgctgcccgtgagaacccaggaccccttcctgccctacccccccagagcctgccccagcagcagagccacctag

SEQ ID NO: 81288 - DNA, 1650 bp, Artificial Sequence
  Description of Artificial Sequence: Synthetic coding sequence
atgagaagacccagaggcgagcccggccccagagcccccagacccaccgagggcgccacctgcgccggccccggcgagagctggagccccagccccaacagcatgctgagagtgctgctgagcgcccagaccagccccgccagactgagcggcctgctgctgatcccccccgtgcagccctgctgcctgggccccagcaagtggggcgacagacccgtgggcggcggccccagcgccggccccgtgcagggcctgcagagactgctggagcaggccaagagccccggcgagctgctgagatggctgggccagaaccccagcaaggtgagagcccaccactacagcgtggccctgagaagactgggccagctgctgggcagcagacccagacccccccccgtggagcaggtgaccctgcaggacctgagccagctgatcatcagaaactgccccagcttcgacatccacaccatccacgtgtgcctgcacctggccgtgctgctgggcttccccagcgacggccccctggtgtgcgccctggagcaggagagaagactgagactgccccccaagccccccccccccctgcagcccctgctgagaggcggccagggcctggaggccgccctgagctgccccagattcctgagataccccagacagcacctgatcagcagcctggccgaggccagacccgaggagctgaccccccacgtgatggtgctgctggcccagcacctggccagacacagactgagagagccccagctgctggaggccatcgcccacttcctggtggtgcaggagacccagctgagcagcaaggtggtgcagaagctggtgctgcccttcggcagactgaactacctgcccctggagcagcagttcatgccctgcctggagagaatcctggccagagaggccggcgtggcccccctggccaccgtgaacatcctgatgagcctgtgccagctgagatgcctgcccttcagagccctgcacttcgtgttcagccccggcttcatcaactacatcagcggcaccccccacgccctgatcgtgagaagatacctgagcctgctggacaccgccgtggagctggagctgcccggctacagaggccccagactgcccagaagacagcaggtgcccatcttcccccagcccctgatcaccgacagagccagatgcaagtacagccacaaggacatcgtggccgagggcctgagacagctgctgggcgaggagaagtacagacaggacctgaccgtgccccccggctactgcaccgacttcctgctgtgcgccagcagcagcggcgccgtgctgcccgtgagaacccaggaccccttcctgccctacccccccagaagctgcccccagggccaggccgccagcagcgccaccaccagagaccccgcccagagagtggtgctggtgctgagagagagatggcacttctgcagagacggcagagtgctgctgggcagcagagccctgagagagagacacctgggcctgatgggctaccagctgctgcccctgcccttcgaggagctggagagccagagaggcctgccccagctgaagagctacctgagacagaagctgcaggccctgggcctgagatggggccccgagggcggctag

SEQ ID NO: 81289 - DNA, 1227 bp, Artificial Sequence
  Description of Artificial Sequence: Synthetic coding sequence
atgagaagacccagaggcgagcccggccccagagcccccagacccaccgagggcgccacctgcgccggccccggcgagagctgcttccccagcgacggccccctggtgtgcgccctggagcaggagagaagactgagactgccccccaagccccccccccccctgcagcccctgctgagaggcggccagggcctggaggccgccctgagctgccccagattcctgagataccccagacagcacctgatcagcagcctggccgaggccagacccgaggagctgaccccccacgtgatggtgctgctggcccagcacctggccagacacagactgagagagccccagctgctggaggccatcgcccacttcctggtggtgcaggagacccagctgagcagcaaggtggtgcagaagctggtgctgcccttcggcagactgaactacctgcccctggagcagcagttcatgccctgcctggagagaatcctggccagagaggccggcgtggcccccctggccaccgtgaacatcctgatgagcctgtgccagctgagatgcctgcccttcagagccctgcacttcgtgttcagccccggcttcatcaactacatcagcggcaccccccacgccctgatcgtgagaagatacctgagcctgctggacaccgccgtggagctggagctgcccggctacagaggccccagactgcccagaagacagcaggtgcccatcttcccccagcccctgatcaccgacagagccagatgcaagtacagccacaaggacatcgtggccgagggcctgagacagctgctgggcgaggagaagtacagacaggacctgaccgtgccccccggctactgcaccgacttcctgctgtgcgccagcagcagcggcgccgtgctgcccgtgagaacccaggaccccttcctgccctacccccccagaagctgcccccagggccaggccgccagcagcgccaccaccagagaccccgcccagagagtggtgctggtgctgagagagagatggcacttctgcagagacggcagagtgctgctgggcagcagagccctgagagagagacacctgggcctgatgggctaccagctgctgcccctgcccttcgaggagctggagagccagagaggcctgccccagctgaagagctacctgagacagaagctgcaggccctgggcctgagatggggccccgagggcggctag

SEQ ID NO: 81290 - DNA, 480 bp, Artificial Sequence
  Description of Artificial Sequence: Synthetic coding sequence
atgctgagagtgctgctgagcgcccagaccagccccgccagactgagcggcctgctgctgatcccccccgtgcagccctgctgcctgggccccagcaagtggggcgacagacccgtgggcggcggccccagcgccggccccgtgcagggcctgcagagactgctggagcaggccaagagccccggcgagctgctgagatggctgggccagaaccccagcaaggtgagagcccaccactacagcgtggccctgagaagactgggccagctgctgggcagcagacccagacccccccccgtggagcaggtgaccctgcaggacctgagccagctgatcatcagaaactgccccagcttcgacatccacaccatccacgtgtgcctgcacctggccgtgctgctgggcggcaccgaggtgggccccgccctgtgggccaccgagctgcccgcccccggcaccgccgtgtacgccctgccctag

SEQ ID NO: 81291 - DNA, 1569 bp, Artificial Sequence
  Description of Artificial Sequence: Synthetic coding sequence
atgagaagacccagaggcgagcccggccccagagcccccagacccaccgagggcgccacctgcgccggccccggcgagagctggagccccagccccaacagcatgctgagagtgctgctgagcgcccagaccagccccgccagactgagcggcctgctgctgatcccccccgtgcagccctgctgcctgggccccagcaagtggggcgacagacccgtgggcggcggccccagcgccggccccgtgcagggcctgcagagactgctggagcaggccaagagccccggcgagctgctgagatggctgggccagaaccccagcaaggtgagagcccaccactacagcgtggccctgagaagactgggccagctgctgggcagcagacccagacccccccccgtggagcaggtgaccctgcaggacctgagccagctgatcatcagaaactgccccagcttcgacatccacaccatccacgtgtgcctgcacctggccgtgctgctgggcttccccagcgacggccccctggtgtgcgccctggagcaggagagaagactgagactgccccccaagccccccccccccctgcagcccctgctgagagaggccagacccgaggagctgaccccccacgtgatggtgctgctggcccagcacctggccagacacagactgagagagccccagctgctggaggccatcgcccacttcctggtggtgcaggagacccagctgagcagcaaggtggtgcagaagctggtgctgcccttcggcagactgaactacctgcccctggagcagcagttcatgccctgcctggagagaatcctggccagagaggccggcgtggcccccctggccaccgtgaacatcctgatgagcctgtgccagctgagatgcctgcccttcagagccctgcacttcgtgttcagccccggcttcatcaactacatcagcggcaccccccacgccctgatcgtgagaagatacctgagcctgctggacaccgccgtggagctggagctgcccggctacagaggccccagactgcccagaagacagcaggtgcccatcttcccccagcccctgatcaccgacagagccagatgcaagtacagccacaaggacatcgtggccgagggcctgagacagctgctgggcgaggagaagtacagacaggacctgaccgtgccccccggctactgcaccgacttcctgctgtgcgccagcagcagcggcgccgtgctgcccgtgagaacccaggaccccttcctgccctacccccccagaagctgcccccagggccaggccgccagcagcgccaccaccagagaccccgcccagagagtggtgctggtgctgagagagagatggcacttctgcagagacggcagagtgctgctgggcagcagagccctgagagagagacacctgggcctgatgggctaccagctgctgcccctgcccttcgaggagctggagagccagagaggcctgccccagctgaagagctacctgagacagaagctgcaggccctgggcctgagatggggccccgagggcggctag

SEQ ID NO: 81292 - DNA, 1179 bp, Artificial Sequence
  Description of Artificial Sequence: Synthetic coding sequence
atggaggcccccctggtgagcctggacgaggagttcgaggacctgagacccagctgcagcgaggaccccgaggagaagccccagtgcttctacggcagcagcccccaccacctggaggaccccagcctgagcgagctggagaacttcagcagcgagatcatcagcttcaagagcatggaggacctggtgaacgagttcgacgagaagctgaacgtgtgcttcagaaactacaacgccaagaccgagaacctggcccccgtgaagaaccagctgcagatccaggaggaggaggagaccctgcaggacgaggaggtgtgggacgccctgaccgacaactacatccccagcctgagcgaggactggagagaccccaacatcgaggccctgaacggcaactgcagcgacaccgagatccacgagaaggaggaggaggagttcaacgagaagagcgagaacgacagcggcatcaacgaggagcccctgctgaccgccgaccaggtgatcgaggagatcgaggagatgatgcagaacagccccgaccccgaggaggaggaggaggtgctggaggaggaggacggcggcgagaccagcagccaggccgacagcgtgctgctgcaggagatgcaggccctgacccagaccttcaacaacaactggagctacgagggcctgagacacatgagcggcagcgagctgaccgagctgctggaccaggtggagggcgccatcagagacttcagcgaggagctggtgcagcagctggccagaagagacgagctggagttcgagaaggaggtgaagaacagcttcatcaccgtgctgatcgaggtgcagaacaagcagaaggagcagagagagctgatgaagaagagaagaaaggagaagggcctgagcctgcagagcagcagaatcgagaagggcaaccagatgcccctgaagagattcagcatggagggcatcagcaacatcctgcagagcggcatcagacagaccttcggcagcagcggcaccgacaagcagtacctgaacaccgtgatcccctacgagaagaaggccagcccccccagcgtggaggacctgcagatgctgaccaacatcctgttcgccatgaaggaggacaacgagaaggtgcccaccctgctgaccgactacatcctgaaggtgctgtgccccacctag

SEQ ID NO: 81293 - DNA, 315 bp, Artificial Sequence
  Description of Artificial Sequence: Synthetic coding sequence
atggaggcccccctggtgagcctggacgaggagttcgaggacctgagacccagctgcagcgaggaccccgaggagaagccccagtgcttctacggcagcagcccccaccacctggaggaccccagcctgagcgagctggagaacttcagcagcgagatcatcagcttcaagagcatggaggacctggtgaacgagttcgacgagaagctgaacgtgtgcttcagaaactacaacgccaagaccgagaacctggcccccgtgaagaaccagctgcagatccaggaggaggaggagaccctgcaggacgaggagtag

SEQ ID NO: 81294 - DNA, 315 bp, Artificial Sequence; identical to SEQ ID NO: 81293
  Description of Artificial Sequence: Synthetic coding sequence

SEQ ID NO: 81295 - DNA, 1419 bp, Artificial Sequence
  Description of Artificial Sequence: Synthetic coding sequence
atgaccgccaacggcaccgccgaggccgtgcagatccagttcggcctgatcaactgcggcaacaagtacctgaccgccgaggccttcggcttcaaggtgaacgccagcgccagcagcctgaagaagaaccacctgggcagatacctggccgccgacaaggacggcaacgtgacctgcgagagagaggtgcccggccccgactgcagattcctgatcgtggcccacgacgacggcagatggagcctgcagagcgaggcccacagaagatacttcggcggcaccgaggacagactgagctgcttcgcccagaccgtgagccccgccgagaagtggagcgtgcacatcgccatgcacccccaggtgaacatctacagcgtgaccagaaagagatacgcccacctgagcgccagacccgccgacgagatcgccgtggacagagacgtgccctggggcgtggacagcctgatcaccctggccttccaggaccagagatacagcgtgcagaccgccgaccacagattcctgagacacgacggcagactggtggccagacccgagcccgccaccggctacaccctggagttcagaagcggcaaggtggccttcagagactgcgagggcagatacctggcccccagcggccccagcggcaccctgaaggccggcaaggccaccaaggtgggcaaggacgagctgttcgccctggagcagagctgcgcccaggtggtgctgcaggccgccaacgagagaaacgtgagcaccagacagggcatggacctgagcgccaaccaggacgaggagaccgaccaggagaccttccagctggagatcgacagagacaccaagaagtgcgccttcagaacccacaccggcaagtactggaccctgaccgccaccggcggcgtgcagagcaccgccagcagcaagaacgccagctgctacttcgacatcgagtggagagacagaagaatcaccctgagagccagcaacggcaagttcgtgaccagcaagaagaacggccagctggccgccagcgtggagaccgccggcgacagcgagctgttcctgatgaagctgatcaacagacccatcatcgtgttcagaggcgagcacggcttcatcggctgcagaaaggtgaccggcaccctggacgccaacagaagcagctacgacgtgttccagctggagttcaacgacggcgcctacaacatcaaggacagcaccggcaagtactggaccgtgggcagcgacagcgccgtgaccagcagcggcgacacccccgtggacttcttcttcgagttctgcgactacaacaaggtggccatcaaggtgggcggcagatacctgaagggcgaccacgccggcgtgctgaaggccagcgccgagaccgtggaccccgccagcctgtgggagtactag

SEQ ID NO: 81296 - DNA, 1482 bp, Artificial Sequence
  Description of Artificial Sequence: Synthetic coding sequence
atgaccgccaacggcaccgccgaggccgtgcagatccagttcggcctgatcaactgcggcaacaagtacctgaccgccgaggccttcggcttcaaggtgaacgccagcgccagcagcctgaagaagaagcagatctggaccctggagcagccccccgacgaggccggcagcgccgccgtgtgcctgagaagccacctgggcagatacctggccgccgacaaggacggcaacgtgacctgcgagagagaggtgcccggccccgactgcagattcctgatcgtggcccacgacgacggcagatggagcctgcagagcgaggcccacagaagatacttcggcggcaccgaggacagactgagctgcttcgcccagaccgtgagccccgccgagaagtggagcgtgcacatcgccatgcacccccaggtgaacatctacagcgtgaccagaaagagatacgcccacctgagcgccagacccgccgacgagatcgccgtggacagagacgtgccctggggcgtggacagcctgatcaccctggccttccaggaccagagatacagcgtgcagaccgccgaccacagattcctgagacacgacggcagactggtggccagacccgagcccgccaccggctacaccctggagttcagaagcggcaaggtggccttcagagactgcgagggcagatacctggcccccagcggccccagcggcaccctgaaggccggcaaggccaccaaggtgggcaaggacgagctgttcgccctggagcagagctgcgcccaggtggtgctgcaggccgccaacgagagaaacgtgagcaccagacagggcatggacctgagcgccaaccaggacgaggagaccgaccaggagaccttccagctggagatcgacagagacaccaagaagtgcgccttcagaacccacaccggcaagtactggaccctgaccgccaccggcggcgtgcagagcaccgccagcagcaagaacgccagctgctacttcgacatcgagtggagagacagaagaatcaccctgagagccagcaacggcaagttcgtgaccagcaagaagaacggccagctggccgccagcgtggagaccgccggcgacagcgagctgttcctgatgaagctgatcaacagacccatcatcgtgttcagaggcgagcacggcttcatcggctgcagaaaggtgaccggcaccctggacgccaacagaagcagctacgacgtgttccagctggagttcaacgacggcgcctacaacatcaaggacagcaccggcaagtactggaccgtgggcagcgacagcgccgtgaccagcagcggcgacacccccgtggacttcttcttcgagttctgcgactacaacaaggtggccatcaaggtgggcggcagatacctgaagggcgaccacgccggcgtgctgaaggccagcgccgagaccgtggaccccgccagcctgtgggagtactag

SEQ ID NO: 81297 - DNA, 648 bp, Artificial Sequence
  Description of Artificial Sequence: Synthetic coding sequence
atggacctgagcgccaaccaggacgaggagaccgaccaggagaccttccagctggagatcgacagagacaccaagaagtgcgccttcagaacccacaccggcaagtactggaccctgaccgccaccggcggcgtgcagagcaccgccagcagcaagaacgccagctgctacttcgacatcgagtggagagacagaagaatcaccctgagagccagcaacggcaagttcgtgaccagcaagaagaacggccagctggccgccagcgtggagaccgccggcgacagcgagctgttcctgatgaagctgatcaacagacccatcatcgtgttcagaggcgagcacggcttcatcggctgcagaaaggtgaccggcaccctggacgccaacagaagcagctacgacgtgttccagctggagttcaacgacggcgcctacaacatcaaggacagcaccggcaagtactggaccgtgggcagcgacagcgccgtgaccagcagcggcgacacccccgtggacttcttcttcgagttctgcgactacaacaaggtggccatcaaggtgggcggcagatacctgaagggcgaccacgccggcgtgctgaaggccagcgccgagaccgtggaccccgccagcctgtgggagtactag

SEQ ID NO: 81298 - DNA, 1551 bp, Artificial Sequence
  Description of Artificial Sequence: Synthetic coding sequence
atgcccaccaacggcctgcaccaggtgctgaagatccagttcggcctggtgaacgacaccgacagatacctgaccgccgagagcttcggcttcaaggtgaacgccagcgcccccagcctgaagagaaagcagacctgggtgctggagcccgaccccggccagggcaccgccgtgctgctgagaagcagccacctgggcagatacctgagcgccgaggaggacggcagagtggcctgcgaggccgagcagcccggcagagactgcagattcctggtgctgccccagcccgacggcagatgggtgctgagaagcgagccccacggcagattcttcggcggcaccgaggaccagctgagctgcttcgccaccgccgtgagccccgccgagctgtggaccgtgcacctggccatccacccccaggcccacctgctgagcgtgagcagaagaagatacgtgcacctgtgccccagagaggacgagatggccgccgacggcgacaagccctggggcgtggacgccctgctgaccctgatcttcagaagcagaagatactgcctgaagagctgcgacagcagatacctgagaagcgacggcagactggtgtgggagcccgagcccagagcctgctacaccctggagttcaaggccggcaagctggccttcaaggactgcgacggccactacctggcccccgtgggccccgccggcaccctgaaggccggcagaaacaccagacccggcaaggacgagctgttcgacctggaggagagccacccccaggtggtgctggtggccgccaaccacagatacgtgagcgtgagacagggcgtgaacgtgagcgccaaccaggacgacgagctggaccacgagaccttcctgatgcagatcgaccaggagaccaagaagtgcaccttctacagcagcaccggcggctactggaccctggtgacccacggcggcatccacgccaccgccacccaggtgagcgccaacaccatgttcgagatggagtggagaggcagaagagtggccctgaaggccagcaacggcagatacgtgtgcatgaagaagaacggccagctggccgccatcagcgacttcgtgggccccccccccagacccgcctggaccggcaaggtggccggcggcgccgcccagcagaccctgagcccccccggcaaggacgaggagttcaccctgaagctgatcaacagacccatcctggtgctgagaggcctggacggcttcgtgtgccaccacagaggcagcaaccagctggacaccaacagaagcgtgtacgacgtgttccacctgagcttcagcgacggcgcctacagaatcagaggcagagacggcggcttctggtacaccggcagccacggcagcgtgtgcagcgacggcgagagagccgaggacttcgtgttcgagttcagagagagaggcagactggccatcagagccagaagcggcaagtacctgagaggcggcgccagcggcctgctgagagccgacgccgacgcccccgccggcaccgccctgtgggagtactag

SEQ ID NO: 81299 - DNA, 1479 bp, Artificial Sequence
  Description of Artificial Sequence: Synthetic coding sequence
atgcccaccaacggcctgcaccaggtgctgaagatccagttcggcctggtgaacgacaccgacagatacctgaccgccgagagcttcggcttcaaggtgaacgccagcgcccccagcctgaagagaaagcagacctgggtgctggagcccgaccccggccagggcaccgccgtgctgctgagaagcagccacctgggcagatacctgagcgccgaggaggacggcagagtggcctgcgaggccgagcagcccggcagagactgcagattcctggtgctgccccagcccgacggcagatgggtgctgagaagcgagccccacggcagattcttcggcggcaccgaggaccagctgagctgcttcgccaccgccgtgagccccgccgagctgtggaccgtgcacctggccatccacccccaggcccacctgctgagcgtgagcagaagaagatacgtgcacctgtgccccagagaggacgagatggccgccgacggcgacaagccctggggcgtggacgccctgctgaccctgatcttcagaagcagaagatactgcctgaagagctgcgacagcagatacctgagaagcgacggcagactggtgtgggagcccgagcccagagcctgctacaccctggagttcaaggccggcaagctggccttcaaggactgcgacggccactacctggcccccgtgggccccgccggcaccctgaaggccggcagaaacaccagacccggcaaggacgagctgttcgacctggaggagagccacccccaggtggtgctggtggccgccaaccacagatacgtgagcgtgagacagggcgtgaacgtgagcgccaaccaggacgacgagctggaccacgagaccttcctgatgcagatcgaccaggagaccaagaagtgcaccttctacagcagcaccggcggctactggaccctggtgacccacggcggcatccacgccaccgccacccaggtgagcgccaacaccatgttcgagatggagtggagaggcagaagagtggccctgaaggccagcaacggcagatacgtgtgcatgaagaagaacggccagctggccgccatcagcgacttcgtgggcaaggacgaggagttcaccctgaagctgatcaacagacccatcctggtgctgagaggcctggacggcttcgtgtgccaccacagaggcagcaaccagctggacaccaacagaagcgtgtacgacgtgttccacctgagcttcagcgacggcgcctacagaatcagaggcagagacggcggcttctggtacaccggcagccacggcagcgtgtgcagcgacggcgagagagccgaggacttcgtgttcgagttcagagagagaggcagactggccatcagagccagaagcggcaagtacctgagaggcggcgccagcggcctgctgagagccgacgccgacgcccccgccggcaccgccctgtgggagtactag

SEQ ID NO: 81300 - DNA, 2133 bp, Artificial Sequence
  Description of Artificial Sequence: Synthetic coding sequence
atgctgaccaccctgaagcccttcggcagcgtgagcgtggagagcaagatgaacaacaaggccggcagcttcttctggaacctgagacagttcagcaccctggtgagcaccagcagaaccatgagactgtgctgcctgggcctgtgcaagcccaagatcgtgcacagcaactggaacatcctgaacaacttccacaacagaatgcagagcaccgacatcatcagatacctgttccaggacgccttcatcttcaagagcgacgtgggcttccagaccaagggcatcagcaccctgaccgccctgagaatcgagagactgctgtacgccaagagactgttcttcgacagcaagcagagcctggtgcccgtggacaagagcgacgacgagctgaagaaggtgaacctgaaccacgaggtgagcaacgaggacgtgctgaccaaggagaccaagcccaacagaatcagcagcagaaagctgagcgaggagtgcaacagcctgagcgacgtgctggacgccttcagcaaggcccccaccttccccagcagcaactacttcaccgccatgtggaccatcgccaagagactgagcgacgaccagaagagattcgagaagagactgatgttcagccaccccgccttcaaccagctgtgcgagcacatgatgagagaggccaagatcatgcagtacaagtacctgctgttcagcctgcacgccatcgtgaagctgggcatcccccagaacaccatcctggtgcagaccctgctgagagtgacccaggagagaatcaacgagtgcgacgagatctgcctgagcgtgctgagcaccgtgctggaggccatggagccctgcaagaacgtgcacgtgctgagaaccggcttcagaatcctggtggaccagcaggtgtggaagatcgaggacgtgttcaccctgcaggtggtgatgaagtgcatcggcaaggacgcccccatcgccctgaagagaaagctggagatgaaggccctgagagagctggacagattcagcgtgctgaacagccagcacatgttcgaggtgctggccgccatgaaccacagaagcctgatcctgctggacgagtgcagcaaggtggtgctggacaacatccacggctgccccctgagaatcatgatcaacatcctgcagagctgcaaggacctgcagtaccacaacctggacctgttcaagggcctggccgactacgtggccgccaccttcgacatctggaagttcagaaaggtgctgttcatcctgatcctgttcgagaacctgggcttcagacccgtgggcctgatggacctgttcatgaagagaatcgtggaggaccccgagagcctgaacatgaagaacatcctgagcatcctgcacacctacagcagcctgaaccacgtgtacaagtgccagaacaaggagcagttcgtggaggtgatggccagcgccctgaccggctacctgcacaccatcagcagcgagaacctgctggacgccgtgtacagcttctgcctgatgaactacttccccctggcccccttcaaccagctgctgcagaaggacatcatcagcgagctgctgaccagcgacgacatgaagaacgcctacaagctgcacaccctggacacctgcctgaagctggacgacaccgtgtacctgagagacatcgccctgagcctgccccagctgcccagagagctgcccagcagccacaccaacgccaaggtggccgaggtgctgagcagcctgctgggcggcgagggccacttcagcaaggacgtgcacctgccccacaactaccacatcgacttcgagatcagaatggacaccaacagaaaccaggtgctgcccctgagcgacgtggacaccaccagcgccaccgacatccagagagtggccgtgctgtgcgtgagcagaagcgcctactgcctgggcagcagccaccccagaggcttcctggccatgaagatgagacacctgaacgccatgggcttccacgtgatcctggtgaacaactgggagatggacaagctggagatggaggacgccgtgaccttcctgaagaccaagatctacagcgtggaggccctgcccgtggccgccgtgaacgtgcagagcacccagtag

SEQ ID NO: 81301 - DNA, 2133 bp, Artificial Sequence; identical to SEQ ID NO: 81300
  Description of Artificial Sequence: Synthetic coding sequence

SEQ ID NO: 81302 - DNA, 2133 bp, Artificial Sequence; identical to SEQ ID NO: 81300
  Description of Artificial Sequence: Synthetic coding sequence

SEQ ID NO: 81303 - DNA, 375 bp, Artificial Sequence
  Description of Artificial Sequence: Synthetic coding sequence
atgctgaccaccctgaagcccttcggcagcgtgagcgtggagagcaagatgaacaacaaggccggcagcttcttctggaacctgagacagttcagcaccctggtgagcaccagcagaaccatgagactgtgctgcctgggcctgtgcaagcccaagatcgtgcacagcaactggaacatcctgaacaacttccacaacagaatgcagagcaccgacatcatcagatacctgttccaggacgccttcatcttcaagagcgacgtgggcttccagaccaagggcatcagcaccctgaccgccctgagaatcgagagactgctgtacgccaagagactgttcttcgacagcaagcagagcctggtgcccgtggactag

SEQ ID NO: 81304 - DNA, 2295 bp, Artificial Sequence
  Description of Artificial Sequence: Synthetic coding sequence
atggccgccaccctgaagagcctgaagctggtgagatacagagccttctgcagccccagcgccttcggcgccgtgagaagcgtgagctactggaacgtgagcagcacccagcacggcggccaggacccccccgagcacatcagcctgtgccacagcgccaagaaggtgaagaacatctgcagcaccttcagcagcagaagaatcctgaccaccagcagcgcccaccccggcctggagttcagcaagaccagcagcagcaaggccagcaccctgcagctgggcagccccagagccaccggcgtggacgaggaggacgtggaggtgttcgacagcttcgagaacatgagagtgttcctgcagctgagacccgagtacagagtgcacagctacaacgccagcgagaccagccagctgctgagcgtgagcgagggcgagctgatcctgcacaaggtgagagtgaaccagaacaacctgcaggcccaggtgatcgtggactacctgtgcaagctgagcagcctgcccgccgagcagcaccccgtgctgctgggcagcaccagcttcgccctgctgtgccagctgagcgtgaagaagatccagctgttcgacacccaggacctgatcaacgtgctgaaggccttcgtgatcctgggcatcccccacagccacagcatgctggacgtgtacgagaccaagtgctgccaccaggtgtgggagatgaacatggaccagctgctgctggtggccgacctgtggagatacctgggcagaaaggtgcccagattcctgaacatcttcagcagctacctgaacctgcactggaaggacctgagcctgagccagctggtgcacctgatctacgtgatcggcgagaacagacaggtgagccaggacctgatgcagaagctggagagcctgatcctgaagtacatcgacctgatcaacctggaggaggtgggcaccatctgcctgggcttcttcaagagcagcaccaacctgagcgagttcgtgatgagaaagatcggcgacctggcctgcgccaacatccagcacctgagcagcagaagcctggtgaacatcgtgaagatgttcagattcacccacgtggaccacatcaacttcatgaagcagatcggcgagatcgccccccagagaatccccagcctgggcgtgcagggcgtgatgcacctgaccctgtactgcagcgccctgagattcctgaacgagggcgtgatgaacgccgtggccgccagcctgccccccagagtggcccactgcagaagcaaggacgtggccaagatcctgtggagcttcggcaccctgaactacaagccccccaacgccgaggagttctacagcagcctgatcagcgagatccacagaaagatgcccgagttcaaccagtaccccgagcacctgcccacctgcctgctgggcctggccttcctggagtacttccccgtggagctgatcgacttcgccctgagccccggcttcgtgagactggcccaggagagaaccaagttcgacctgctgaaggagctgtacaccctggacggcaccgtgggcatcgagtgccccgactacagaggcaacagactgagcacccacctgcagcaggagggcagcgagctgctgtggtacctggccgagaaggacatgaacagcaagcccgagttcctggagaccgtgttcctgctggagaccatgctgggcggcccccagtacgtgaagcaccacatgatcctgccccacaccagaagcagcgacctggaggtgcagctggacgtgaacctgaagcccctgcccttcaacagagaggccacccccgccgagaacgtggccaagctgagactggagcacgtgggcgtgagcctgaccgacgacctgatgaacaagctgctgaagggcaaggccagaggccacttccagggcaagaccgagagcgagcccggccagcagcccatggagctggagaacaaggccgccgtgcccctgggcggcttcctgtgcaacgtggccgacaagagcggcgccatggagatggccggcctgtgccccgccgcctgcatgcagacccccagaatgaagctggccgtgcagttcaccaacagaaaccagtactgctacggcagcagagacctgctgggcctgcacaacatgaagagaagacagctggccagactgggctacagagtggtggagctgagctactgggagtggctgcccctgctgaagagaaccagactggagaagctggccttcctgcacgagaaggtgttcaccagcgccctgtag

SEQ ID NO: 81305 - DNA, 183 bp, Artificial Sequence
  Description of Artificial Sequence: Synthetic coding sequence
atggcctgccagggcagagaggagtgctggtgccagagcagaatcgccagaaccctgcccgccgaccagaagcccgagtgcagaccctactgggagaaggacgacgccagcatgcccctgcccttcgacctgaccgacatcgtgagcgagctgagaggccagctgctggaggccaagccctag

SEQ ID NO: 81306 - DNA, 630 bp, Artificial Sequence
  Description of Artificial Sequence: Synthetic coding sequence
atgctggacgacctgaacgccacccaccagcactgcgtgctggccggcagccagcccagattcagcagcacccacagagtggccgagtgcagcaccggcaccctggactacatcctgcagagatgccagctggccctgcagaacgtgtgcgacgacgtggacaacgacgacgtgagcctgaagagcttcgagcccgccgtgctgaagcagggcgaggagatccacaacgaggtggagttcgagtggctgagacagttctggttccagggcaacagatacagaaagtgcaccgactggtggtgccagcccatggcccagctggaggccctgtggaagaagatggagggcgtgaccaacgccgtgctgcacgaggtgaagagagagggcctgcccgtggagcagagaaacgagatcctgaccgccatcctggccagcctgaccgccagacagaacctgagaagagagtggcacgccagatgccagagcagaatcgccagaaccctgcccgccgaccagaagcccgagtgcagaccctactgggagaaggacgacgccagcatgcccctgcccttcgacctgaccgacatcgtgagcgagctgagaggccagctgctggaggccaagccctag

SEQ ID NO: 81307 - DNA, 321 bp, Artificial Sequence
  Description of Artificial Sequence: Synthetic coding sequence
atggcccagctggaggccctgtggaagaagatggagggcgtgaccaacgccgtgctgcacgaggtgaagagagagggcctgcccgtggagcagagaaacgagatcctgaccgccatcctggccagcctgaccgccagacagaacctgagaagagagtggcacgccagatgccagagcagaatcgccagaaccctgcccgccgaccagaagcccgagtgcagaccctactgggagaaggacgacgccagcatgcccctgcccttcgacctgaccgacatcgtgagcgagctgagaggccagctgctggaggccaagccctag

SEQ ID NO: 81308 - DNA, 321 bp, Artificial Sequence; identical to SEQ ID NO: 81307
  Description of Artificial Sequence: Synthetic coding sequence

SEQ ID NO: 81309 - DNA, 384 bp, Artificial Sequence
  Description of Artificial Sequence: Synthetic coding sequence
atggagtggagaaaggtgagcgagtgcaacagcgtggagccctgcagagaggtgaagaagtggccctacagatgcatccaccacggcaagaacttcagcagaatgaccaacgccgtgctgcacgaggtgaagagagagggcctgcccgtggagcagagaaacgagatcctgaccgccatcctggccagcctgaccgccagacagaacctgagaagagagtggcacgccagatgccagagcagaatcgccagaaccctgcccgccgaccagaagcccgagtgcagaccctactgggagaaggacgacgccagcatgcccctgcccttcgacctgaccgacatcgtgagcgagctgagaggccagctgctggaggccaagccctag

SEQ ID NO: 81310 - DNA, 1518 bp, Artificial Sequence
  Description of Artificial Sequence: Synthetic coding sequence
atgaagagaacccccaccgccgaggagagagagagagaggccaagaagctgagactgctggaggagctggaggacacctggctgccctacctgacccccaaggacgacgagttctaccagcagtggcagctgaagtaccccaagctgatcctgagagaggccagcagcgtgagcgaggagctgcacaaggaggtgcaggaggccttcctgaccctgcacaagcacggctgcctgttcagagacctggtgagaatccagggcaaggacctgctgacccccgtgagcagaatcctgatcggcaaccccggctgcacctacaagtacctgaacaccagactgttcaccgtgccctggcccgtgaagggcagcaacatcaagcacaccgaggccgagatcgccgccgcctgcgagaccttcctgaagctgaacgactacctgcagatcgagaccatccaggccctggaggagctggccgccaaggagaaggccaacgaggacgccgtgcccctgtgcatgagcgccgacttccccagagtgggcatgggcagcagctacaacggccaggacgaggtggacatcaagagcagagccgcctacaacgtgaccctgctgaacttcatggacccccagaagatgccctacctgaaggaggagccctacttcggcatgggcaagatggccgtgagctggcaccacgacgagaacctggtggacagaagcgccgtggccgtgtacagctacagctgcgagggccccgaggaggagagcgaggacgacagccacctggagggcagagaccccgacatctggcacgtgggcttcaagatcagctgggacatcgagacccccggcctggccatccccctgcaccagggcgactgctacttcatgctggacgacctgaacgccacccaccagcactgcgtgctggccggcagccagcccagattcagcagcacccacagagtggccgagtgcagcaccggcaccctggactacatcctgcagagatgccagctggccctgcagaacgtgtgcgacgacgtggacaacgacgacgtgagcctgaagagcttcgagcccgccgtgctgaagcagggcgaggagatccacaacgaggtggagttcgagtggctgagacagttctggttccagggcaacagatacagaaagtgcaccgactggtggtgccagcccatggcccagctggaggccctgtggaagaagatggagggcgtgaccaacgccgtgctgcacgaggtgaagagagagggcctgcccgtggagcagagaaacgagatcctgaccgccatcctggccagcctgaccgccagacagaacctgagaagagagtggcacgccagatgccagagcagaatcgccagaaccctgcccgccgaccagaagcccgagtgcagaccctactgggagaaggacgacgccagcatgcccctgcccttcgacctgaccgacatcgtgagcgagctgagaggccagctgctggaggccaagccctag

SEQ ID NO: 81311 - DNA, 321 bp, Artificial Sequence; identical to SEQ ID NO: 81307
  Description of Artificial Sequence: Synthetic coding sequence

SEQ ID NO: 81312 - DNA, 13050 bp, Artificial Sequence
  Description of Artificial Sequence: Synthetic coding sequence
atgaccatcgccctgctgggcttcgccatcttcctgctgcactgcgccacctgcgagaagcccctggagggcatcctgagcagcagcgcctggcacttcacccacagccactacaacgccaccatctacgagaacagcagccccaagacctacgtggagagcttcgagaagatgggcatctacctggccgagccccagtgggccgtgagatacagaatcatcagcggcgacgtggccaacgtgttcaagaccgaggagtacgtggtgggcaacttctgcttcctgagaatcagaaccaagagcagcaacaccgccctgctgaacagagaggtgagagacagctacaccctgatcatccaggccaccgagaagaccctggagctggaggccctgaccagagtggtggtgcacatcctggaccagaacgacctgaagcccctgttcagcccccccagctacagagtgaccatcagcgaggacatgcccctgaagagccccatctgcaaggtgaccgccaccgacgccgacctgggccagaacgccgagttctactacgccttcaacaccagaagcgagatgttcgccatccaccccaccagcggcgtggtgaccgtggccggcaagctgaacgtgacctggagaggcaagcacgagctgcaggtgctggccgtggacagaatgagaaagatcagcgagggcaacggcttcggcagcctggccgccctggtggtgcacgtggagcccgccctgagaaagccccccgccatcgccagcgtggtggtgaccccccccgacagcaacgacggcaccacctacgccaccgtgctggtggacgccaacagcagcggcgccgaggtggagagcgtggaggtggtgggcggcgaccccggcaagcacttcaaggccatcaagagctacgccagaagcaacgagttcagcctggtgagcgtgaaggacatcaactggatggagtacctgcacggcttcaacctgagcctgcaggccagaagcggcagcggcccctacttctacagccagatcagaggcttccacctgccccccagcaagctgagcagcctgaagttcgagaaggccgtgtacagagtgcagctgagcgagttcagcccccccggcagcagagtggtgatggtgagagtgacccccgccttccccaacctgcagtacgtgctgaagcccagcagcgagaacgtgggcttcaagctgaacgccagaaccggcctgatcaccaccaccaagctgatggacttccacgacagagcccactaccagctgcacatcagaaccagccccggccaggccagcaccgtggtggtgatcgacatcgtggactgcaacaaccacgcccccctgttcaacagaagcagctacgacggcaccctggacgagaacatcccccccggcaccagcgtgctggccgtgaccgccaccgacagagaccacggcgagaacggctacgtgacctacagcatcgccggccccaaggccctgcccttcagcatcgacccctacctgggcatcatcagcaccagcaagcccatggactacgagctgatgaagagaatctacaccttcagagtgagagccagcgactggggcagccccttcagaagagagaaggaggtgagcatcttcctgcagctgagaaacctgaacgacaaccagcccatgttcgaggaggtgaactgcaccggcagcatcagacaggactggcccgtgggcaagagcatcatgaccatgagcgccatcgacgtggacgagctgcagaacctgaagtacgagatcgtgagcggcaacgagctggagtacttcgacctgaaccacttcagcggcgtgatcagcctgaagagacccttcatcaacctgaccgccggccagcccaccagctacagcctgaagatcaccgccagcgacggcaagaactacgccagccccaccaccctgaacatcaccgtggtgaaggacccccacttcgaggtgcccgtgacctgcgacaagaccggcgtgctgacccagttcaccaagaccatcctgcacttcatcggcctgcagaaccaggagagcagcgacgaggagttcaccagcctgagcacctaccagatcaaccactacaccccccagttcgaggaccacttcccccagagcatcgacgtgctggagagcgtgcccatcaacacccccctggccagactggccgccaccgaccccgacgccggcttcaacggcaagctggtgtacgtgatcgccgacggcaacgaggagggctgcttcgacatcgagctggagaccggcctgctgaccgtggccgcccccctggactacgaggccaccaacttctacatcctgaacgtgaccgtgtacgacctgggcaccccccagaagagcagctggaagctgctgaccgtgaacgtgaaggactggaacgacaacgcccccagattcccccccggcggctaccagctgaccatcagcgaggacaccgaggtgggcaccaccatcgccgagctgaccaccaaggacgccgacagcgaggacaacggcagagtgagatacaccctgctgagccccaccgagaagttcagcctgcaccccctgaccggcgagctggtggtgaccggccacctggacagagagagcgagcccagatacatcctgaaggtggaggccagagaccagcccagcaagggccaccagctgttcagcgtgaccgacctgatcatcaccctggaggacgtgaacgacaacagcccccagtgcatcaccgagcacaacagactgaaggtgcccgaggacctgccccccggcaccgtgctgaccttcctggacgccagcgaccccgacctgggccccgccggcgaggtgagatacgtgctgatggacggcgcccacggcaccttcagagtggacctgatgaccggcgccctgatcctggagagagagctggacttcgagagaagagccggctacaacctgagcctgtgggccagcgacggcggcagacccctggccagaagaaccctgtgccacgtggaggtgatcgtgctggacgtgaacgagaacctgcaccccccccacttcgccagcttcgtgcaccagggccaggtgcaggagaacagccccagcggcacccaggtgatcgtggtggccgcccaggacgacgacagcggcctggacggcgagctgcagtacttcctgagagccggcaccggcctggccgccttcagcatcaaccaggacaccggcatgatccagaccctggcccccctggacagagagttcgccagctactactggctgaccgtgctggccgtggacagaggcagcgtgcccctgagcagcgtgaccgaggtgtacatcgaggtgaccgacgccaacgacaaccccccccagatgagccaggccgtgttctaccccagcatccaggaggacgcccccgtgggcaccagcgtgctgcagctggacgcctgggaccccgacagcagcagcaagggcaagctgaccttcaacatcaccagcggcaactacatgggcttcttcatgatccaccccgtgaccggcctgctgagcaccgcccagcagctggacagagagaacaaggacgagcacatcctggaggtgaccgtgctggacaacggcgagcccagcctgaagagcaccagcagagtggtggtgggcatcctggacgtgaacgacaacccccccatcttcagccacaagctgttcaacgtgagactgcccgagagactgagccccgtgagccccggccccgtgtacagactggtggccagcgacctggacgagggcctgaacggcagagtgacctacagcatcgaggacagcgacgaggaggccttcagcatcgacctggtgaccggcgtggtgagcagcagcagcaccttcaccgccggcgagtacaacatcctgaccatcaaggccaccgacagcggccagccccccctgagcgccagcgtgagactgcacatcgagtggatcccctggcccagacccagcagcatccccctggccttcgacgagacctactacagcttcaccgtgatggagaccgaccccgtgaaccacatggtgggcgtgatcagcgtggagggcagacccggcctgttctggttcaacatcagcggcggcgacaaggacatggacttcgacatcgagaagaccaccggcagcatcgtgatcgccagacccctggacaccagaagaagaagcaactacaacctgaccgtggaggtgaccgacggcagcagaaccatcgccacccaggtgcacatcttcatgatcgccaacatcaaccaccacagaccccagttcctggagaccagatacgaggtgagagtgccccaggacaccgtgcccggcgtggagctgctgagagtgcaggccatcgaccaggacaagggcaagagcctgatctacaccatccacggcagccaggaccccggcagcgccagcctgttccagctggaccccagcagcggcgtgctggtgaccgtgggcaagctggacctgggcagcggccccagccagcacaccctgaccgtgatggtgagagaccaggagatccccatcaagagaaacttcgtgtgggtgaccatccacgtggaggacggcaacctgcacccccccagattcacccagctgcactacgaggccagcgtgcccgacaccatcgcccccggcaccgagctgctgcaggtgagagccatggacgccgacagaggcgtgaacgccgaggtgcactacagcctgctgaagggcaacagcgagggcttcttcaacatcaacgccctgctgggcatcatcaccctggcccagaagctggaccaggccaaccacgccccccacaccctgaccgtgaaggccgaggaccagggcagcccccagtggcacgacctggccaccgtgatcatccacgtgtaccccagcgacagaagcgcccccatcttcagcaagagcgagtacttcgtggagatccccgagagcatccccgtgggcagccccatcctgctggtgagcgccatgagccccagcgaggtgacctacgagctgagagagggcaacaaggacggcgtgttcagcatgaacagctacagcggcctgatcagcacccagaagaagctggaccacgagaagatcagcagctaccagctgaagatcagaggcagcaacatggccggcgccttcaccgacgtgatggtggtggtggacatcatcgacgagaacgacaacgcccccatgttcctgaagagcaccttcgtgggccagatcagcgaggccgcccccctgtacagcatgatcatggacaagaacaacaaccccttcgtgatccacgccagcgacagcgacaaggaggccaacagcctgctggtgtacaagatcctggagcccgaggccctgaagttcttcaagatcgaccccagcatgggcaccctgaccatcgtgagcgagatggactacgagagcatgcccagcttccagttctgcgtgtacgtgcacgaccagggcagccccgtgctgttcgcccccagacccgcccaggtgatcatccacgtgagagacgtgaacgacagcccccccagattcagcgagcagatctacgaggtggccatcgtgggccccatccaccccggcatggagctgctgatggtgagagccagcgacgaggacagcgaggtgaactacagcatcaagaccggcaacgccgacgaggccgtgaccatccaccccgtgaccggcagcatcagcgtgctgaaccccgccttcctgggcctgagcagaaagctgaccatcagagccagcgacggcctgtaccaggacaccgccctggtgaagatcagcctgacccaggtgctggacaagagcctgcagttcgaccaggacgtgtactgggccgccgtgaaggagaacctgcaggacagaaaggccctggtgatcctgggcgcccagggcaaccacctgaacgacaccctgagctacttcctgctgaacggcaccgacatgttccacatggtgcagagcgccggcgtgctgcagaccagaggcgtggccttcgacagagagcagcaggacacccacgagctggccgtggaggtgagagacaacagaaccccccagagagtggcccagggcctggtgagagtgagcatcgaggacgtgaacgacaacccccccaagttcaagcacctgccctactacaccatcatccaggacggcaccgagcccggcgacgtgctgttccaggtgagcgccaccgacgaggacctgggcaccaacggcgccgtgacctacgagttcgccgaggactacacctacttcagaatcgacccctacctgggcgacatcagcctgaagaagcccttcgactaccaggccctgaacaagtaccacctgaaggtgatcgccagagacggcggcacccccagcctgcagagcgaggaggaggtgctggtgaccgtgagaaacaagagcaaccccctgttccagagcccctactacaaggtgagagtgcccgagaacatcaccctgtacacccccatcctgcacacccaggccagaagccccgagggcctgagactgatctacaacatcgtggaggaggagcccctgatgctgttcaccaccgacttcaagaccggcgtgctgaccgtgaccggccccctggactacgagagcaagaccaagcacgtgttcaccgtgagagccaccgacaccgccctgggcagcttcagcgaggccaccgtggaggtgctggtggaggacgtgaacgacaacccccccaccttcagccagctggtgtacaccaccagcatcagcgagggcctgcccgcccagacccccgtgatccagctgctggccagcgaccaggacagcggcagaaacagagacgtgagctaccagatcgtggaggacggcagcgacgtgagcaagttcttccagatcaacggcagcaccggcgagatgagcaccgtgcaggagctggactacgaggcccagcagcacttccacgtgaaggtgagagccatggacaagggcgacccccccctgaccggcgagaccctggtggtggtgaacgtgagcgacatcaacgacaacccccccgagttcagacagccccagtacgaggccaacgtgagcgagctggccacctgcggccacctggtgctgaaggtgcaggccatcgaccccgacagcagagacaccagcagactggagtacctgatcctgagcggcaaccaggacagacacttcttcatcaacagcagcagcggcatcatcagcatgttcaacctgtgcaagaagcacctggacagcagctacaacctgagagtgggcgccagcgacggcgtgttcagagccaccgtgcccgtgtacatcaacaccaccaacgccaacaagtacagccccgagttccagcagcacctgtacgaggccgagctggccgagaacgccatggtgggcaccaaggtgatcgacctgctggccatcgacaaggacagcggcccctacggcaccatcgactacaccatcatcaacaagctggccagcgagaagttcagcatcaaccccaacggccagatcgccaccctgcagaagctggacagagagaacagcaccgagagagtgatcgccatcaaggtgatggccagagacggcggcggcagagtggccttctgcaccgtgaagatcatcctgaccgacgagaacgacaaccccccccagttcaaggccagcgagtacaccgtgagcatccagagcaacgtgagcaaggacagccccgtgatccaggtgctggcctacgacgccgacgagggccagaacgccgacgtgacctacagcgtgaaccccgaggacctggtgaaggacgtgatcgagatcaaccccgtgaccggcgtggtgaaggtgaaggacagcctggtgggcctggagaaccagaccctggacttcttcatcaaggcccaggacggcggccccccccactggaacagcctggtgcccgtgagactgcaggtggtgcccaagaaggtgagcctgcccaagttcagcgagcccctgtacaccttcagcgcccccgaggacctgcccgagggcagcgagatcggcatcgtgaaggccgtggccgcccaggaccccgtgatctacagcctggtgagaggcaccacccccgagagcaacaaggacggcgtgttcagcctggaccccgacaccggcgtgatcaaggtgagaaagcccatggaccacgagagcaccaagctgtaccagatcgacgtgatggcccactgcctgcagaacaccgacgtggtgagcctggtgagcgtgaacatccaggtgggcgacgtgaacgacaacagacccgtgttcgaggccgacccctacaaggccgtgctgaccgagaacatgcccgtgggcaccagcgtgatccaggtgaccgccatcgacaaggacaccggcagagacggccaggtgagctacagactgagcgccgaccccggcagcaacgtgcacgagctgttcgccatcgacagcgagagcggctggatcaccaccctgcaggagctggactgcgagacctgccagacctaccacttccacgtggtggcctacgaccacggccagaccatccagctgagcagccaggccctggtgcaggtgagcatcaccgacgagaacgacaacgcccccagattcgccagcgaggagtacagaggcagcgtggtggagaacagcgagcccggcgagctggtggccaccctgaagaccctggacgccgacatcagcgagcagaacagacaggtgacctgctacatcaccgagggcgaccccctgggccagttcggcatcagccaggtgggcgacgagtggagaatcagcagcagaaagaccctggacagagagcacaccgccaagtacctgctgagagtgaccgccagcgacggcaagttccaggccagcgtgaccgtggagatcttcgtgctggacgtgaacgacaacagcccccagtgcagccagctgctgtacaccggcaaggtgcacgaggacgtgttccccggccacttcatcctgaaggtgagcgccaccgacctggacaccgacaccaacgcccagatcacctacagcctgcacggccccggcgcccacgagttcaagctggacccccacaccggcgagctgaccaccctgaccgccctggacagagagagaaaggacgtgttcaacctggtggccaaggccaccgacggcggcggcagaagctgccaggccgacatcaccctgcacgtggaggacgtgaacgacaacgcccccagattcttccccagccactgcgccgtggccgtgttcgacaacaccaccgtgaagacccccgtggccgtggtgttcgccagagaccccgaccagggcgccaacgcccaggtggtgtacagcctgcccgacagcgccgagggccacttcagcatcgacgccaccaccggcgtgatcagactggagaagcccctgcaggtgagaccccaggcccccctggagctgaccgtgagagccagcgacctgggcacccccatccccctgagcaccctgggcaccgtgaccgtgagcgtggtgggcctggaggactacctgcccgtgttcctgaacaccgagcacagcgtgcaggtgcccgaggacgccccccccggcaccgaggtgctgcagctggccaccctgaccagacccggcgccgagaagaccggctacagagtggtgagcggcaacgagcagggcagattcagactggacgccagaaccggcatcctgtacgtgaacgccagcctggacttcgagaccagccccaagtacttcctgagcatcgagtgcagcagaaagagcagcagcagcctgagcgacgtgaccaccgtgatggtgaacatcaccgacgtgaacgagcacagaccccagttcccccaggacccctacagcaccagagtgctggagaacgccctggtgggcgacgtgatcctgaccgtgagcgccaccgacgaggacggccccctgaacagcgacatcacctacagcctgatcggcggcaaccagctgggccacttcaccatccaccccaagaagggcgagctgcaggtggccaaggccctggacagagagcaggccagcagctacagcctgaagctgagagccaccgacagcggccagccccccctgcacgaggacaccgacatcgccatccaggtggccgacgtgaacgacaacccccccagattcttccagctgaactacagcaccaccgtgcaggagaacagccccatcggcagcaaggtgctgcagctgatcctgagcgaccccgacagccccgagaacggccccccctacagcttcagaatcaccaagggcaacaacggcagcgccttcagagtgacccccgacggctggctggtgaccgccgagggcctgagcagaagagcccaggagtggtaccagctgcagatccaggccagcgacagcggcatcccccccctgagcagcctgaccagcgtgagagtgcacgtgaccgagcagagccactacgcccccagcgccctgcccctggagatcttcatcaccgtgggcgaggacgagttccagggcggcatggtgggcaagatccacgccaccgacagagacccccaggacaccctgacctacagcctggccgaggaggagaccctgggcagacacttcagcgtgggcgcccccgacggcaagatcatcgccgcccagggcctgcccagaggccactacagcttcaacgtgaccgtgagcgacggcaccttcaccaccaccgccggcgtgcacgtgtacgtgtggcacgtgggccaggaggccctgcagcaggccatgtggatgggcttctaccagctgacccccgaggagctggtgagcgaccactggagaaacctgcagagattcctgagccacaagctggacatcaagagagccaacatccacctggccagcctgcagcccgccgaggccgtggccggcgtggacgtgctgctggtgttcgagggccacagcggcaccttctacgagttccaggagctggccagcatcatcacccacagcgccaaggagatggagcacagcgtgggcgtgcagatgagaagcgccatgcccatggtgccctgccagggccccacctgccagggccagatctgccacaacaccgtgcacctggaccccaaggtgggccccacctacagcaccgccagactgagcatcctgacccccagacaccacctgcagagaagctgcagctgcaacggcaccgccaccagattcagcggccagagctacgtgagatacagagcccccgccgccagaaactggcacatccacttctacctgaagaccctgcagccccaggccatcctgctgttcaccaacgagaccgccagcgtgagcctgaagctggccagcggcgtgccccagctggagtaccactgcctgggcggcttctacggcaacctgagcagccagagacacgtgaacgaccacgagtggcacagcatcctggtggaggagatggacgccagcatcagactgatggtggacagcatgggcaacaccagcctggtggtgcccgagaactgcagaggcctgagacccgagagacacctgctgctgggcggcctgatcctgctgcacagcagcagcaacgtgagccagggcttcgagggctgcctggacgccgtggtggtgaacgaggaggccctggacctgctggcccccggcaagaccgtggccggcctgctggagacccaggccctgacccagtgctgcctgcacagcgactactgcagccagaacacctgcctgaacggcggcaagtgcagctggacccacggcgccggctacgtgtgcaagtgccccccccagttcagcggcaagcactgcgagcagggcagagagaactgcaccttcgccccctgcctggagggcggcacctgcatcctgagccccaagggcgccagctgcaactgcccccacccctacaccggcgacagatgcgagatggaggccagaggctgcagcgagggccactgcctggtgacccccgagatccagagaggcgactggggccagcaggagctgctgatcatcaccgtggccgtggccttcatcatcatcagcaccgtgggcctgctgttctactgcagaagatgcaagagccacaagcccgtggccatggaggaccccgacctgctggccagaagcgtgggcgtggacacccaggccatgcccgccatcgagctgaaccccctgagcgccagcagctgcaacaacctgaaccagcccgagcccagcaaggccagcgtgcccaacgagctggtgaccttcggccccaacagcaagcagagacccgtggtgtgcagcgtgccccccagactgccccccgccgccgtgcccagccacagcgacaacgagcccgtgatcaagagaacctggagcagcgaggagatggtgtaccccggcggcgccatggtgtggccccccacctacagcagaaacgagagatgggagtacccccacagcgaggtgacccagggccccctgccccccagcgcccacagacacagcacccccgtggtgatgcccgagcccaacggcctgtacggcggcttccccttccccctggagatggagaacaagagagcccccctgccccccagatacagcaaccagaacctggaggacctgatgcccagcagaccccccagccccagagagagactggtggccccctgcctgaacgagtacaccgccatcagctactaccacagccagttcagacagggcggcggcggcccctgcctggccgacggcggctacaagggcgtgggcatgagactgagcagagccggccccagctacgccgtgtgcgaggtggagggcgcccccctggccggccagggccagcccagagtgccccccaactacgagggcagcgacatggtggagagcgactacggcagctgcgaggaggtgatgttctag

SEQ ID NO: 81313 - DNA, 13770 bp, Artificial Sequence
  Description of Artificial Sequence: Synthetic coding sequence
atggacatcatcatgggccactgcgtgggcaccagaccccccgcctgctgcctgatcctgctgctgttcaagctgctggccaccgtgagccagggcctgcccggcaccggccccctgggcttccacttcacccacagcatctacaacgccaccgtgtacgagaacagcgccgccagaacctacgtgaacagccagagcagaatgggcatcaccctgatcgacctgagctgggacatcaagtacagaatcgtgagcggcgacgaggagggcttcttcaaggccgaggaggtgatcatcgccgacttctgcttcctgagaatcagaaccaagggcggcaacagcgccatcctgaacagagagatccaggacaactacctgctgatcgtgaagggcagcgtgagaggcgaggacctggaggcctggaccaaggtgaacatccaggtgctggacatgaacgacctgagacccctgttcagccccaccacctacagcgtgaccatcgccgagagcacccccctgagaaccagcgtggcccaggtgaccgccaccgacgccgacatcggcagcaacggcgagttctactactacttcaagaacaaggtggacctgttcagcgtgcaccccaccagcggcgtgatcagcctgagcggcagactgaactacgacgagaagaacagatacgacctggagatcctggccgtggacagaggcatgaagctgtacggcaacaacggcgtgagcagcaccgccaagctgtacgtgcacatcgagagaatcaacgagcacgcccccaccatccacgtggtgacccacgtgcccttcagcctggagaaggagcccacctacgccgtggtgaccgtggacgacctggacgacggcgccaacggcgagatcgagagcgtgagcatcgtggccggcgaccccctggaccagttcttcctggccaaggagggcaagtggctgaacgagtacaagatcaaggagagaaagcagatcgactgggagagcttcccctacggctacaacctgaccctgcaggccaaggacaagggcagcccccagaagtgcagcgccctgaaggccgtgtacatcggcaaccccaccagagacaccgtgcccatcagattcgagaaggaggtgtacgacgtgagcatcagcgagttcagcccccccggcgtggtggtggccatcgtgaagctgagccccgagcccatcgacgtggagtacaagctgagccccggcgaggacgccgtgtacttcaagatcaaccccagaagcggcctgatcgtgaccgccagacccctgaacaccgtgaagaaggaggtgtacaagctggaggtgaccaacaaggagggcgacctgaaggcccaggtgaccatcagcatcgaggacgccaacgaccacacccccgagttccagcagcccctgtacgacgcctacgtgaacgagagcgtgcccgtgggcaccagcgtgctgaccgtgagcgccagcgacaaggacaagggcgagaacggctacatcacctacagcatcgccagcctgaacctgctgcccttcgtgatcaaccagttcaccggcgtgatcagcaccaccgaggagctggacttcgagagcagccccgagatctacagattcatcgtgagagccagcgactggggcagcccctacagacacgagagcgaggtgaacgtgaccatcagaatcggcaacgtgaacgacaacagccccctgttcgagaaggtggcctgccagggcgtgatcagctacgacttccccgtgggcggccacatcaccgccgtgagcgccatcgacatcgacgagctggagctggtgaagtacaagatcatcagcggcaacgagctgggcttcttctacctgaaccccgacagcggcgtgctgcagctgaagaagagcctgaccaacagcggcatcaagaacggcaacttcgccctgagaatcaccgccaccgacggcgagaacctggccgaccccatgagcatcaacatcagcgtgctgcacggcaaggtgagcagcaagagcttcagctgcagagagaccagagtggcccagaagctggccgagaagctgctgatcaaggccaaggccaacggcaagctgaacctggaggacggcttcctggacttctacagcatcaacagacagggcccctacttcgacaagagcttccccagcgacgtggccgtgaaggaggacctgcccgtgggcgccaacatcctgaagatcaaggcctacgacgccgacagcggcttcaacggcaaggtgctgttcaccatcagcgacggcaacaccgacagctgcttcaacatcgacatggagaccggccagctgaaggtgctgatgcccatggacagagagcacaccgacctgtacctgctgaacatcaccatctacgacctgggcaacccccagaagagcagctggagactgctgaccatcaacgtggaggacgccaacgacaacagccccgtgttcatccaggacagctacagcgtgaacatcctggagagcagcggcatcggcaccgagatcatccaggtggaggccagagacaaggacctgggcagcaacggcgaggtgacctacagcgtgctgaccgacacccagcagttcgccatcaacagcagcaccggcatcgtgtacgtggccgaccagctggacagagagagcaaggccaactacagcctgaagatcgaggccagagacaaggccgagagcggccagcagctgttcagcgtggtgaccctgaaggtgttcctggacgacgtgaacgactgcagccccgccttcatccccagcagctacagcgtgaaggtgctggaggacctgcccgtgggcaccgtgatcgcctggctggagacccacgaccccgacctgggcctgggcggccaggtgagatacagcctggtgaacgactacaacggcagattcgagatcgacaaggccagcggcgccatcagactgagcaaggagctggactacgagaagcagcagttctacaacctgaccgtgagagccaaggacaagggcagacccgtgagcctgagcagcgtgagcttcgtggaggtggaggtggtggacgtgaacgagaacctgcacaccccctacttccccgacttcgccgtggtgggcagcgtgaaggagaacagcagaatcggcaccagcgtgctgcaggtgaccgccagagacgaggacagcggcagagacggcgagatccagtacagcatcagagacggcagcggcctgggcagattcagcatcgacgacgagagcggcgtgatcaccgccgccgacatcctggacagagagaccatgggcagctactggctgaccgtgtacgccaccgacagaggcgtggtgcccctgtacagcaccatcgaggtgtacatcgaggtggaggacgtgaacgacaacgcccccctgaccagcgagcccatctactaccccgtggtgatggagaacagccccaaggacgtgagcgtgatccagatccaggccgaggaccccgacagcagcagcaacgagaagctgacctacagaatcaccagcggcaacccccagaacttcttcgccatcaacatcaagaccggcctgatcaccaccaccagcagaaagctggacagagagcagcaggccgagcacttcctggaggtgaccgtgaccgacggcggccccagccccaagcagagcaccatctgggtggtggtgcaggtgctggacgagaacgacaacaagccccagttccccgagaaggtgtaccagatcaagctgcccgagagagacagaaagaagagaggcgagcccatctacagagccttcgccttcgacagagacgagggccccaacgccgagatcagctacagcatcgtggacggcaacgacgacggcaagttcttcatcgaccccaagaccggcatggtgagcagcagaaagcagttcaccgccggcagctacgacatcctgaccatcaaggccgtggacaacggcagaccccagaagagcagcaccgccagactgcacatcgagtggatcaagaagcccccccccagccccatccccctgaccttcgacgagcccttctacaacttcaccgtgatggagagcgacagagtgaccgagatcgtgggcgtggtgagcgtgcagcccgccaacacccccctgtggttcgacatcgtgggcggcaacttcgacagcgccttcgacgccgagaagggcgtgggcaccatcgtgatcgccaagcccctggacgccgagcagagaagcatctacaacatgagcgtggaggtgaccgacggcaccaacgtggccgtgacccaggtgttcatcaaggtgctggacaacaacgacaacggccccgagttcagccagcccaactacgacgtgaccatcagcgaggacgtgctgcccgacaccgagatcctgcagatcgaggccaccgacagagacgagaagcacaagctgagctacaccgtgcacagcagcatcgacagcatcagcatgagaaagttcagaatcgaccccagcaccggcgtgctgtacaccgccgagagactggaccacgaggcccaggacaagcacatcctgaacatcatggtgagagaccaggagttcccctacagaagaaacctggccagagtgatcgtgaacgtggaggacgccaacgaccacagcccctacttcaccaaccccctgtacgaggccagcgtgttcgagagcgccgccctgggcagcgccgtgctgcaggtgaccgccctggacaaggacaagggcgagaacgccgagctgatctacaccatcgaggccggcaacaccggcaacatgttcaagatcgagcccgtgctgggcatcatcaccatctgcaaggagcccgacatgaccaccatgggccagttcgtgctgagcatcaaggtgaccgaccagggcagcccccccatgagcgccaccgccatcgtgagaatcagcgtgaccatgagcgacaacagccaccccaagttcatccacaaggactaccaggccgaggtgaacgagaacgtggacatcggcaccagcgtgatcctgatcagcgccatcagccagagcaccctgatctacgaggtgaaggacggcgacatcaacggcatcttcaccatcaacccctacagcggcgtgatcaccacccagaaggccctggactacgagagaaccagcagctaccagctgatcatccaggccaccaacatggccggcatggccagcaacgccaccgtgaacatccagatcgtggacgagaacgacaacgcccccgtgttcctgttcagccagtacagcggcagcctgagcgaggccgcccccatcaacagcatcgtgagaagcctggacaacagccccctggtgatcagagccaccgacgccgacagcaacagaaacgccctgctggtgtaccagatcgtggagagcaccgccaagaagttcttcaccgtggacagcagcaccggcgccatcagaaccatcgccaacctggaccacgagaccatcgcccacttccacttccacgtgcacgtgagagacagcggcagcccccagctgaccgccgagagccccgtggaggtgaacatcgaggtgaccgacgtgaacgacaacccccccgtgttcacccaggccgtgttcgagaccatcctgctgctgcccacctacgtgggcgtggaggtgctgaaggtgagcgccaccgaccccgacagcgaggtgccccccgagctgacctacagcctgatggagggcagcctggaccacttcctgatcgacagcaacagcggcgtgctgaccatcaagaacaacaacctgagcaaggaccactacatgctgatcgtgaaggtgagcgacggcaagttctacagcaccagcatggtgaccatcatggtgaaggaggccatggacagcggcctgcacttcacccagagcttctacagcaccagcatcagcgagaacaacaccaacatcaccaaggtggccatcgtgaacgccgtgggcaacagactgaacgagcccctgaagtacagcatcctgaaccccggcaacaagttcaagatcaagagcaccagcggcgtgatccagaccaccggcgtgcccttcgacagagaggagcaggagctgtacgagctggtggtggaggccagcagagagctggaccacctgagagtggccagagtggtggtgagagtgaacatcgaggacatcaacgacaacagccccgtgttcgtgggcctgccctactacgccgccgtgcaggtggacgccgagcccggcaccctgatctaccaggtgaccgccatcgacaaggacaagggccccaacggcgaggtgacctacgtgctgcaggacgactacggccacttcgagatcaaccccaacagcggcaacgtgatcctgaaggaggccttcaacagcgacctgagcaacatcgagtacggcgtgaccatcctggccaaggacggcggcaagcccagcctgagcaccagcgtggagctgcccatcaccatcgtgaacaaggccatgcccgtgttcgacaagcccttctacaccgccagcgtgaacgaggacatcagaatgaacacccccatcctgagcatcaacgccaccagccccgagggccagggcatcatctacatcatcatcgacggcgaccccttcaagcagttcaacatcgacttcgacaccggcgtgctgaaggtggtgagccccctggactacgaggtgaccagcgcctacaagctgaccatcagagccagcgacgccctgaccggcgccagagccgaggtgaccgtggacctgctggtgaacgacgtgaacgacaacccccccatcttcgaccagcccacctacaacaccaccctgagcgaggccagcctgatcggcacccccgtgctgcaggtggtgagcatcgacgccgacagcgagaacaacaagatggtgcactaccagatcgtgcaggacacctacaacagcaccgactacttccacatcgacagcagcagcggcctgatcctgaccgccagaatgctggaccacgagctggtgcagcactgcaccctgaaggtgagaagcatcgacagcggcttccccagcctgagcagcgaggtgctggtgcacatctacatcagcgacgtgaacgacaacccccccgtgttcaaccagctgatctacgagagctacgtgagcgagctggcccccagaggccacttcgtgacctgcgtgcaggccagcgacgccgacagcagcgacttcgacagactggagtacagcatcctgagcggcaacgacagaaccagcttcctgatggacagcaagagcggcgtgatcaccctgagcaaccacagaaagcagagaatggagcccctgtacagcctgaacgtgagcgtgagcgacggcctgttcaccagcaccgcccaggtgcacatcagagtgctgggcgccaacctgtacagccccgccttcagccagagcacctacgtggccgaggtgagagagaacgtggccgccggcaccaaggtgatccacgtgagagccaccgacggcgaccccggcacctacggccagatcagctacgccatcatcaacgacttcgccaaggacagattcctgatcgacagcaacggccaggtgatcaccaccgagagactggacagagagaaccccctggagggcgacgtgagcatcttcgtgagagccctggacggcggcggcagaaccaccttctgcaccgtgagagtgatcgtggtggacgagaacgacaacgccccccagttcatgaccgtggagtacagagccagcgtgagagccgacgtgggcagaggccacctggtgacccaggtgcaggccatcgaccccgacgacggcgccaacagcagaatcacctacagcctgtacagcgaggccagcgtgagcgtggccgacctgctggagatcgaccccgacaacggctggatggtgaccaagggcaacttcaaccagctgaagaacaccgtgctgagcttcttcgtgaaggccgtggacggcggcatccccgtgaagcacagcctgatccccgtgtacatccacgtgctgccccccgagaccttcctgcccagcttcacccagagccagtacagcttcaccatcgccgaggacaccgccatcggcagcaccgtggacaccctgagaatcctgcccagccagaacgtgtggttcagcaccgtgaacggcgagagacccgagaacaacaagggcggcatcttcgtgatcgagcaggagaccggcaccatcaagctggacaagagactggacagagagaccagccccgccttccacttcaaggtggccgccaccatccccctggacaaggtggacatcgtgttcaccgtggacgtggacatcaaggtgctggacctgaacgacaacaagcccgtgttcgagaccagcagctacgacaccatcatcatggagggcatgcccgtgggcaccaagctgacccaggtgagagccatcgacatggactggggcgccaacggccaggtgacctacagcctgcacagcgacagccagcccgagaaggtgatggaggccttcaacatcgacagcaacaccggctggatcagcaccctgaaggacctggaccacgagaccgaccccaccttcaccttcagcgtggtggccagcgacctgggcgaggccttcagcctgagcagcaccgccctggtgagcgtgagagtgaccgacatcaacgacaacgcccccgtgttcgcccaggaggtgtacagaggcaacgtgaaggagagcgacccccccggcgaggtggtggccgtgctgagcacctgggacagagacaccagcgacgtgaacagacaggtgagctaccacatcaccggcggcaaccccagaggcagattcgccctgggcctggtgcagagcgagtggaaggtgtacgtgaagagacccctggacagagaggagcaggacatctacttcctgaacatcaccgccaccgacggcctgttcgtgacccaggccatggtggaggtgagcgtgagcgacgtgaacgacaacagccccgtgtgcgaccaggtggcctacaccgccctgctgcccgaggacatccccagcaacaagatcatcctgaaggtgagcgccaaggacgccgacatcggcagcaacggctacatcagatacagcctgtacggcagcggcaacagcgagttcttcctggaccccgagagcggcgagctgaagaccctggccctgctggacagagagagaatccccgtgtacagcctgatggccaaggccaccgacggcggcggcagattctgccagagcaacatccacctgatcctggaggacgtgaacgacaacccccccgtgttcagcagcgaccactacaacacctgcgtgtacgagaacaccgccaccaaggccctgctgaccagagtgcaggccgtggaccccgacatcggcatcaacagaaaggtggtgtacagcctggccgacagcgccggcggcgtgttcagcatcgacagcagcagcggcatcatcatcctggagcagcccctggacagagagcagcagagcagctacaacatcagcgtgagagccaccgaccagagccccggccagagcctgagcagcctgaccaccgtgaccatcaccgtgctggacatcaacgacaacccccccgtgttcgagagaagagactacctggtgaccgtgcccgaggacaccagccccggcacccaggtgctggccgtgttcgccaccagcaaggacatcggcaccaacgccgagatcacctacctgatcagaagcggcaacgagcagggcaagttcaagatcaaccccaagaccggcggcatcagcgtgagcgaggtgctggactacgagctgtgcaagagattctacctggtggtggaggccaaggacggcggcacccccgccctgagcgccgtggccaccgtgaacatcaacctgaccgacgtgaacgacaacccccccaagttcagccaggacgtgtacagcgccgtgatcagcgaggacgccctggtgggcgacagcgtgatcctgctgatcgccgaggacgtggacagccagcccaacggccagatccacttcagcatcgtgaacggcgacagagacaacgagttcaccgtggaccccgtgctgggcctggtgaaggtgaagaagaagctggacagagagagagtgagcggctacagcctgctggtgcaggccgtggacagcggcatccccgccatgagcagcaccgccaccgtgaacatcgacatcagcgacgtgaacgacaacagccccgtgttcacccccgccaactacaccgccgtgatccaggagaacaagcccgtgggcaccagcatcctgcagctggtggtgaccgacagagacagcttccacaacggcccccccttcagcttcagcatcctgagcggcaacgaggaggaggagttcgtgctggacccccacggcatcctgagaagcgccgtggtgttccagcacaccgagagcctggagtacgtgctgtgcgtgcaggccaaggacagcggcaagccccagcaggtgagccacacctacatcagagtgagagtgatcgaggagagcacccacaagcccaccgccatccccctggagatcttcatcgtgaccatggaggacgacttccccggcggcgtgatcggcaagatccacgccaccgaccaggacatgtacgacgtgctgaccttcgccctgaagagcgagcagaagagcctgttcaaggtgaacagccacgacggcaagatcatcgccctgggcggcctggacagcggcaagtacgtgctgaacgtgagcgtgagcgacggcagattccaggtgcccatcgacgtggtggtgcacgtggagcagctggtgcacgagatgctgcagaacaccgtgaccatcagattcgagaacgtgagccccgaggacttcgtgggcctgcacatgcacggcttcagaagaaccctgagaaacgccgtgctgacccagaagcaggacagcctgagaatcatcagcatccagcccgtggccggcaccaaccagctggacatgctgttcgccgtggagatgcacagcagcgagttctacaagcccgcctacctgatccagaagctgagcaacgccagaagacacctggagaacatcatgagaatcagcgccatcctggagaagaactgcagcggcctggactgccaggagcagcactgcgagcagggcctgagcctggacagccacgccctgatgacctacagcaccgccagaatcagcttcgtgtgccccagattctacagaaacgtgagatgcacctgcaacggcggcctgtgccccggcagcaacgacccctgcgtggagaagccctgccccggcgacatgcagtgcgtgagctacgaggccagcagaagacccttcctgtgccagtgcccccccggcaagctgggcgagtgcagcggccacaccagcctgagcttcgccggcaacagctacatcaagtacagactgagcgagaacagcaaggaggaggacttcaagctggccctgagactgagaaccctgcagagcaacggcatcatcatgtacaccagagccaacccctgcatcatcctgaagatcgtggacggcaagctgtggttccagctggactgcggcagcggccccggcatcctgggcatcagcggcagagccgtgaacgacggcagctggcacagcgtgttcctggagctgaacagaaacttcaccagcctgagcctggacgacagctacgtggagagaagaagagcccccctgtacttccagaccctgagcaccgagagcagcatctacttcggcgccctggtgcaggccgacaacatcagaagcctgaccgacaccagagtgacccaggtgctgagcggcttccagggctgcctggacagcgtgatcctgaacaacaacgagctgcccctgcagaacaagagaagcagcttcgccgaggtggtgggcctgaccgagctgaagctgggctgcgtgctgtaccccgacgcctgcaagagaagcccctgccagcacggcggcagctgcaccggcctgcccagcggcggctaccagtgcacctgcctgagccagttcaccggcagaaactgcgagagcgagatcaccgcctgcttccccaacccctgcagaaacggcggcagctgcgaccccatcggcaacaccttcatctgcaactgcaaggccggcctgaccggcgtgacctgcgaggaggacatcaacgagtgcgagagagaggagtgcgagaacggcggcagctgcgtgaacgtgttcggcagcttcctgtgcaactgcacccccggctacgtgggccagtactgcggcctgagacccgtggtggtgcccaacatccaggccggccacagctacgtgggcaaggaggagctgatcggcatcgccgtggtgctgttcgtgatcttcatcctggtggtgctgttcatcgtgttcagaaagaaggtgttcagaaagaactacagcagaaacaacatcaccctggtgcaggaccccgccaccgccgccctgctgaacaagagcaacggcatccccttcagaaacctgagaggcagcggcgacggcagaaacgtgtaccaggaggtgggccccccccaggtgcccgtgagacccatggcctacaccccctgcttccagagcgacagcagaagcaacctggacaagatcgtggacggcctgggcggcgagcaccaggagatgaccaccttccaccccgagagccccagaatcctgaccgccagaagaggcgtggtggtgtgcagcgtggcccccaacctgcccgccgtgagcccctgcagaagcgactgcgacagcatcagaaagaacggctgggacgccggcaccgagaacaagggcgtggacgaccccggcgaggtgacctgcttcgccggcagcaacaagggcagcaacagcgaggtgcagagcctgagcagcttccagagcgacagcggcgacgacaacgccagcatcgtgaccgtgatccagctggtgaacaacgtggtggacaccatcgagaacgaggtgagcgtgatggaccagggccagaactacaacagagcctaccactgggacaccagcgactggatgcccggcgccagactgagcgacatcgaggaggtgcccaactacgagaaccaggacggcggcagcgcccaccagggcagcaccagagagctggagagcgactactacctgggcggctacgacatcgacagcgagtacccccccccccacgaggaggagttcctgagccaggaccagctgcccccccccctgcccgaggacttccccgaccagtacgaggccctgccccccagccagcccgtgagcctggccagcaccctgagccccgactgcagaagaagaccccagttccaccccagccagtacctgcccccccaccccttccccaacgagaccgacctggtgggcccccccgccagctgcgagttcagcaccttcgccgtgagcatgaaccagggcaccgagcccaccggccccgccgacagcgtgagcctgagcctgcacaacagcagaggcaccagcagcagcgacgtgagcgccaactgcggcttcgacgacagcgaggtggccatgagcgactacgagagcgtgggcgagctgagcctggccagcctgcacatccccttcgtggagacccagcaccagacccaggtgtag

SEQ ID NO: 81314 - DNA, 13674 bp, Artificial Sequence
  Description of Artificial Sequence: Synthetic coding sequence
atggacatcatcatgggccactgcgtgggcaccagaccccccgcctgctgcctgatcctgctgctgttcaagctgctggccaccgtgagccagggcctgcccggcaccggccccctgggcttccacttcacccacagcatctacaacgccaccgtgtacgagaacagcgccgccagaacctacgtgaacagccagagcagaatgggcatcaccctgatcgacctgagctgggacatcaagtacagaatcgtgagcggcgacgaggagggcttcttcaaggccgaggaggtgatcatcgccgacttctgcttcctgagaatcagaaccaagggcggcaacagcgccatcctgaacagagagatccaggacaactacctgctgatcgtgaagggcagcgtgagaggcgaggacctggaggcctggaccaaggtgaacatccaggtgctggacatgaacgacctgagacccctgttcagccccaccacctacagcgtgaccatcgccgagagcacccccctgagaaccagcgtggcccaggtgaccgccaccgacgccgacatcggcagcaacggcgagttctactactacttcaagaacaaggtggacctgttcagcgtgcaccccaccagcggcgtgatcagcctgagcggcagactgaactacgacgagaagaacagatacgacctggagatcctggccgtggacagaggcatgaagctgtacggcaacaacggcgtgagcagcaccgccaagctgtacgtgcacatcgagagaatcaacgagcacgcccccaccatccacgtggtgacccacgtgcccttcagcctggagaaggagcccacctacgccgtggtgaccgtggacgacctggacgacggcgccaacggcgagatcgagagcgtgagcatcgtggccggcgaccccctggaccagttcttcctggccaaggagggcaagtggctgaacgagtacaagatcaaggagagaaagcagatcgactgggagagcttcccctacggctacaacctgaccctgcaggccaaggacaagggcagcccccagaagtgcagcgccctgaaggccgtgtacatcggcaaccccaccagagacaccgtgcccatcagattcgagaaggaggtgtacgacgtgagcatcagcgagttcagcccccccggcgtggtggtggccatcgtgaagctgagccccgagcccatcgacgtggagtacaagctgagccccggcgaggacgccgtgtacttcaagatcaaccccagaagcggcctgatcgtgaccgccagacccctgaacaccgtgaagaaggaggtgtacaagctggaggtgaccaacaaggagggcgacctgaaggcccaggtgaccatcagcatcgaggacgccaacgaccacacccccgagttccagcagcccctgtacgacgcctacgtgaacgagagcgtgcccgtgggcaccagcgtgctgaccgtgagcgccagcgacaaggacaagggcgagaacggctacatcacctacagcatcgccagcctgaacctgctgcccttcgtgatcaaccagttcaccggcgtgatcagcaccaccgaggagctggacttcgagagcagccccgagatctacagattcatcgtgagagccagcgactggggcagcccctacagacacgagagcgaggtgaacgtgaccatcagaatcggcaacgtgaacgacaacagccccctgttcgagaaggtggcctgccagggcgtgatcagctacgacttccccgtgggcggccacatcaccgccgtgagcgccatcgacatcgacgagctggagctggtgaagtacaagatcatcagcggcaacgagctgggcttcttctacctgaaccccgacagcggcgtgctgcagctgaagaagagcctgaccaacagcggcatcaagaacggcaacttcgccctgagaatcaccgccaccgacggcgagaacctggccgaccccatgagcatcaacatcagcgtgctgcacggcaaggtgagcagcaagagcttcagctgcagagagaccagagtggcccagaagctggccgagaagctgctgatcaaggccaaggccaacggcaagctgaacctggaggacggcttcctggacttctacagcatcaacagacagggcccctacttcgacaagagcttccccagcgacgtggccgtgaaggaggacctgcccgtgggcgccaacatcctgaagatcaaggcctacgacgccgacagcggcttcaacggcaaggtgctgttcaccatcagcgacggcaacaccgacagctgcttcaacatcgacatggagaccggccagctgaaggtgctgatgcccatggacagagagcacaccgacctgtacctgctgaacatcaccatctacgacctgggcaacccccagaagagcagctggagactgctgaccatcaacgtggaggacgccaacgacaacagccccgtgttcatccaggacagctacagcgtgaacatcctggagagcagcggcatcggcaccgagatcatccaggtggaggccagagacaaggacctgggcagcaacggcgaggtgacctacagcgtgctgaccgacacccagcagttcgccatcaacagcagcaccggcatcgtgtacgtggccgaccagctggacagagagagcaaggccaactacagcctgaagatcgaggccagagacaaggccgagagcggccagcagctgttcagcgtggtgaccctgaaggtgttcctggacgacgtgaacgactgcagccccgccttcatccccagcagctacagcgtgaaggtgctggaggacctgcccgtgggcaccgtgatcgcctggctggagacccacgaccccgacctgggcctgggcggccaggtgagatacagcctggtgaacgactacaacggcagattcgagatcgacaaggccagcggcgccatcagactgagcaaggagctggactacgagaagcagcagttctacaacctgaccgtgagagccaaggacaagggcagacccgtgagcctgagcagcgtgagcttcgtggaggtggaggtggtggacgtgaacgagaacctgcacaccccctacttccccgacttcgccgtggtgggcagcgtgaaggagaacagcagaatcggcaccagcgtgctgcaggtgaccgccagagacgaggacagcggcagagacggcgagatccagtacagcatcagagacggcagcggcctgggcagattcagcatcgacgacgagagcggcgtgatcaccgccgccgacatcctggacagagagaccatgggcagctactggctgaccgtgtacgccaccgacagaggcgtggtgcccctgtacagcaccatcgaggtgtacatcgaggtggaggacgtgaacgacaacgcccccctgaccagcgagcccatctactaccccgtggtgatggagaacagccccaaggacgtgagcgtgatccagatccaggccgaggaccccgacagcagcagcaacgagaagctgacctacagaatcaccagcggcaacccccagaacttcttcgccatcaacatcaagaccggcctgatcaccaccaccagcagaaagctggacagagagcagcaggccgagcacttcctggaggtgaccgtgaccgacggcggccccagccccaagcagagcaccatctgggtggtggtgcaggtgctggacgagaacgacaacaagccccagttccccgagaaggtgtaccagatcaagctgcccgagagagacagaaagaagagaggcgagcccatctacagagccttcgccttcgacagagacgagggccccaacgccgagatcagctacagcatcgtggacggcaacgacgacggcaagttcttcatcgaccccaagaccggcatggtgagcagcagaaagcagttcaccgccggcagctacgacatcctgaccatcaaggccgtggacaacggcagaccccagaagagcagcaccgccagactgcacatcgagtggatcaagaagcccccccccagccccatccccctgaccttcgacgagcccttctacaacttcaccgtgatggagagcgacagagtgaccgagatcgtgggcgtggtgagcgtgcagcccgccaacacccccctgtggttcgacatcgtgggcggcaacttcgacagcgccttcgacgccgagaagggcgtgggcaccatcgtgatcgccaagcccctggacgccgagcagagaagcatctacaacatgagcgtggaggtgaccgacggcaccaacgtggccgtgacccaggtgttcatcaaggtgctggacaacaacgacaacggccccgagttcagccagcccaactacgacgtgaccatcagcgaggacgtgctgcccgacaccgagatcctgcagatcgaggccaccgacagagacgagaagcacaagctgagctacaccgtgcacagcagcatcgacagcatcagcatgagaaagttcagaatcgaccccagcaccggcgtgctgtacaccgccgagagactggaccacgaggcccaggacaagcacatcctgaacatcatggtgagagaccaggagttcccctacagaagaaacctggccagagtgatcgtgaacgtggaggacgccaacgaccacagcccctacttcaccaaccccctgtacgaggccagcgtgttcgagagcgccgccctgggcagcgccgtgctgcaggtgaccgccctggacaaggacaagggcgagaacgccgagctgatctacaccatcgaggccggcaacaccggcaacatgttcaagatcgagcccgtgctgggcatcatcaccatctgcaaggagcccgacatgaccaccatgggccagttcgtgctgagcatcaaggtgaccgaccagggcagcccccccatgagcgccaccgccatcgtgagaatcagcgtgaccatgagcgacaacagccaccccaagttcatccacaaggactaccaggccgaggtgaacgagaacgtggacatcggcaccagcgtgatcctgatcagcgccatcagccagagcaccctgatctacgaggtgaaggacggcgacatcaacggcatcttcaccatcaacccctacagcggcgtgatcaccacccagaaggccctggactacgagagaaccagcagctaccagctgatcatccaggccaccaacatggccggcatggccagcaacgccaccgtgaacatccagatcgtggacgagaacgacaacgcccccgtgttcctgttcagccagtacagcggcagcctgagcgaggccgcccccatcaacagcatcgtgagaagcctggacaacagccccctggtgatcagagccaccgacgccgacagcaacagaaacgccctgctggtgtaccagatcgtggagagcaccgccaagaagttcttcaccgtggacagcagcaccggcgccatcagaaccatcgccaacctggaccacgagaccatcgcccacttccacttccacgtgcacgtgagagacagcggcagcccccagctgaccgccgagagccccgtggaggtgaacatcgaggtgaccgacgtgaacgacaacccccccgtgttcacccaggccgtgttcgagaccatcctgctgctgcccacctacgtgggcgtggaggtgctgaaggtgagcgccaccgaccccgacagcgaggtgccccccgagctgacctacagcctgatggagggcagcctggaccacttcctgatcgacagcaacagcggcgtgctgaccatcaagaacaacaacctgagcaaggaccactacatgctgatcgtgaaggtgagcgacggcaagttctacagcaccagcatggtgaccatcatggtgaaggaggccatggacagcggcctgcacttcacccagagcttctacagcaccagcatcagcgagaacaacaccaacatcaccaaggtggccatcgtgaacgccgtgggcaacagactgaacgagcccctgaagtacagcatcctgaaccccggcaacaagttcaagatcaagagcaccagcggcgtgatccagaccaccggcgtgcccttcgacagagaggagcaggagctgtacgagctggtggtggaggccagcagagagctggaccacctgagagtggccagagtggtggtgagagtgaacatcgaggacatcaacgacaacagccccgtgttcgtgggcctgccctactacgccgccgtgcaggtggacgccgagcccggcaccctgatctaccaggtgaccgccatcgacaaggacaagggccccaacggcgaggtgacctacgtgctgcaggacgactacggccacttcgagatcaaccccaacagcggcaacgtgatcctgaaggaggccttcaacagcgacctgagcaacatcgagtacggcgtgaccatcctggccaaggacggcggcaagcccagcctgagcaccagcgtggagctgcccatcaccatcgtgaacaaggccatgcccgtgttcgacaagcccttctacaccgccagcgtgaacgaggacatcagaatgaacacccccatcctgagcatcaacgccaccagccccgagggccagggcatcatctacatcatcatcgacggcgaccccttcaagcagttcaacatcgacttcgacaccggcgtgctgaaggtggtgagccccctggactacgaggtgaccagcgcctacaagctgaccatcagagccagcgacgccctgaccggcgccagagccgaggtgaccgtggacctgctggtgaacgacgtgaacgacaacccccccatcttcgaccagcccacctacaacaccaccctgagcgaggccagcctgatcggcacccccgtgctgcaggtggtgagcatcgacgccgacagcgagaacaacaagatggtgcactaccagatcgtgcaggacacctacaacagcaccgactacttccacatcgacagcagcagcggcctgatcctgaccgccagaatgctggaccacgagctggtgcagcactgcaccctgaaggtgagaagcatcgacagcggcttccccagcctgagcagcgaggtgctggtgcacatctacatcagcgacgtgaacgacaacccccccgtgttcaaccagctgatctacgagagctacgtgagcgagctggcccccagaggccacttcgtgacctgcgtgcaggccagcgacgccgacagcagcgacttcgacagactggagtacagcatcctgagcggcaacgacagaaccagcttcctgatggacagcaagagcggcgtgatcaccctgagcaaccacagaaagcagagaatggagcccctgtacagcctgaacgtgagcgtgagcgacggcctgttcaccagcaccgcccaggtgcacatcagagtgctgggcgccaacctgtacagccccgccttcagccagagcacctacgtggccgaggtgagagagaacgtggccgccggcaccaaggtgatccacgtgagagccaccgacggcgaccccggcacctacggccagatcagctacgccatcatcaacgacttcgccaaggacagattcctgatcgacagcaacggccaggtgatcaccaccgagagactggacagagagaaccccctggagggcgacgtgagcatcttcgtgagagccctggacggcggcggcagaaccaccttctgcaccgtgagagtgatcgtggtggacgagaacgacaacgccccccagttcatgaccgtggagtacagagccagcgtgagagccgacgtgggcagaggccacctggtgacccaggtgcaggccatcgaccccgacgacggcgccaacagcagaatcacctacagcctgtacagcgaggccagcgtgagcgtggccgacctgctggagatcgaccccgacaacggctggatggtgaccaagggcaacttcaaccagctgaagaacaccgtgctgagcttcttcgtgaaggccgtggacggcggcatccccgtgaagcacagcctgatccccgtgtacatccacgtgctgccccccgagaccttcctgcccagcttcacccagagccagtacagcttcaccatcgccgaggacaccgccatcggcagcaccgtggacaccctgagaatcctgcccagccagaacgtgtggttcagcaccgtgaacggcgagagacccgagaacaacaagggcggcatcttcgtgatcgagcaggagaccggcaccatcaagctggacaagagactggacagagagaccagccccgccttccacttcaaggtggccgccaccatccccctggacaaggtggacatcgtgttcaccgtggacgtggacatcaaggtgctggacctgaacgacaacaagcccgtgttcgagaccagcagctacgacaccatcatcatggagggcatgcccgtgggcaccaagctgacccaggtgagagccatcgacatggactggggcgccaacggccaggtgacctacagcctgcacagcgacagccagcccgagaaggtgatggaggccttcaacatcgacagcaacaccggctggatcagcaccctgaaggacctggaccacgagaccgaccccaccttcaccttcagcgtggtggccagcgacctgggcgaggccttcagcctgagcagcaccgccctggtgagcgtgagagtgaccgacatcaacgacaacgcccccgtgttcgcccaggaggtgtacagaggcaacgtgaaggagagcgacccccccggcgaggtggtggccgtgctgagcacctgggacagagacaccagcgacgtgaacagacaggtgagctaccacatcaccggcggcaaccccagaggcagattcgccctgggcctggtgcagagcgagtggaaggtgtacgtgaagagacccctggacagagaggagcaggacatctacttcctgaacatcaccgccaccgacggcctgttcgtgacccaggccatggtggaggtgagcgtgagcgacgtgaacgacaacagccccgtgtgcgaccaggtggcctacaccgccctgctgcccgaggacatccccagcaacaagatcatcctgaaggtgagcgccaaggacgccgacatcggcagcaacggctacatcagatacagcctgtacggcagcggcaacagcgagttcttcctggaccccgagagcggcgagctgaagaccctggccctgctggacagagagagaatccccgtgtacagcctgatggccaaggccaccgacggcggcggcagattctgccagagcaacatccacctgatcctggaggacgtgaacgacaacccccccgtgttcagcagcgaccactacaacacctgcgtgtacgagaacaccgccaccaaggccctgctgaccagagtgcaggccgtggaccccgacatcggcatcaacagaaaggtggtgtacagcctggccgacagcgccggcggcgtgttcagcatcgacagcagcagcggcatcatcatcctggagcagcccctggacagagagcagcagagcagctacaacatcagcgtgagagccaccgaccagagccccggccagagcctgagcagcctgaccaccgtgaccatcaccgtgctggacatcaacgacaacccccccgtgttcgagagaagagactacctggtgaccgtgcccgaggacaccagccccggcacccaggtgctggccgtgttcgccaccagcaaggacatcggcaccaacgccgagatcacctacctgatcagaagcggcaacgagcagggcaagttcaagatcaaccccaagaccggcggcatcagcgtgagcgaggtgctggactacgagctgtgcaagagattctacctggtggtggaggccaaggacggcggcacccccgccctgagcgccgtggccaccgtgaacatcaacctgaccgacgtgaacgacaacccccccaagttcagccaggacgtgtacagcgccgtgatcagcgaggacgccctggtgggcgacagcgtgatcctgctgatcgccgaggacgtggacagccagcccaacggccagatccacttcagcatcgtgaacggcgacagagacaacgagttcaccgtggaccccgtgctgggcctggtgaaggtgaagaagaagctggacagagagagagtgagcggctacagcctgctggtgcaggccgtggacagcggcatccccgccatgagcagcaccgccaccgtgaacatcgacatcagcgacgtgaacgacaacagccccgtgttcacccccgccaactacaccgccgtgatccaggagaacaagcccgtgggcaccagcatcctgcagctggtggtgaccgacagagacagcttccacaacggcccccccttcagcttcagcatcctgagcggcaacgaggaggaggagttcgtgctggacccccacggcatcctgagaagcgccgtggtgttccagcacaccgagagcctggagtacgtgctgtgcgtgcaggccaaggacagcggcaagccccagcaggtgagccacacctacatcagagtgagagtgatcgaggagagcacccacaagcccaccgccatccccctggagatcttcatcgtgaccatggaggacgacttccccggcggcgtgatcggcaagatccacgccaccgaccaggacatgtacgacgtgctgaccttcgccctgaagagcgagcagaagagcctgttcaaggtgaacagccacgacggcaagatcatcgccctgggcggcctggacagcggcaagtacgtgctgaacgtgagcgtgagcgacggcagattccaggtgcccatcgacgtggtggtgcacgtggagcagctggtgcacgagatgctgcagaacaccgtgaccatcagattcgagaacgtgagccccgaggacttcgtgggcctgcacatgcacggcttcagaagaaccctgagaaacgccgtgctgacccagaagcaggacagcctgagaatcatcagcatccagcccgtggccggcaccaaccagctggacatgctgttcgccgtggagatgcacagcagcgagttctacaagcccgcctacctgatccagaagctgagcaacgccagaagacacctggagaacatcatgagaatcagcgccatcctggagaagaactgcagcggcctggactgccaggagcagcactgcgagcagggcctgagcctggacagccacgccctgatgacctacagcaccgccagaatcagcttcgtgtgccccagattctacagaaacgtgagatgcacctgcaacggcggcctgtgccccggcagcaacgacccctgcgtggagaagccctgccccggcgacatgcagtgcgtgagctacgaggccagcagaagacccttcctgtgccagtgcccccccggcaagctgggcgagtgcagcggccacaccagcctgagcttcgccggcaacagctacatcaagtacagactgagcgagaacagcaaggaggaggacttcaagctggccctgagactgagaaccctgcagagcaacggcatcatcatgtacaccagagccaacccctgcatcatcctgaagatcgtggacggcaagctgtggttccagctggactgcggcagcggccccggcatcctgggcatcagcggcagagccgtgaacgacggcagctggcacagcgtgttcctggagctgaacagaaacttcaccagcctgagcctggacgacagctacgtggagagaagaagagcccccctgtacttccagaccctgagcaccgagagcagcatctacttcggcgccctggtgcaggccgacaacatcagaagcctgaccgacaccagagtgacccaggtgctgagcggcttccagggctgcctggacagcgtgatcctgaacaacaacgagctgcccctgcagaacaagagaagcagcttcgccgaggtggtgggcctgaccgagctgaagctgggctgcgtgctgtaccccgacgcctgcaagagaagcccctgccagcacggcggcagctgcaccggcctgcccagcggcggctaccagtgcacctgcctgagccagttcaccggcagaaactgcgagagcgagatcaccgcctgcttccccaacccctgcagaaacggcggcagctgcgaccccatcggcaacaccttcatctgcaactgcaaggccggcctgaccggcgtgacctgcgaggaggacatcaacgagtgcgagagagaggagtgcgagaacggcggcagctgcgtgaacgtgttcggcagcttcctgtgcaactgcacccccggctacgtgggccagtactgcggcctgagacccgtggtggtgcccaacatccaggccggccacagctacgtgggcaaggaggagctgatcggcatcgccgtggtgctgttcgtgatcttcatcctggtggtgctgttcatcgtgttcagaaagaaggtgttcagaaagaactacagcagaaacaacatcaccctggtgcaggaccccgccaccgccgccctgctgaacaagagcaacggcatccccttcagaaacctgagaggcagcggcgacggcagaaacgtgtaccaggaggtgggccccccccaggtgcccgtgagacccatggcctacaccccctgcttccagagcgacagcagaagcaacctggacaagatcgtggacggcctgggcggcgagcaccaggagatgaccaccttccaccccgagagccccagaatcctgaccgccagaagaggcgtggtggtgtgcagcgtggcccccaacctgcccgccgtgagcccctgcagaagcgactgcgacagcatcagaaagaacggctgggacgccggcaccgagaacaagggcgtggacgaccccggcgaggtgacctgcttcgccggcagcaacaagggcagcaacagcgaggtgcagagcctgagcagcttccagagcgacagcggcgacgacaacgcctaccactgggacaccagcgactggatgcccggcgccagactgagcgacatcgaggaggtgcccaactacgagaaccaggacggcggcagcgcccaccagggcagcaccagagagctggagagcgactactacctgggcggctacgacatcgacagcgagtacccccccccccacgaggaggagttcctgagccaggaccagctgcccccccccctgcccgaggacttccccgaccagtacgaggccctgccccccagccagcccgtgagcctggccagcaccctgagccccgactgcagaagaagaccccagttccaccccagccagtacctgcccccccaccccttccccaacgagaccgacctggtgggcccccccgccagctgcgagttcagcaccttcgccgtgagcatgaaccagggcaccgagcccaccggccccgccgacagcgtgagcctgagcctgcacaacagcagaggcaccagcagcagcgacgtgagcgccaactgcggcttcgacgacagcgaggtggccatgagcgactacgagagcgtgggcgagctgagcctggccagcctgcacatccccttcgtggagacccagcaccagacccaggtgtag

SEQ ID NO: 81315 - DNA, 3765 bp, Artificial Sequence
  Description of Artificial Sequence: Synthetic coding sequence
atggacatcatcatgggccactgcgtgggcaccagaccccccgcctgctgcctgatcctgctgctgttcaagctgctggccaccgtgagccagggcctgcccggcaccggccccctgggcttccacttcacccacagcatctacaacgccaccgtgtacgagaacagcgccgccagaacctacgtgaacagccagagcagaatgggcatcaccctgatcgacctgagctgggacatcaagtacagaatcgtgagcggcgacgaggagggcttcttcaaggccgaggaggtgatcatcgccgacttctgcttcctgagaatcagaaccaagggcggcaacagcgccatcctgaacagagagatccaggacaactacctgctgatcgtgaagggcagcgtgagaggcgaggacctggaggcctggaccaaggtgaacatccaggtgctggacatgaacgacctgagacccctgttcagccccaccacctacagcgtgaccatcgccgagagcacccccctgagaaccagcgtggcccaggtgaccgccaccgacgccgacatcggcagcaacggcgagttctactactacttcaagaacaaggtggacctgttcagcgtgcaccccaccagcggcgtgatcagcctgagcggcagactgaactacgacgagaagaacagatacgacctggagatcctggccgtggacagaggcatgaagctgtacggcaacaacggcgtgagcagcaccgccaagctgtacgtgcacatcgagagaatcaacgagcacgcccccaccatccacgtggtgacccacgtgcccttcagcctggagaaggagcccacctacgccgtggtgaccgtggacgacctggacgacggcgccaacggcgagatcgagagcgtgagcatcgtggccggcgaccccctggaccagttcttcctggccaaggagggcaagtggctgaacgagtacaagatcaaggagagaaagcagatcgactgggagagcttcccctacggctacaacctgaccctgcaggccaaggacaagggcagcccccagaagtgcagcgccctgaaggccgtgtacatcggcaaccccaccagagacaccgtgcccatcagattcgagaaggaggtgtacgacgtgagcatcagcgagttcagcccccccggcgtggtggtggccatcgtgaagctgagccccgagcccatcgacgtggagtacaagctgagccccggcgaggacgccgtgtacttcaagatcaaccccagaagcggcctgatcgtgaccgccagacccctgaacaccgtgaagaaggaggtgtacaagctggaggtgaccaacaaggagggcgacctgaaggcccaggtgaccatcagcatcgaggacgccaacgaccacacccccgagttccagcagcccctgtacgacgcctacgtgaacgagagcgtgcccgtgggcaccagcgtgctgaccgtgagcgccagcgacaaggacaagggcgagaacggctacatcacctacagcatcgccagcctgaacctgctgcccttcgtgatcaaccagttcaccggcgtgatcagcaccaccgaggagctggacttcgagagcagccccgagatctacagattcatcgtgagagccagcgactggggcagcccctacagacacgagagcgaggtgaacgtgaccatcagaatcggcaacgtgaacgacaacagccccctgttcgagaaggtggcctgccagggcgtgatcagctacgacttccccgtgggcggccacatcaccgccgtgagcgccatcgacatcgacgagctggagctggtgaagtacaagatcatcagcggcaacgagctgggcttcttctacctgaaccccgacagcggcgtgctgcagctgaagaagagcctgaccaacagcggcatcaagaacggcaacttcgccctgagaatcaccgccaccgacggcgagaacctggccgaccccatgagcatcaacatcagcgtgctgcacggcaaggtgagcagcaagagcttcagctgcagagagaccagagtggcccagaagctggccgagaagctgctgatcaaggccaaggccaacggcaagctgaacctggaggacggcttcctggacttctacagcatcaacagacagggcccctacttcgacaagagcttccccagcgacgtggccgtgaaggaggacctgcccgtgggcgccaacatcctgaagatcaaggcctacgacgccgacagcggcttcaacggcaaggtgctgttcaccatcagcgacggcaacaccgacagctgcttcaacatcgacatggagaccggccagctgaaggtgctgatgcccatggacagagagcacaccgacctgtacctgctgaacatcaccatctacgacctgggcaacccccagaagagcagctggagactgctgaccatcaacgtggaggacgccaacgacaacagccccgtgttcatccaggacagctacagcgtgaacatcctggagagcagcggcatcggcaccgagatcatccaggtggaggccagagacaaggacctgggcagcaacggcgaggtgacctacagcgtgctgaccgacacccagcagttcgccatcaacagcagcaccggcatcgtgtacgtggccgaccagctggacagagagagcaaggccaactacagcctgaagatcgaggccagagacaaggccgagagcggccagcagctgttcagcgtggtgaccctgaaggtgttcctggacgacgtgaacgactgcagccccgccttcatccccagcagctacagcgtgaaggtgctggaggacctgcccgtgggcaccgtgatcgcctggctggagacccacgaccccgacctgggcctgggcggccaggtgagatacagcctggtgaacgactacaacggcagattcgagatcgacaaggccagcggcgccatcagactgagcaaggagctggactacgagaagcagcagttctacaacctgaccgtgagagccaaggacaagggcagacccgtgagcctgagcagcgtgagcttcgtggaggtggaggtggtggacgtgaacgagaacctgcacaccccctacttccccgacttcgccgtggtgggcagcgtgaaggagaacagcagaatcggcaccagcgtgctgcaggtgaccgccagagacgaggacagcggcagagacggcgagatccagtacagcatcagagacggcagcggcctgggcagattcagcatcgacgacgagagcggcgtgatcaccgccgccgacatcctggacagagagaccatgggcagctactggctgaccgtgtacgccaccgacagaggcgtggtgcccctgtacagcaccatcgaggtgtacatcgaggtggaggacgtgaacgacaacgcccccctgaccagcgagcccatctactaccccgtggtgatggagaacagccccaaggacgtgagcgtgatccagatccaggccgaggaccccgacagcagcagcaacgagaagctgacctacagaatcaccagcggcaacccccagaacttcttcgccatcaacatcaagaccggcagctgcagcgtggcccaggccggcatgcagtggcacgaccacagcagcctgcagagcagaacccccggcttcaagggctacccctgcctgagcctgctgagcagctgggactacagacacgcccccccctgccccgccaccttcctgaacagctag

SEQ ID NO: 81316 - DNA, 9669 bp, Artificial Sequence
  Description of Artificial Sequence: Synthetic coding sequence
atggtgaccaccgtggtggccgtgggcgacaccctggcccagcccctggccgccgccgaggtgttcatcgtggagatcaccctgcaggacatcaacgacaacccccccgtgttccccaccgacatgctggacctgaccgtggaggagaacatcggcgacggcagcaagatcatgcagctgaccgccatggacgccgacgagggcgccaacgccctggtgacctacaccatcatcagcggcgccgacgacagcttcagaatcgaccccgagagcggcgacctgatcgccaccagaagactggacagagagagaagaagcaagtacagcctgctggtgagagccgacgacggcctgcagagcagcgacatgagaatcaacatcaccgtgagcgacgtgaacgaccacacccccaagttcagcagacccgtgtacagcttcgacatccccgaggacaccatccccggcagcctggtggccgccatcctggccaccgacgacgacagcggcgtgaacggcgagatcacctacatcgtgaacgaggacgacgaggacggcatcttcttcctgaaccccatcaccggcgtgttcaacctgaccagactgctggactacgaggtgcagcagtactacatcctgaccgtgagagccgaggacggcggcggccagttcaccaccatcagagtgtacttcaacatcctggacgtgaacgacaacccccccatcttcagcctgaacagctacagcaccagcctgatggagaacctgcccgtgggcagcaccgtgctggtgttcaacgtgaccgacgccgacgacggcatcaacagccagctgacctacagcatcgccagcggcgacagcctgggccagttcaccgtggacaagaacggcgtgctgaaggtgctgaaggccctggacagagagagccagagcttctacaacctggtggtgcaggtgcacgacctgccccagatccccgccagcagattcaccagcaccgcccaggtgagcatcatcctgctggacgtgaacgacaacccccccaccttcctgagccccaagctgacctacatccccgagaacacccccatcgacaccgtggtgttcaaggcccaggccaccgaccccgacagcggccccaacagctacatcgagtacaccctgctgaaccccctgggcaacaagttcagcatcggcaccatcgacggcgaggtgagactgaccggcgagctggacagagaggaggtgagcaactacaccctgaccgtggtggccaccgacaagggccagcccagcctgagcagcagcaccgaggtggtggtgatggtgctggacatcaacgacaacaaccccatcttcgcccaggccctgtacaaggtggagatcaacgagaacaccctgaccggcaccgacatcatccaggtgttcgccgccgacggcgacgagggcaccaacggccaggtgagatacggcatcgtgaacggcaacaccaaccaggagttcagaatcgacagcgtgaccggcgccatcaccgtggccaagcccctggacagagagaagacccccacctaccacctgaccgtgcaggccaccgacagaggcagcacccccagaaccgacaccagcaccgtgagcatcgtgctgctggacatcaacgacttcgtgcccgtgttcgagctgagcccctacagcgtgaacgtgcccgagaacctgggcaccctgcccagaaccatcctgcaggtggtggccagagacgacgacagaggcagcaacagcaagctgagctacgtgctgttcggcggcaacgaggacaacgccttcaccctgagcgccagcggcgagctgggcgtgacccagagcctggacagagagaccaaggagagattcgtgctgatgatcaccgccaccgacagcggcagccccgccctgaccggcaccggcaccatcaacgtgatcgtggacgacgtgaacgacaacgtgcccaccttcgccagcaaggcctacttcaccaccatccccgaggacgcccccaccggcaccgacgtgctgctggtgaacgccagcgacgccgacgccagcaagaacgccgtgatcagaatcatcggcggcaacagccagttcaccatcaaccccagcaccggccagatcatcaccagcgccctgctggacagagagaccaaggacaactacaccctggtggtggtgtgcagcgacgccggcagccccgagcccctgagcagcagcaccagcgtgctggtgaccgtgaccgacgtgaacgacaacccccccagattccagcaccacccctacgtgacccacatccccagccccaccctgcccggcagcttcgtgttcgccgtgaccgtgaccgacgccgacatcggccccaacagcgagctgcactacagcctgagcggcagaaacagcgagaagttccacatcgaccccctgagaggcgccatcatggccgccggccccctgaacggcgccagcgaggtgaccttcagcgtgcacgtgaaggacggcggcagcttccccaagaccgacagcaccaccgtgaccgtgagattcgtgaacaaggccgacttccccaaggtgagagccaaggagcagaccttcatgttccccgagaaccagcccgtgagcagcctggtgaccaccatcaccggcagcagcctgagaggcgagcccatgagctactacatcgccagcggcaacctgggcaacaccttccagatcgaccagctgaccggccaggtgagcatcagccagcccctggacttcgagaagatccagaagtacgtggtgtggatcgaggccagagacggcggcttcccccccttcagcagctacgagaagctggacatcaccgtgctggacgtgaacgacaacgcccccatcttcaaggaggaccccttcatcagcgagatcctggagaacctgagccccagaaagatcctgaccgtgagcgccatggacaaggacagcggccccaacggccagctggactacgagatcgtgaacggcaacatggagaacagcttcagcatcaaccacgccaccggcgagatcagaagcgtgagacccctggacagagagaaggtgagccactacgtgctgaccatcaagagcagcgacaagggcagccccagccagagcaccagcgtgaaggtgatgatcaacatcctggacgagaacgacaacgcccccagattcagccagatcttcagcgcccacgtgcccgagaacagccccctgggctacaccgtgaccagagtgaccaccagcgacgaggacatcggcatcaacgccatcagcagatacagcatcatggacgccagcctgcccttcaccatcaaccccagcaccggcgacatcgtgatcagcagacccctgaacagagaggacaccgacagatacagaatcagagtgagcgcccacgacagcggctggaccgtgagcaccgacgtgaccatcttcgtgaccgacatcaacgacaacgcccccagattcagcagaaccagctactacctggactgccccgagctgaccgagatcggcagcaaggtgacccaggtgttcgccaccgaccccgacgagggcagcaacggccaggtgttctacttcatcaagagccagagcgagtacttcagaatcaacgccaccaccggcgagatcttcaacaagcagatcctgaagtaccagaacgtgaccggcttcagcaacgtgaacatcaacagacacagcttcatcgtgaccagcagcgacagaggcaagcccagcctgatcagcgagaccaccgtgaccatcaacatcgtggacagcaacgacaacgccccccagttcctgaagagcaagtacttcacccccgtgaccaagaacgtgaaggtgggcaccaagctgatcagagtgaccgccatcgacgacaaggacttcggcctgaacagcgaggtggagtacttcatcagcaacgacaaccacctgggcaagttcaagctggacaacgacaccggctggatcagcgtggccagcagcctgatcagcgacctgaaccagaacttcttcatcaccgtgaccgccaaggacaagggcaacccccccctgagcagccaggccaccgtgcacatcaccgtgaccgaggagaactaccacacccccgagttcagccagagccacatgagcgccaccatccccgagagccacagcatcggcagcatcgtgagaaccgtgagcgccagagacagagacgccgccatgaacggcctgatcaagtacagcatcagcagcggcaacgaggagggcatcttcgccatcaacagcagcaccggcatcctgaccctggccaaggccctggactacgagctgtgccagaagcacgagatgaccatcagcgccatcgacggcggctgggtggccagaaccggctactgcagcgtgaccgtgaacgtgatcgacgtgaacgacaacagccccgtgttcctgagcgacgactacttccccaccgtgctggagaacgcccccagcggcaccaccgtgatccacctgaacgccaccgacgccgacagcggcaccaacgccgtgatcgcctacaccgtgcagagcagcgacagcgacctgttcgtgatcgaccccaacaccggcgtgatcaccacccagggcttcctggacttcgagaccaagcagagctaccacctgaccgtgaaggccttcaacgtgcccgacgaggagagatgcagcttcgccaccgtgaacatccagctgaagggcaccaacgagtacgtgcccagattcgtgagcaagctgtactacttcgagatcagcgaggccgcccccaagggcaccatcgtgggcgaggtgttcgccagcgacagagacctgggcaccgacggcgaggtgcactacctgatcttcggcaacagcagaaagaagggcttccagatcaacaagaagaccggccagatctacgtgagcggcatcctggacagagagaaggaggagagagtgagcctgaaggtgctggccaagaacttcggcagcatcagaggcgccgacatcgacgaggtgaccgtgaacgtgaccgtgctggacgccaacgacccccccatcttcaccctgaacatctacagcgtgcagatcagcgagggcgtgcccatcggcacccacgtgaccttcgtgagcgccttcgacagcgacagcatccccagctggagcagattcagctacttcatcggcagcggcaacgagaacggcgccttcagcatcaacccccagaccggccagatcaccgtgaccgccgagctggacagagagaccctgcccatctacaacctgagcgtgctggccgtggacagcggcacccccagcgccaccggcagcgccagcctgctggtgaccctggaggacatcaacgacaacggccccatgctgaccgtgagcgagggcgaggtgatggagaacaagagacccggcaccctggtgatgaccctgcagagcaccgaccccgacctgccccccaaccagggccccttcacctactacctgctgagcaccggccccgccaccagctacttcagcctgagcaccgccggcgtgctgagcaccaccagagagatcgacagagagcagatcgccgacttctacctgagcgtggtgaccaaggacagcggcgtgccccagatgagcagcaccggcaccgtgcacatcaccgtgatcgaccagaacgacaaccccagccagagcagaaccgtggagatcttcgtgaactactacggcaacctgttccccggcggcatcctgggcagcgtgaagccccaggaccccgacgtgctggacagcttccactgcagcctgaccagcggcgtgaccagcctgttcagcatccccggcggcacctgcgacctgaacagccagcccagaagcaccgacggcaccttcgacctgaccgtgctgagcaacgacggcgtgcacagcaccgtgaccagcaacatcagagtgttcttcgccggcttcagcaacgccaccgtggacaacagcatcctgctgagactgggcgtgcccaccgtgaaggacttcctgaccaaccactacctgcacttcctgagaatcgccagcagccagctgaccggcctgggcaccgccgtgcagctgtacagcgcctacgaggagaacaacagaaccttcctgctggccgccgtgaagagaaaccacaaccagtacgtgaaccccagcggcgtggccaccttcttcgagagcatcaaggagatcctgctgagacagagcggcgtgaaggtggagagcgtggaccacgacagctgcgtgcacggcccctgccagaacggcggcagctgcctgagaagactggccgtgagcagcgtgctgaagagcagagagagcctgcccgtgatcatcgtggccaacgagcccctgcagcccttcctgtgcaagtgcctgcccggctacgccggcagctggtgcgagatcgacatcgacgagtgcctgcccagcccctgccacagcggcggcacctgccacaacctggtgggcggcttcagctgcagctgccccgacggcttcaccggcagagcctgcgagagagacatcaacgagtgcctgcagagcccctgcaagaacggcgccatctgccagaacttccccggcagcttcaactgcgtgtgcaagaccggctacaccggcgtgttcggcaagcactgcgagctgaacagctacggcttcgaggagctgagctacatggagttccccagcctggaccccaacaacaactacatctacgtgaagttcgccaccatcaagagccacgccctgctgctgtacaactacgacaaccagaccggcgacagagccgagttcctggccctggagatcgccgaggagagactgagattcagctacaacctgggcagcggcacctacaagctgaccaccatgaagaaggtgagcgacggccacttccacaccgtgatcgccagaagagccggcatggccgccagcctgaccgtggacagctgcagcgagaaccaggagcccggctactgcaccgtgagcaacgtggccgtgagcgacgactggaccctggacgtgcagcccaacagagtgaccgtgggcggcatcagaagcctggagcccatcctgcagagaagaggccacgtggagagccacgacttcgtgggctgcatcatggagttcgccgtgaacggcagacccctggagcccagccaggccctggccgcccagggcatcctggaccagtacggcgacttcatcagctactgcttcaaggagaagaagtgcaagaaggtgtgcttcaccgtgacccccgacaccgccctgagcctggagggcaagggcagactggactaccacatgagccagaacgagaagagagagtacctgctgagacagagcctgagaggcgccatgctggagcccttcggcgtgaacagcctggaggtgaagttcagaaccagaagcgagaacggcgtgctgatccacatccaggagagcagcaactacaccaccgtgaagatcaagaacggcaaggtgtacttcaccagcgacgccggcatcgccggcaaggtggagagaaacatccccgaggtgtacgtggccgacggccactggcacaccttcctgatcggcaagaacggcaccgccaccgtgctgagcgtggacagaatctacaacagagacatcatccaccccacccaggacttcggcggcctggacgtgctgaccatcagcctgggcggcatcccccccaaccaggcccacagagacgcccagaccgccggcttcgacggctgcatcgccagcatgtggtacggcggcgagagcctgcccttcagcggcaagcacagcctggccagcatcagcaagaccgaccccagcgtgaagatcggctgcagaggccccaacatctgcgccagcaacccctgctggggcgacctgctgtgcatcaaccagtggtacgcctacagatgcgtgccccccggcgactgcgccagccacccctgccagaacggcggcagctgcgagcccggcctgcacagcggcttcacctgcagctgccccgacagccacaccggcagaacctgcgagatggtggtggcctgcctgggcgtgctgtgcccccagggcaaggtgtgcaaggccggcagccccgccggccacgtgtgcgtgctgagccagggccccgaggagatcagcctgcccctgtgggccgtgcccgccatcgtgggcagctgcgccaccgtgctggccctgctggtgctgagcctgatcctgtgcaaccagtgcagaggcaagaaggccaagaaccccaaggaggagaagaagcccaaggagaagaagaagaagggcagcgagaacgtggccttcgacgaccccgacaacatccccccctacggcgacgacatgaccgtgagaaagcagcccgagggcaaccccaagcccgacatcatcgagagagagaacccctacctgatctacgacgagaccgacatcccccacaacagcgagaccatccccagcgcccccctggccagccccgagcaggagatcgagcactacgacatcgacaacgccagcagcatcgcccccagcgacgccgacatcatccagcactacaagcagttcagaagccacacccccaagttcagcatccagagacacagccccctgggcttcgccagacagagccccatgcccctgggcgccagcagcctgacctaccagcccagctacggccagggcctgagaaccagcagcctgagccacagcgcctgccccacccccaaccccctgagcagacacagccccgcccccttcagcaagagcagcaccttctacagaaacagccccgccagagagctgcacctgcccatcagagacggcaacaccctggagatgcacggcgacacctgccagcccggcatcttcaactacgccaccagactgggcagaagaagcaagagcccccaggccatggccagccacggcagcagacccggcagcagactgaagcagcccatcggccagatccccctggagagcagcccccccgtgggcctgagcatcgaggaggtggagagactgaacacccccagacccagaaaccccagcatctgcagcgccgaccacggcagaagcagcagcgaggaggactgcagaagacccctgagcagaaccagaaaccccgccgacggcatccccgcccccgagagcagcagcgacagcgacagccacgagagcttcacctgcagcgagatggagtacgacagagagaagcccatggtgtacaccagcagaatgcccaagctgagccaggtgaacgagagcgacgccgacgacgaggacaactacggcgccagactgaagcccagaagataccacggcagaagagccgagggcggccccgtgggcacccaggccgccgcccccggcaccgccgacaacaccctgcccatgaagctgggccagcaggccggcaccttcaactgggacaacctgctgaactggggccccggcttcggccactacgtggacgtgttcaaggacctggccagcctgcccgagaaggccgccgccaacgaggagggcaaggccggcaccaccaagcccgtgcccaaggacggcgaggccgagcagtacgtgtag

SEQ ID NO: 81317 - DNA, 14946 bp, Artificial Sequence
  Description of Artificial Sequence: Synthetic coding sequence
atggacctggcccccgacagagccaccggcagaccctggctgcccctgcacaccctgagcgtgagccagctgctgagagtgttctggctgctgagcctgctgcccggccaggcctgggtgcacggcgccgagcccagacaggtgttccaggtgctggaggagcagccccccggcaccctggtgggcaccatccagaccagacccggcttcacctacagactgagcgagagccacgccctgttcgccatcaacagcagcaccggcgccctgtacaccaccagcaccatcgacagagagagcctgcccagcgacgtgatcaacctggtggtgctgagcagcgcccccacctaccccaccgaggtgagagtgctggtgagagacctgaacgacaacgcccccgtgttccccgaccccagcatcgtggtgaccttcaaggaggacagcagcagcggcagacaggtgatcctggacaccgccaccgacagcgacatcggcagcaacggcgtggaccacagaagctacagaatcatcagaggcaacgaggccggcagattcagactggacatcaccctgaaccccagcggcgagggcgccttcctgcacctggtgagcaagggcggcctggacagagaggtgaccccccagtaccagctgctggtggaggtggaggacaagggcgagcccaagagaagaggctacctgcaggtgaacgtgaccgtgcaggacatcaacgacaacccccccgtgttcggcagcagccactaccaggccggcgtgcccgaggacgccgtggtgggcagcagcgtgctgcaggtggccgccgccgacgccgacgagggcaccaacgccgacatcagatacagactgcaggacgagggcacccccttccagatggaccccgagaccggcctgatcaccgtgagagagcccctggacttcgaggccagaagacagtacagcctgaccgtgcaggccatggacagaggcgtgcccagcctgaccggcagagccgaggccctgatccagctgctggacgtgaacgacaacgaccccgtggtgaagttcagatacttccccgccaccagcagatacgccagcgtggacgagaacgcccaggtgggcaccgtggtggccctgctgaccgtgaccgacgccgacagccccgccgccaacggcaacatcagcgtgcagatcctgggcggcaacgagcagagacacttcgaggtgcagagcagcaaggtgcccaacctgagcctgatcaaggtggccagcgccctggacagagagagaatccccagctacaacctgaccgtgagcgtgagcgacaactacggcgccccccccggcgccgccgtgcaggccagaagcagcgtggccagcctggtgatcttcgtgaacgacatcaacgaccacccccccgtgttcagccagcaggtgtacagagtgaacctgagcgaggaggccccccccggcagctacgtgagcggcatcagcgccaccgacggcgacagcggcctgaacgccaacctgagatacagcatcgtgagcggcaacggcctgggctggttccacatcagcgagcacagcggcctggtgaccaccggcagcagcggcggcctggacagagagctggccagccagatcgtgctgaacatcagcgccagagaccagggcgtgcaccccaaggtgagctacgcccagctggtggtgaccctgctggacgtgaacgacgagaagcccgtgttcagccagcccgagggctacgacgtgagcgtggtggagaacgcccccaccggcaccgagctgctgatgctgagagccaccgacggcgacctgggcgacaacggcaccgtgagattcagcctgcaggaggccgagaccgacagaagaagcttcagactggaccccgtgagcggcagactgagcaccatcagcagcctggacagagaggagcaggccttctacagcctgctggtgctggccaccgacctgggcagccccccccagagcagcatggccagaatcaacgtgagcctgctggacatcaacgacaacagccccgtgttctaccccgtgcagtacttcgcccacatcaaggagaacgagcccggcggcagctacatcaccaccgtgagcgccaccgaccccgacctgggcaccaacggcaccgtgaagtacagcatcagcgccggcgacagaagcagattccaggtgaacgcccagagcggcgtgatcagcaccagaatggccctggacagagaggagaagaccgcctaccagctgcagatcgtggccaccgacggcggcaacctgcagagccccaaccaggccatcgtgaccatcaccgtgctggacacccaggacaacccccccgtgttcagccaggtggcctacagcttcgtggtgttcgagaacgtggccctgggctaccacgtgggcagcgtgagcgccagcaccatggacctgaacagcaacatcagctacctgatcaccaccggcgaccagaagggcatgttcgccatcaaccaggtgaccggccagctgaccaccgccaacgtgatcgacagagaggagcagagcttctaccagctgaaggtggtggccagcggcggcaccgtgaccggcgacaccatggtgaacatcaccgtgaaggacctgaacgacaacagcccccacttcctgcaggccatcgagagcgtgaacgtggtggagaactggcaggccggccacagcatcttccaggccaaggccgtggaccccgacgagggcgtgaacggcatggtgctgtacagcctgaagcagaaccccaagaacctgttcgccatcaacgagaagaacggcaccatcagcctgctgggccccctggacgtgcacgccggcagctaccagatcgagatcctggccagcgacatgggcgtgccccagctgagcagcagcgtgatcctgaccgtgtacgtgcacgacgtgaacgacaacagccccgtgttcgaccagctgagctacgaggtgaccctgagcgagagcgagcccgtgaacagcagattcttcaaggtgcaggccagcgacaaggacagcggcgccaacggcgagatcgcctacaccatcgccgagggcaacaccggcgacgccttcggcatcttccccgacggccagctgtacatcaagagcgagctggacagagagctgcaggacagatacgtgctgatggtggtggccagcgacagagccgtggagcccctgagcgccaccgtgaacgtgaccgtgatcctggaggacgtgaacgacaacagacccctgttcaacagcaccaactacaccttctacttcgaggaggagcagagagccggcagcttcgtgggcaaggtgagcgccgtggacaaggacttcggccccaacggcgaggtgagatacagcttcgagatggtgcagcccgacttcgagctgcacgccatcagcggcgagatcaccaacacccaccagttcgacagagagagcctgatgagaagaagaggcaccgccgtgttcagcttcaccgtgatcgccaccgaccagggcatcccccagcccctgaaggaccaggccaccgtgcacgtgtacatgaaggacatcaacgacaacgcccccaagttcctgaaggacttctaccaggccaccatcagcgagagcgccgccaacctgacccaggtgctgagagtgagcgccagcgacgtggacgagggcaacaacggcctgatccactacagcatcatcaagggcaacgaggagagacagttcgccatcgacagcaccagcggccaggtgaccctgatcggcaagctggactacgaggccacccccgcctacagcctggtgatccaggccgtggacagcggcaccatccccctgaacagcacctgcaccctgaacatcgacatcctggacgagaacgacaacacccccagcttccccaagagcaccctgttcgtggacgtgctggagaacatgagaatcggcgagctggtgagcagcgtgaccgccaccgacagcgacagcggcgacaacgccgacctgtactacagcatcaccggcaccaacaaccacggcaccttcagcatcagccccaacaccggcagcatcttcctggccaagaagctggacttcgagacccagagcctgtacaagctgaacatcaccgccaaggaccagggcagaccccccagaagcagcaccatgagcgtggtgatccacgtgagagacttcaacgacaacccccccagcttcccccccggcgacatcttcaagagcatcgtggagaacatccccatcggcaccagcgtgatcagcgtgaccgcccacgaccccgacgccgacatcaacggccagctgagctacaccatcatccagcagatgcccagaggcaaccacttcaccatcgacgaggtgaagggcaccatctacaccaacgccgagatcgacagagagttcgccaacctgttcgagctgaccgtgaaggccaacgaccaggccgtgcccatcgagaccagaagatacgccctgaagaacgtgaccatcctggtgaccgacctgaacgacaacgtgcccatgttcatcagccagaacgccctggccgccgaccccagcgccgtgatcggcagcgtgctgaccaccatcatggccgccgaccccgacgagggcgccaacggcgagatcgagtacgagatcatcaacggcgacaccgacaccttcatcgtggacagatacagcggcgacctgagagtggccagcgccctggtgcccagccagctgatctacaacctgatcgtgagcgccaccgacctgggccccgagagaagaaagagcaccaccgagctgaccatcatcctgcagggcctggacggccccgtgttcacccagcccaagtacatcaccatcctgaaggagggcgagcccatcggcaccaacgtgatcagcatcgaggccgccagccccagaggcagcgaggcccccgtggagtactacatcgtgagcgtgagatgcgaggagaagaccgtgggcagactgttcaccatcggcagacacaccggcatcatccagaccgccgccatcctggacagagagcagggcgcctgcctgtacctggtggacgtgtacgccatcgagaagagcaccgccttccccagaacccagagagccgaggtggagatcaccctgcaggacatcaacgacaacccccccgtgttccccaccgacatgctggacctgaccgtggaggagaacatcggcgacggcagcaagatcatgcagctgaccgccatggacgccgacgagggcgccaacgccctggtgacctacaccatcatcagcggcgccgacgacagcttcagaatcgaccccgagagcggcgacctgatcgccaccagaagactggacagagagagaagaagcaagtacagcctgctggtgagagccgacgacggcctgcagagcagcgacatgagaatcaacatcaccgtgagcgacgtgaacgaccacacccccaagttcagcagacccgtgtacagcttcgacatccccgaggacaccatccccggcagcctggtggccgccatcctggccaccgacgacgacagcggcgtgaacggcgagatcacctacatcgtgaacgaggacgacgaggacggcatcttcttcctgaaccccatcaccggcgtgttcaacctgaccagactgctggactacgaggtgcagcagtactacatcctgaccgtgagagccgaggacggcggcggccagttcaccaccatcagagtgtacttcaacatcctggacgtgaacgacaacccccccatcttcagcctgaacagctacagcaccagcctgatggagaacctgcccgtgggcagcaccgtgctggtgttcaacgtgaccgacgccgacgacggcatcaacagccagctgacctacagcatcgccagcggcgacagcctgggccagttcaccgtggacaagaacggcgtgctgaaggtgctgaaggccctggacagagagagccagagcttctacaacctggtggtgcaggtgcacgacctgccccagatccccgccagcagattcaccagcaccgcccaggtgagcatcatcctgctggacgtgaacgacaacccccccaccttcctgagccccaagctgacctacatccccgagaacacccccatcgacaccgtggtgttcaaggcccaggccaccgaccccgacagcggccccaacagctacatcgagtacaccctgctgaaccccctgggcaacaagttcagcatcggcaccatcgacggcgaggtgagactgaccggcgagctggacagagaggaggtgagcaactacaccctgaccgtggtggccaccgacaagggccagcccagcctgagcagcagcaccgaggtggtggtgatggtgctggacatcaacgacaacaaccccatcttcgcccaggccctgtacaaggtggagatcaacgagaacaccctgaccggcaccgacatcatccaggtgttcgccgccgacggcgacgagggcaccaacggccaggtgagatacggcatcgtgaacggcaacaccaaccaggagttcagaatcgacagcgtgaccggcgccatcaccgtggccaagcccctggacagagagaagacccccacctaccacctgaccgtgcaggccaccgacagaggcagcacccccagaaccgacaccagcaccgtgagcatcgtgctgctggacatcaacgacttcgtgcccgtgttcgagctgagcccctacagcgtgaacgtgcccgagaacctgggcaccctgcccagaaccatcctgcaggtggtggccagagacgacgacagaggcagcaacagcaagctgagctacgtgctgttcggcggcaacgaggacaacgccttcaccctgagcgccagcggcgagctgggcgtgacccagagcctggacagagagaccaaggagagattcgtgctgatgatcaccgccaccgacagcggcagccccgccctgaccggcaccggcaccatcaacgtgatcgtggacgacgtgaacgacaacgtgcccaccttcgccagcaaggcctacttcaccaccatccccgaggacgcccccaccggcaccgacgtgctgctggtgaacgccagcgacgccgacgccagcaagaacgccgtgatcagaatcatcggcggcaacagccagttcaccatcaaccccagcaccggccagatcatcaccagcgccctgctggacagagagaccaaggacaactacaccctggtggtggtgtgcagcgacgccggcagccccgagcccctgagcagcagcaccagcgtgctggtgaccgtgaccgacgtgaacgacaacccccccagattccagcaccacccctacgtgacccacatccccagccccaccctgcccggcagcttcgtgttcgccgtgaccgtgaccgacgccgacatcggccccaacagcgagctgcactacagcctgagcggcagaaacagcgagaagttccacatcgaccccctgagaggcgccatcatggccgccggccccctgaacggcgccagcgaggtgaccttcagcgtgcacgtgaaggacggcggcagcttccccaagaccgacagcaccaccgtgaccgtgagattcgtgaacaaggccgacttccccaaggtgagagccaaggagcagaccttcatgttccccgagaaccagcccgtgagcagcctggtgaccaccatcaccggcagcagcctgagaggcgagcccatgagctactacatcgccagcggcaacctgggcaacaccttccagatcgaccagctgaccggccaggtgagcatcagccagcccctggacttcgagaagatccagaagtacgtggtgtggatcgaggccagagacggcggcttcccccccttcagcagctacgagaagctggacatcaccgtgctggacgtgaacgacaacgcccccatcttcaaggaggaccccttcatcagcgagatcctggagaacctgagccccagaaagatcctgaccgtgagcgccatggacaaggacagcggccccaacggccagctggactacgagatcgtgaacggcaacatggagaacagcttcagcatcaaccacgccaccggcgagatcagaagcgtgagacccctggacagagagaaggtgagccactacgtgctgaccatcaagagcagcgacaagggcagccccagccagagcaccagcgtgaaggtgatgatcaacatcctggacgagaacgacaacgcccccagattcagccagatcttcagcgcccacgtgcccgagaacagccccctgggctacaccgtgaccagagtgaccaccagcgacgaggacatcggcatcaacgccatcagcagatacagcatcatggacgccagcctgcccttcaccatcaaccccagcaccggcgacatcgtgatcagcagacccctgaacagagaggacaccgacagatacagaatcagagtgagcgcccacgacagcggctggaccgtgagcaccgacgtgaccatcttcgtgaccgacatcaacgacaacgcccccagattcagcagaaccagctactacctggactgccccgagctgaccgagatcggcagcaaggtgacccaggtgttcgccaccgaccccgacgagggcagcaacggccaggtgttctacttcatcaagagccagagcgagtacttcagaatcaacgccaccaccggcgagatcttcaacaagcagatcctgaagtaccagaacgtgaccggcttcagcaacgtgaacatcaacagacacagcttcatcgtgaccagcagcgacagaggcaagcccagcctgatcagcgagaccaccgtgaccatcaacatcgtggacagcaacgacaacgccccccagttcctgaagagcaagtacttcacccccgtgaccaagaacgtgaaggtgggcaccaagctgatcagagtgaccgccatcgacgacaaggacttcggcctgaacagcgaggtggagtacttcatcagcaacgacaaccacctgggcaagttcaagctggacaacgacaccggctggatcagcgtggccagcagcctgatcagcgacctgaaccagaacttcttcatcaccgtgaccgccaaggacaagggcaacccccccctgagcagccaggccaccgtgcacatcaccgtgaccgaggagaactaccacacccccgagttcagccagagccacatgagcgccaccatccccgagagccacagcatcggcagcatcgtgagaaccgtgagcgccagagacagagacgccgccatgaacggcctgatcaagtacagcatcagcagcggcaacgaggagggcatcttcgccatcaacagcagcaccggcatcctgaccctggccaaggccctggactacgagctgtgccagaagcacgagatgaccatcagcgccatcgacggcggctgggtggccagaaccggctactgcagcgtgaccgtgaacgtgatcgacgtgaacgacaacagccccgtgttcctgagcgacgactacttccccaccgtgctggagaacgcccccagcggcaccaccgtgatccacctgaacgccaccgacgccgacagcggcaccaacgccgtgatcgcctacaccgtgcagagcagcgacagcgacctgttcgtgatcgaccccaacaccggcgtgatcaccacccagggcttcctggacttcgagaccaagcagagctaccacctgaccgtgaaggccttcaacgtgcccgacgaggagagatgcagcttcgccaccgtgaacatccagctgaagggcaccaacgagtacgtgcccagattcgtgagcaagctgtactacttcgagatcagcgaggccgcccccaagggcaccatcgtgggcgaggtgttcgccagcgacagagacctgggcaccgacggcgaggtgcactacctgatcttcggcaacagcagaaagaagggcttccagatcaacaagaagaccggccagatctacgtgagcggcatcctggacagagagaaggaggagagagtgagcctgaaggtgctggccaagaacttcggcagcatcagaggcgccgacatcgacgaggtgaccgtgaacgtgaccgtgctggacgccaacgacccccccatcttcaccctgaacatctacagcgtgcagatcagcgagggcgtgcccatcggcacccacgtgaccttcgtgagcgccttcgacagcgacagcatccccagctggagcagattcagctacttcatcggcagcggcaacgagaacggcgccttcagcatcaacccccagaccggccagatcaccgtgaccgccgagctggacagagagaccctgcccatctacaacctgagcgtgctggccgtggacagcggcacccccagcgccaccggcagcgccagcctgctggtgaccctggaggacatcaacgacaacggccccatgctgaccgtgagcgagggcgaggtgatggagaacaagagacccggcaccctggtgatgaccctgcagagcaccgaccccgacctgccccccaaccagggccccttcacctactacctgctgagcaccggccccgccaccagctacttcagcctgagcaccgccggcgtgctgagcaccaccagagagatcgacagagagcagatcgccgacttctacctgagcgtggtgaccaaggacagcggcgtgccccagatgagcagcaccggcaccgtgcacatcaccgtgatcgaccagaacgacaaccccagccagagcagaaccgtggagatcttcgtgaactactacggcaacctgttccccggcggcatcctgggcagcgtgaagccccaggaccccgacgtgctggacagcttccactgcagcctgaccagcggcgtgaccagcctgttcagcatccccggcggcacctgcgacctgaacagccagcccagaagcaccgacggcaccttcgacctgaccgtgctgagcaacgacggcgtgcacagcaccgtgaccagcaacatcagagtgttcttcgccggcttcagcaacgccaccgtggacaacagcatcctgctgagactgggcgtgcccaccgtgaaggacttcctgaccaaccactacctgcacttcctgagaatcgccagcagccagctgaccggcctgggcaccgccgtgcagctgtacagcgcctacgaggagaacaacagaaccttcctgctggccgccgtgaagagaaaccacaaccagtacgtgaaccccagcggcgtggccaccttcttcgagagcatcaaggagatcctgctgagacagagcggcgtgaaggtggagagcgtggaccacgacagctgcgtgcacggcccctgccagaacggcggcagctgcctgagaagactggccgtgagcagcgtgctgaagagcagagagagcctgcccgtgatcatcgtggccaacgagcccctgcagcccttcctgtgcaagtgcctgcccggctacgccggcagctggtgcgagatcgacatcgacgagtgcctgcccagcccctgccacagcggcggcacctgccacaacctggtgggcggcttcagctgcagctgccccgacggcttcaccggcagagcctgcgagagagacatcaacgagtgcctgcagagcccctgcaagaacggcgccatctgccagaacttccccggcagcttcaactgcgtgtgcaagaccggctacaccggcaagatgtgcgagagcagcgtgaactactgcgagtgcaacccctgcttcaacggcggcagctgccagagcggcgtggacagctactactgccactgccccttcggcgtgttcggcaagcactgcgagctgaacagctacggcttcgaggagctgagctacatggagttccccagcctggaccccaacaacaactacatctacgtgaagttcgccaccatcaagagccacgccctgctgctgtacaactacgacaaccagaccggcgacagagccgagttcctggccctggagatcgccgaggagagactgagattcagctacaacctgggcagcggcacctacaagctgaccaccatgaagaaggtgagcgacggccacttccacaccgtgatcgccagaagagccggcatggccgccagcctgaccgtggacagctgcagcgagaaccaggagcccggctactgcaccgtgagcaacgtggccgtgagcgacgactggaccctggacgtgcagcccaacagagtgaccgtgggcggcatcagaagcctggagcccatcctgcagagaagaggccacgtggagagccacgacttcgtgggctgcatcatggagttcgccgtgaacggcagacccctggagcccagccaggccctggccgcccagggcatcctggaccagtgccccagactggagggcgcctgcaccagaagcccctgccagcacggcggcacctgcatggactactggagctggcagcagtgccactgcaaggagggcctgaccggcaagtactgcgagaagagcgtgacccccgacaccgccctgagcctggagggcaagggcagactggactaccacatgagccagaacgagaagagagagtacctgctgagacagagcctgagaggcgccatgctggagcccttcggcgtgaacagcctggaggtgaagttcagaaccagaagcgagaacggcgtgctgatccacatccaggagagcagcaactacaccaccgtgaagatcaagaacggcaaggtgtacttcaccagcgacgccggcatcgccggcaaggtggagagaaacatccccgaggtgtacgtggccgacggccactggcacaccttcctgatcggcaagaacggcaccgccaccgtgctgagcgtggacagaatctacaacagagacatcatccaccccacccaggacttcggcggcctggacgtgctgaccatcagcctgggcggcatcccccccaaccaggcccacagagacgcccagaccgccggcttcgacggctgcatcgccagcatgtggtacggcggcgagagcctgcccttcagcggcaagcacagcctggccagcatcagcaagaccgaccccagcgtgaagatcggctgcagaggccccaacatctgcgccagcaacccctgctggggcgacctgctgtgcatcaaccagtggtacgcctacagatgcgtgccccccggcgactgcgccagccacccctgccagaacggcggcagctgcgagcccggcctgcacagcggcttcacctgcagctgccccgacagccacaccggcagaacctgcgagatggtggtggcctgcctgggcgtgctgtgcccccagggcaaggtgtgcaaggccggcagccccgccggccacgtgtgcgtgctgagccagggccccgaggagatcagcctgcccctgtgggccgtgcccgccatcgtgggcagctgcgccaccgtgctggccctgctggtgctgagcctgatcctgtgcaaccagtgcagaggcaagaaggccaagaaccccaaggaggagaagaagcccaaggagaagaagaagaagggcagcgagaacgtggccttcgacgaccccgacaacatccccccctacggcgacgacatgaccgtgagaaagcagcccgagggcaaccccaagcccgacatcatcgagagagagaacccctacctgatctacgacgagaccgacatcccccacaacagcgagaccatccccagcgcccccctggccagccccgagcaggagatcgagcactacgacatcgacaacgccagcagcatcgcccccagcgacgccgacatcatccagcactacaagcagttcagaagccacacccccaagttcagcatccagagacacagccccctgggcttcgccagacagagccccatgcccctgggcgccagcagcctgacctaccagcccagctacggccagggcctgagaaccagcagcctgagccacagcgcctgccccacccccaaccccctgagcagacacagccccgcccccttcagcaagagcagcaccttctacagaaacagccccgccagagagctgcacctgcccatcagagacggcaacaccctggagatgcacggcgacacctgccagcccggcatcttcaactacgccaccagactgggcagaagaagcaagagcccccaggccatggccagccacggcagcagacccggcagcagactgaagcagcccatcggccagatccccctggagagcagcccccccgtgggcctgagcatcgaggaggtggagagactgaacacccccagacccagaaaccccagcatctgcagcgccgaccacggcagaagcagcagcgaggaggactgcagaagacccctgagcagaaccagaaaccccgccgacggcatccccgcccccgagagcagcagcgacagcgacagccacgagagcttcacctgcagcgagatggagtacgacagagagaagcccatggtgtacaccagcagaatgcccaagctgagccaggtgaacgagagcgacgccgacgacgaggacaactacggcgccagactgaagcccagaagataccacggcagaagagccgagggcggccccgtgggcacccaggccgccgcccccggcaccgccgacaacaccctgcccatgaagctgggccagcaggccggcaccttcaactgggacaacctgctgaactggggccccggcttcggccactacgtggacgtgttcaaggacctggccagcctgcccgagaaggccgccgccaacgaggagggcaaggccggcaccaccaagcccgtgcccaaggacggcgaggccgagcagtacgtgtag

SEQ ID NO: 81318 - DNA, 1239 bp, Artificial Sequence
  Description of Artificial Sequence: Synthetic coding sequence
atgggcctgcacctgagaccctacagagtgggcctgctgcccgacggcctgctgttcctgctgctgctgctgatgctgctggccgaccccgccctgcccgccggcagacacccccccgtggtgctggtgcccggcgacctgggcaaccagctggaggccaagctggacaagcccaccgtggtgcactacctgtgcagcaagaagaccgagagctacttcaccatctggctgaacctggagctgctgctgcccgtgatcatcgactgctggatcgacaacatcagactggtgtacaacaagaccagcagagccacccagttccccgacggcgtggacgtgagagtgcccggcttcggcaagaccttcagcctggagttcctggaccccagcaagagcagcgtgggcagctacttccacaccatggtggagagcctggtgggctggggctacaccagaggcgaggacgtgagaggcgccccctacgactggagaagagcccccaacgagaacggcccctacttcctggccctgagagagatgatcgaggagatgtaccagctgtacggcggccccgtggtgctggtggcccacagcatgggcaacatgtacaccctgtacttcctgcagagacagccccaggcctggaaggacaagtacatcagagccttcgtgagcctgggcgccccctggggcggcgtggccaagaccctgagagtgctggccagcggcgacaacaacagaatccccgtgatcggccccctgaagatcagagagcagcagagaagcgccgtgagcaccagctggctgctgccctacaactacacctggagccccgagaaggtgttcgtgcagacccccaccatcaactacaccctgagagactacagaaagttcttccaggacatcggcttcgaggacggctggctgatgagacaggacaccgagggcctggtggaggccaccatgccccccggcgtgcagctgcactgcctgtacggcaccggcgtgcccacccccgacagcttctactacgagagcttccccgacagagaccccaagatctgcttcggcgacggcgacggcaccgtgaacctgaagagcgccctgcagtgccaggcctggcagagcagacaggagcaccaggtgctgctgcaggagctgcccggcagcgagcacatcgagatgctggccaacgccaccaccctggcctacctgaagagagtgctgctgggcccctag

SEQ ID NO: 81319 - DNA, 480 bp, Artificial Sequence
  Description of Artificial Sequence: Synthetic coding sequence
atgttccccggcctgttcatgctgggcaccttcctgtggagcctgatcgagtacctgatccacagattcctgttccacatgaagccccccagcgacagctactacctgatcatgctgcacttcgtgatgcacggccagcaccacaaggcccccttcgacggcagcagactggtgttcccccccgtgcccgccagcctggtgatcggcgtgttctacctgtgcatgcagctgatcctgcccgaggccgtgggcggcaccgtgttcgccggcggcctgctgggctacgtgctgtacgacatgacccactactacctgcacttcggcagcccccacaagggcagctacctgtacagcctgaaggcccaccacgtgaagcaccacttcgcccaccagaagagcggcttcggcatcagcaccaagctgtgggactactgcttccacaccctgacccccgagaagccccacctgaagacccagtag

SEQ ID NO: 81320 - DNA, 1740 bp, Artificial Sequence
  Description of Artificial Sequence: Synthetic coding sequence
atggtgcagtacgagctgtgggccgccctgcccggcgccagcggcgtggccctggcctgctgcttcgtggccgccgccgtggccctgagatggagcggcagaagaaccgccagaggcgccgtggtgagagccagacagagacagagagccggcctggagaacatggacagagccgcccagagattcagactgcagaaccccgacctggacagcgaggccctgctggccctgcccctgccccagctggtgcagaagctgcacagcagagagctggcccccgaggccgtgctgttcacctacgtgggcaaggcctgggaggtgaacaagggcaccaactgcgtgaccagctacctggccgactgcgagacccagctgagccaggcccccagacagggcctgctgtacggcgtgcccgtgagcctgaaggagtgcttcacctacaagggccaggacagcaccctgggcctgagcctgaacgagggcgtgcccgccgagtgcgacagcgtggtggtgcacgtgctgaagctgcagggcgccgtgcccttcgtgcacaccaacgtgccccagagcatgttcagctacgactgcagcaaccccctgttcggccagaccgtgaacccctggaagagcagcaagagccccggcggcagcagcggcggcgagggcgccctgatcggcagcggcggcagccccctgggcctgggcaccgacatcggcggcagcatcagattccccagcagcttctgcggcatctgcggcctgaagcccaccggcaacagactgagcaagagcggcctgaagggctgcgtgtacggccaggaggccgtgagactgagcgtgggccccatggccagagacgtggagagcctggccctgtgcctgagagccctgctgtgcgaggacatgttcagactggaccccaccgtgccccccctgcccttcagagaggaggtgtacaccagcagccagcccctgagagtgggctactacgagaccgacaactacaccatgcccagccccgccatgagaagagccgtgctggagaccaagcagagcctggaggccgccggccacaccctggtgcccttcctgcccagcaacatcccccacgccctggagaccctgagcaccggcggcctgttcagcgacggcggccacaccttcctgcagaacttcaagggcgacttcgtggacccctgcctgggcgacctggtgagcatcctgaagctgccccagtggctgaagggcctgctggccttcctggtgaagcccctgctgcccagactgagcgccttcctgagcaacatgaagagcagaagcgccggcaagctgtgggagctgcagcacgagatcgaggtgtacagaaagaccgtgatcgcccagtggagagccctggacctggacgtggtgctgacccccatgctggcccccgccctggacctgaacgcccccggcagagccaccggcgccgtgagctacaccatgctgtacaactgcctggacttccccgccggcgtggtgcccgtgaccaccgtgaccgccgaggacgaggcccagatggagcactacagaggctacttcggcgacatctgggacaagatgctgcagaagggcatgaagaagagcgtgggcctgcccgtggccgtgcagtgcgtggccctgccctggcaggaggagctgtgcctgagattcatgagagaggtggagagactgatgacccccgagaagcagagcagctag

SEQ ID NO: 81321 - DNA, 456 bp, Artificial Sequence
  Description of Artificial Sequence: Synthetic coding sequence
agaagacagcaccccctgcccctgctgctgctgagacacctgagaccccaggcccacagagagcccccccaggtgtacaccagcagccagcccctgagagtgggctactacgagaccgacaactacaccatgcccagccccgccatgagaagagccgtgctggagaccaagcagagcctggaggccgccggccacaccctggtgcccttcctgcccagcaacatcccccacgccctggagaccctgagcaccggcggcctgttcagcgacggcggccacaccttcctgcagaacttcaagggcgacttcgtggacccctgcctgggcgacctggtgagcatcctgaagctgccccagtggctgaagggcctgctggccttcctggtgaagcccctgctgcccagactgagcgccttcctgagcaacatgaagagcagatgcagacccctgccctag

SEQ ID NO: 81322 - DNA, 1599 bp, Artificial Sequence
  Description of Artificial Sequence: Synthetic coding sequence
atggcccccagcttcaccgccagaatccagctgttcctgctgagagccctgggcttcctgatcggcctggtgggcagagccgccctggtgctgggcggccccaagttcgccagcaagacccccagacccgtgaccgagcccctgctgctgctgagcggcatgcagctggccaagctgatcagacagagaaaggtgaagtgcatcgacgtggtgcaggcctacatcaacagaatcaaggacgtgaaccccatgatcaacggcatcgtgaagtacagattcgaggaggccatgaaggaggcccacgccgtggaccagaagctggccgagaagcaggaggacgaggccaccctggagaacaagtggcccttcctgggcgtgcccctgaccgtgaaggaggccttccagctgcagggcatgcccaacagcagcggcctgatgaacagaagagacgccatcgccaagaccgacgccaccgtggtggccctgctgaagggcgccggcgccatccccctgggcatcaccaactgcagcgagctgtgcatgtggtacgagagcagcaacaagatctacggcagaagcaacaacccctacgacctgcagcacatcgtgggcggcagcagcggcggcgagggctgcaccctggccgccgcctgcagcgtgatcggcgtgggcagcgacatcggcggcagcatcagaatgcccgccttcttcaacggcatcttcggccacaagcccagccccggcgtggtgcccaacaagggccagttccccctggccgtgggcgcccaggagctgttcctgtgcaccggccccatgtgcagatacgccgaggacctggcccccatgctgaaggtgatggccggccccggcatcaagagactgaagctggacaccaaggtgcacctgaaggacctgaagttctactggatggagcacgacggcggcagcttcctgatgagcaaggtggaccaggacctgatcatgacccagaagaaggtggtggtgcacctggagaccatcctgggcgccagcgtgcagcacgtgaagctgaagaagatgaagtacagcttccagctgtggatcgccatgatgagcgccaagggccacgacggcaaggagcccgtgaagttcgtggacctgctgggcgaccacggcaagcacgtgagccccctgtgggagctgatcaagtggtgcctgggcctgagcgtgtacaccatccccagcatcggcctggccctgctggaggagaagctgagatacagcaacgagaagtaccagaagttcaaggccgtggaggagagcctgagaaaggagctggtggacatgctgggcgacgacggcgtgttcctgtaccccagccaccccaccgtggcccccaagcaccacgtgcccctgaccagacccttcaacttcgcctacaccggcgtgttcagcgccctgggcctgcccgtgacccagtgccccctgggcctgaacgccaagggcctgcccctgggcatccaggtggtggccggccccttcaacgaccacctgaccctggccgtggcccagtacctggagaagaccttcggcggctgggtgtgccccggcaagttctag

SEQ ID NO: 81323 - DNA, 384 bp, Artificial Sequence
  Description of Artificial Sequence: Synthetic coding sequence
atgagcttcagcggcaagtaccagctgcagagccaggagaacttcgaggccttcatgaaggccatcggcctgcccgaggagctgatccagaagggcaaggacatcaagggcgtgagcgagatcgtgcagaacggcaagcacttcaagttcaccatcaccgccggcagcaaggtgatccagaacgagttcaccgtgggcgaggagtgcgagctggagaccatgaccggcgagaaggtgaagaccgtggtgcagctggagggcgacaacaagctggtgaccaccttcaagaacatcaagagcgtgaccgagctgaacggcgacatcatcaccaacaccatgaccctgggcgacatcgtgttcaagagaatcagcaagagaatctag

SEQ ID NO: 81324 - DNA, 399 bp, Artificial Sequence
  Description of Artificial Sequence: Synthetic coding sequence
atggccttcgacagcacctggaaggtggacagaagcgagaactacgacaagttcatggagaagatgggcgtgaacatcgtgaagagaaagctggccgcccacgacaacctgaagctgaccatcacccaggagggcaacaagttcaccgtgaaggagagcagcaccttcagaaacatcgaggtggtgttcgagctgggcgtgaccttcaactacaacctggccgacggcaccgagctgagaggcacctggagcctggagggcaacaagctgatcggcaagttcaagagaaccgacaacggcaacgagctgaacaccgtgagagagatcatcggcgacgagctggtgcagacctacgtgtacgagggcgtggaggccaagagaatcttcaagaaggactag

SEQ ID NO: 81325 - DNA, 402 bp, Artificial Sequence
  Description of Artificial Sequence: Synthetic coding sequence
atggtggacgccttcctgggcacctggaagctggtggacagcaagaacttcgacgactacatgaagagcctgggcgtgggcttcgccaccagacaggtggccagcatgaccaagcccaccaccatcatcgagaagaacggcgacatcctgaccctgaagacccacagcaccttcaagaacaccgagatcagcttcaagctgggcgtggagttcgacgagaccaccgccgacgacagaaaggtgaagagcatcgtgaccctggacggcggcaagctggtgcacctgcagaagtgggacggccaggagaccaccctggtgagagagctgatcgacggcaagctgatcctgaccctgacccacggcaccgccgtgtgcaccagaacctacgagaaggaggcctag

SEQ ID NO: 81326 - DNA, 408 bp, Artificial Sequence
  Description of Artificial Sequence: Synthetic coding sequence
atggccaccgtgcagcagctggagggcagatggagactggtggacagcaagggcttcgacgagtacatgaaggagctgggcgtgggcatcgccctgagaaagatgggcgccatggccaagcccgactgcatcatcacctgcgacggcaagaacctgaccatcaagaccgagagcaccctgaagaccacccagttcagctgcaccctgggcgagaagttcgaggagaccaccgccgacggcagaaagacccagaccgtgtgcaacttcaccgacggcgccctggtgcagcaccaggagtgggacggcaaggagagcaccatcaccagaaagctgaaggacggcaagctggtggtggagtgcgtgatgaacaacgtgacctgcaccagaatctacgagaaggtggagtag

SEQ ID NO: 81327 - DNA, 534 bp, Artificial Sequence
  Description of Artificial Sequence: Synthetic coding sequence
atgaagaccgtgaccatgatgatggtggtggagatgcaggccctgacccaggtgctgagagccgtgctgagcgcctgcacctgggtgagcagaaagggcgacctgcagagaatgaagcagacccacaagggcaagccccccagcagcatggccttcaccggcaagttcgagatggagagcgagaagaactacgacgagttcatgaagctgctgggcatcagcagcgacgtgatcgagaaggccagaaacttcaagatcgtgaccgaggtgcagcaggacggccaggacttcacctggagccagcactacagcggcggccacaccatgaccaacaagttcaccgtgggcaaggagagcaacatccagaccatgggcggcaagaccttcaaggccaccgtgcagatggagggcggcaagctggtggtgaacttccccaactaccaccagaccagcgagatcgtgggcgacaagctggtggaggtgagcaccatcggcggcgtgacctacgagagagtgagcaagagactggcctag

SEQ ID NO: 81328 - DNA, 534 bp, Artificial Sequence; identical to SEQ ID NO: 81327
  Description of Artificial Sequence: Synthetic coding sequence

SEQ ID NO: 81329 - DNA, 387 bp, Artificial Sequence
  Description of Artificial Sequence: Synthetic coding sequence
atggccttcaccggcaagttcgagatggagagcgagaagaactacgacgagttcatgaagctgctgggcatcagcagcgacgtgatcgagaaggccagaaacttcaagatcgtgaccgaggtgcagcaggacggccaggacttcacctggagccagcactacagcggcggccacaccatgaccaacaagttcaccgtgggcaaggagagcaacatccagaccatgggcggcaagaccttcaaggccaccgtgcagatggagggcggcaagctggtggtgaacttccccaactaccaccagaccagcgagatcgtgggcgacaagctggtggaggtgagcaccatcggcggcgtgacctacgagagagtgagcaagagactggcctag

SEQ ID NO: 81330 - DNA, 501 bp, Artificial Sequence
  Description of Artificial Sequence: Synthetic coding sequence
atggtggaggccttctgcgccacctggaagctgaccaacagccagaacttcgacgagtacatgaaggccctgggcgtgggcttcgccaccagacaggtgggcaacgtgaccaagcccaccgtgatcatcagccaggagggcgacaaggtggtgatcagaaccctgagcaccttcaagaacaccgagatcagcttccagctgggcgaggagttcgacgagaccaccgccgacgacagaaactgcaagagcgtggtgagcctggacggcgacaagctggtgcacatccagaagtgggacggcaaggagaccaacttcgtgagagagatcaaggacggcaagatggtgatggtgagcaacgacaacagccccttcttcctggtgttcttcagcagcccccacaccagccacctgctgcccagcagcagcctgctgctgcccttcttcctgctgcccagcttcttcaacaacaccagcctggccagattcttcaactacatgtag

SEQ ID NO: 81331 - DNA, 399 bp, Artificial Sequence
  Description of Artificial Sequence: Synthetic coding sequence
atggtggaggccttctgcgccacctggaagctgaccaacagccagaacttcgacgagtacatgaaggccctgggcgtgggcttcgccaccagacaggtgggcaacgtgaccaagcccaccgtgatcatcagccaggagggcgacaaggtggtgatcagaaccctgagcaccttcaagaacaccgagatcagcttccagctgggcgaggagttcgacgagaccaccgccgacgacagaaactgcaagagcgtggtgagcctggacggcgacaagctggtgcacatccagaagtgggacggcaaggagaccaacttcgtgagagagatcaaggacggcaagatggtgatgaccctgaccttcggcgacgtggtggccgtgagacactacgagaaggcctag

SEQ ID NO: 81332 - DNA, 1506 bp, Artificial Sequence
  Description of Artificial Sequence: Synthetic coding sequence
atgggcaccagagccgccagacccgccggcctgccctgcggcgccgagaaccccgccagaagaagactggccctgggcgccagacagcagatccacagctggagccccagaacccccagcaccagactgaccgcccccgccggccccgccagaggcgtggccagacccgccatggcccccgaccccgtggccgccgagaccgccgcccagggccccacccccagatacttcacctgggacgaggtggcccagagaagcggctgcgaggagagatggctggtgatcgacagaaaggtgtacaacatcagcgagttcaccagaagacaccccggcggcagcagagtgatcagccactacgccggccaggacgccaccgaccccttcgtggccttccacatcaacaagggcctggtgaagaagtacatgaacagcctgctgatcggcgagctgagccccgagcagcccagcttcgagcccaccaagaacaaggagctgaccgacgagttcagagagctgagagccaccgtggagagaatgggcctgatgaaggccaaccacgtgttcttcctgctgtacctgctgcacatcctgctgctggacggcgccgcctggctgaccctgtgggtgttcggcaccagcttcctgcccttcctgctgtgcgccgtgctgctgagcgccgtgcaggcccaggccggctggctgcagcacgacttcggccacctgagcgtgttcagcaccagcaagtggaaccacctgctgcaccacttcgtgatcggccacctgaagggcgcccccgccagctggtggaaccacatgcacttccagcaccacgccaagcccaactgcttcagaaaggaccccgacatcaacatgcaccccttcttcttcgccctgggcaagatcctgagcgtggagctgggcaagcagaagaagaagtacatgccctacaaccaccagcacaagtacttcttcctgatcggcccccccgccctgctgcccctgtacttccagtggtacatcttctacttcgtgatccagagaaagaagtgggtggacctggcctggatgatcaccttctacgtgagattcttcctgacctacgtgcccctgctgggcctgaaggccttcctgggcctgttcttcatcgtgagattcctggagagcaactggttcgtgtgggtgacccagatgaaccacatccccatgcacatcgaccacgacagaaacatggactgggtgagcacccagctgcaggccacctgcaacgtgcacaagagcgccttcaacgactggttcagcggccacctgaacttccagatcgagcaccacctgttccccaccatgcccagacacaactaccacaaggtggcccccctggtgcagagcctgtgcgccaagcacggcatcgagtaccagagcaagcccctgctgagcgccttcgccgacatcatccacagcctgaaggagagcggccagctgtggctggacgcctacctgcaccagtag

SEQ ID NO: 81333 - DNA, 1083 bp, Artificial Sequence
  Description of Artificial Sequence: Synthetic coding sequence
atgaacagcctgctgatcggcgagctgagccccgagcagcccagcttcgagcccaccaagaacaaggagctgaccgacgagttcagagagctgagagccaccgtggagagaatgggcctgatgaaggccaaccacgtgttcttcctgctgtacctgctgcacatcctgctgctggacggcgccgcctggctgaccctgtgggtgttcggcaccagcttcctgcccttcctgctgtgcgccgtgctgctgagcgccgtgcaggcccaggccggctggctgcagcacgacttcggccacctgagcgtgttcagcaccagcaagtggaaccacctgctgcaccacttcgtgatcggccacctgaagggcgcccccgccagctggtggaaccacatgcacttccagcaccacgccaagcccaactgcttcagaaaggaccccgacatcaacatgcaccccttcttcttcgccctgggcaagatcctgagcgtggagctgggcaagcagaagaagaagtacatgccctacaaccaccagcacaagtacttcttcctgatcggcccccccgccctgctgcccctgtacttccagtggtacatcttctacttcgtgatccagagaaagaagtgggtggacctggcctggatgatcaccttctacgtgagattcttcctgacctacgtgcccctgctgggcctgaaggccttcctgggcctgttcttcatcgtgagattcctggagagcaactggttcgtgtgggtgacccagatgaaccacatccccatgcacatcgaccacgacagaaacatggactgggtgagcacccagctgcaggccacctgcaacgtgcacaagagcgccttcaacgactggttcagcggccacctgaacttccagatcgagcaccacctgttccccaccatgcccagacacaactaccacaaggtggcccccctggtgcagagcctgtgcgccaagcacggcatcgagtaccagagcaagcccctgctgagcgccttcgccgacatcatccacagcctgaaggagagcggccagctgtggctggacgcctacctgcaccagtag

SEQ ID NO: 81334 - DNA, 1083 bp, Artificial Sequence; identical to SEQ ID NO: 81333
  Description of Artificial Sequence: Synthetic coding sequence

SEQ ID NO: 81335 - DNA, 1083 bp, Artificial Sequence; identical to SEQ ID NO: 81333
  Description of Artificial Sequence: Synthetic coding sequence

SEQ ID NO: 81336 - DNA, 1131 bp, Artificial Sequence
  Description of Artificial Sequence: Synthetic coding sequence
caggacgccttcagagccttccaccaggacctgaacttcgtgagaaagttcctgcagcccctgctgatcggcgagctggcccccgaggagcccagccaggacggccccctgaacgcccagctggtggaggacttcagagccctgcaccaggccgccgaggacatgaagctgttcgacgccagccccaccttcttcgccttcctgctgggccacatcctggccatggaggtgctggcctggctgctgatctacctgctgggccccggctgggtgcccagcgccctggccgccttcatcctggccatcagccaggcccaggccggctggctgcagcacgacttcggccacctgagcgtgttcagcaccagcaagtggaaccacctgctgcaccacttcgtgatcggccacctgaagggcgcccccgccagctggtggaaccacatgcacttccagcaccacgccaagcccaactgcttcagaaaggaccccgacatcaacatgcaccccttcttcttcgccctgggcaagatcctgagcgtggagctgggcaagcagaagaagaagtacatgccctacaaccaccagcacaagtacttcttcctgatcggcccccccgccctgctgcccctgtacttccagtggtacatcttctacttcgtgatccagagaaagaagtgggtggacctggcctggatgatcaccttctacgtgagattcttcctgacctacgtgcccctgctgggcctgaaggccttcctgggcctgttcttcatcagattcctggagagcaactggttcgtgtgggtgacccagatgaaccacatccccatgcacatcgaccacgacagaaacatggactgggtgagcacccagctgcaggccacctgcaacgtgcacaagagcgccttcaacgactggttcagcggccacctgaacttccagatcgagcaccacctgttccccaccatgcccagacacaactaccacaaggtggcccccctggtgcagagcctgtgcgccaagcacggcatcgagtaccagagcaagcccctgctgagcgccttcgccgacatcatccacagcctgaaggagagcggccagctgtggctggacgcctacctgcaccagtag

SEQ ID NO: 81337 - DNA, 1269 bp, Artificial Sequence
  Description of Artificial Sequence: Synthetic coding sequence
atgcacggcagagaggccggccccttcgtgtgcgtgtgcgtgctgctggccagcatccccaccccccagacccccctgctgcaggccagcctgccccccttccaccccgccagcgccggccaccccatcaccggccagcaggacgccttcagagccttccaccccgacctggagttcgtgggcaagttcctgaagcccctgctgatcggcgagctggcccccgaggagcccagccaggaccacggcaagaacagcaagatcaccgaggacttcagagccctgagaaagaccgccgaggacatgaacctgttcaagaccaaccacgtgttcttcctgctgctgctggcccacatcatcgccctggagagcatcgcctggttcaccgtgttctacttcggcaacggctggatccccaccctgatcaccgccttcgtgctggccaccagccaggcccaggccggctggctgcagcacgactacggccacctgagcgtgtacagaaagcccaagtggaaccacctggtgcacaagttcgtgatcggccacctgaagggcgccagcgccaactggtggaaccacagacacttccagcaccacgccaagcccaacatcttccacaaggaccccgacgtgaacatgctgcacgtgttcgtgctgggcgagtggcagcccatcgagtacggcaagaagaagctgaagtacctgccctacaaccaccagcacgagtacttcttcctgatcggcccccccctgctgatccccatgtacttccagtaccagatcatcatgaccatgatcgtgcacaagaactgggtggacctggcctgggccgtgagctactacatcagattcttcatcacctacatccccttctacggcatcctgggcgccctgctgttcctgaacttcatcagattcctggagagccactggttcgtgtgggtgacccagatgaaccacatcgtgatggagatcgaccaggaggcctacagagactggttcagcagccagctgaccgccacctgcaacgtggagcagagcttcttcaacgactggttcagcggccacctgaacttccagatcgagcaccacctgttccccaccatgcccagacacaacctgcacaagatcgcccccctggtgaagagcctgtgcgccaagcacggcatcgagtaccaggagaagcccctgctgagagccctgctggacatcatcagaagcctgaagaagagcggcaagctgtggctggacgcctacctgcacaagtag

SEQ ID NO: 81338 - DNA, 1335 bp, Artificial Sequence
  Description of Artificial Sequence: Synthetic coding sequence
atgggcaagggcggcaaccagggcgagggcgccgccgagagagaggtgagcgtgcccaccttcagctgggaggagatccagaagcacaacctgagaaccgacagatggctggtgatcgacagaaaggtgtacaacatcaccaagtggagcatccagcaccccggcggccagagagtgatcggccactacgccggcgaggacgccaccgacgccttcagagccttccaccccgacctggagttcgtgggcaagttcctgaagcccctgctgatcggcgagctggcccccgaggagcccagccaggaccacggcaagaacagcaagatcaccgaggacttcagagccctgagaaagaccgccgaggacatgaacctgttcaagaccaaccacgtgttcttcctgctgctgctggcccacatcatcgccctggagagcatcgcctggttcaccgtgttctacttcggcaacggctggatccccaccctgatcaccgccttcgtgctggccaccagccaggcccaggccggctggctgcagcacgactacggccacctgagcgtgtacagaaagcccaagtggaaccacctggtgcacaagttcgtgatcggccacctgaagggcgccagcgccaactggtggaaccacagacacttccagcaccacgccaagcccaacatcttccacaaggaccccgacgtgaacatgctgcacgtgttcgtgctgggcgagtggcagcccatcgagtacggcaagaagaagctgaagtacctgccctacaaccaccagcacgagtacttcttcctgatcggcccccccctgctgatccccatgtacttccagtaccagatcatcatgaccatgatcgtgcacaagaactgggtggacctggcctgggccgtgagctactacatcagattcttcatcacctacatccccttctacggcatcctgggcgccctgctgttcctgaacttcatcagattcctggagagccactggttcgtgtgggtgacccagatgaaccacatcgtgatggagatcgaccaggaggcctacagagactggttcagcagccagctgaccgccacctgcaacgtggagcagagcttcttcaacgactggttcagcggccacctgaacttccagatcgagcaccacctgttccccaccatgcccagacacaacctgcacaagatcgcccccctggtgaagagcctgtgcgccaagcacggcatcgagtaccaggagaagcccctgctgagagccctgctggacatcatcagaagcctgaagaagagcggcaagctgtggctggacgcctacctgcacaagtag

SEQ ID NO: 81339 - DNA, 1161 bp, Artificial Sequence
  Description of Artificial Sequence: Synthetic coding sequence
atgggcaagggcggcaaccagggcgagggcgccgccgagagagaggtgagcgtgcccaccttcagctgggaggagatccagaagcacaacctgagaaccgacagatggctggtgatcgacagaaaggtgtacaacatcaccaagtggagcatccagcaccccggcggccagagagtgatcggccactacgccggcgaggacgccaccgacgccttcagagccttccaccccgacctggagttcgtgggcaagttcctgaagcccctgctgatcggcgagctggcccccgaggagcccagccaggaccacggcaagaacagcaagatcaccgaggacttcagagccctgagaaagaccgccgaggacatgaacctgttcaagaccaaccacgtgttcttcctgctgctgctggcccacatcatcgccctggagagcatcgcctggttcaccgtgttctacttcggcaacggctggatccccaccctgatcaccgccttcgtgctggccaccagccaggcccaggccggctggctgcagcacgactacggccacctgagcgtgtacagaaagcccaagtggaaccacctggtgcacaagttcgtgatcggccacctgaagggcgccagcgccaactggtggaaccacagacacttccagcaccacgccaagcccaacatcttccacaaggaccccgacgtgaacatgctgcacgtgttcgtgctgggcgagtggcagcccatcgagtacggcaagaagaagctgaagtacctgccctacaaccaccagcacgagtacttcttcctgatcggcccccccctgctgatccccatgtacttccagtaccagatcatcatgaccatgatcgtgcacaagaactgggtggacctggcctgggccgtgagctactacatcagattcttcatcacctacatccccttctacggcatcctgggcgccctgctgttcctgaacttcatcagattcctggagagccactggttcgtgtgggtgacccagatgaaccacatcgtgatggagatcgaccaggaggcctacagagactggttcagcagccagctgaccgccacctgcaacgtggagcagagcttcttcaacgactggttcagcggccacctgaacttccagatcgagcaccagtag

SEQ ID NO: 81340 - DNA, 1338 bp, Artificial Sequence
  Description of Artificial Sequence: Synthetic coding sequence
atgggcggcgtgggcgagcccggccccagagagggccccgcccagcccggcgcccccctgcccaccttctgctgggagcagatcagagcccacgaccagcccggcgacaagtggctggtgatcgagagaagagtgtacgacatcagcagatgggcccagagacaccccggcggcagcagactgatcggccaccacggcgccgaggacgccaccgacgccttcagagccttccaccaggacctgaacttcgtgagaaagttcctgcagcccctgctgatcggcgagctggcccccgaggagcccagccaggacggccccctgaacgcccagctggtggaggacttcagagccctgcaccaggccgccgaggacatgaagctgttcgacgccagccccaccttcttcgccttcctgctgggccacatcctggccatggaggtgctggcctggctgctgatctacctgctgggccccggctgggtgcccagcgccctggccgccttcatcctggccatcagccaggcccagagctggtgcctgcagcacgacctgggccacgccagcatcttcaagaagagctggtggaaccacgtggcccagaagttcgtgatgggccagctgaagggcttcagcgcccactggtggaacttcagacacttccagcaccacgccaagcccaacatcttccacaaggaccccgacgtgaccgtggcccccgtgttcctgctgggcgagagcagcgtggagtacggcaagaagaagagaagatacctgccctacaaccagcagcacctgtacttcttcctgatcggcccccccctgctgaccctggtgaacttcgaggtggagaacctggcctacatgctggtgtgcatgcagtgggccgacctgctgtgggccgccagcttctacgccagattcttcctgagctacctgcccttctacggcgtgcccggcgtgctgctgttcttcgtggccgtgagagtgctggagagccactggttcgtgtggatcacccagatgaaccacatccccaaggagatcggccacgagaagcacagagactgggtgagcagccagctggccgccacctgcaacgtggagcccagcctgttcaccaactggttcagcggccacctgaacttccagatcgagcaccacctgttccccagaatgcccagacacaactacagcagagtggcccccctggtgaagagcctgtgcgccaagcacggcctgagctacgaggtgaagcccttcctgaccgccctggtggacatcgtgagaagcctgaagaagagcggcgacatctggctggacgcctacctgcaccagtag

SEQ ID NO: 81341 - DNA, 1158 bp, Artificial Sequence
  Description of Artificial Sequence: Synthetic coding sequence
atgggcggcgtgggcgagcccggccccagagagggccccgcccagcccggcgcccccctgcccaccttctgctgggagcagatcagagcccacgaccagcccggcgacaagtggctggtgatcgagagaagagtgtacgacatcagcagatgggcccagagacaccccggcggcagcagactgatcggccaccacggcgccgaggacgccaccgacgccttcagagccttccaccaggacctgaacttcgtgagaaagttcctgcagcccctgctgatcggcgagctggcccccgaggagcccagccaggacggccccctgaacgcccagctggtggaggacttcagagccctgcaccaggccgccgaggacatgaagctgttcgacgccagccccaccttcttcgccttcctgctgggccacatcctggccatggaggtgctggcctggctgctgatctacctgctgggccccggctgggtgcccagcgccctggccgccttcatcctggccatcagccaggcccagagctggtgcctgcagcacgacctgggccacgccagcatcttcaagaagagctggtggaaccacgtggcccagaagttcgtgatgggccagctgaagggcttcagcgcccactggtggaacttcagacacttccagcaccacgccaagcccaacatcttccacaaggaccccgacgtgaccgtggcccccgtgttcctgctgggcgagagcagcgtggagtacggcaagaagaagagaagatacctgccctacaaccagcagcacctgtacttcttcctgatcggcccccccctgctgaccctggtgaacttcgaggtggagaacctggcctacatgctggtgtgcatgcagtgggccgacctgctgtgggccgccagcttctacgccagattcttcctgagctacctgcccttctacggcgtgcccggcgtgctgctgttcttcgtggccgtgagatacggcagagagtggagaggccacacccaggccaccggcgacccccactgcagccccccccccgagctgcccttcagcagactgcagaacggcgccagcggcaccgccagcctggcctgctggtggaaccacatcaacaccagcgtggccggcgcccagggcagatgggtgtag

SEQ ID NO: 81342 - DNA, 1017 bp, Artificial Sequence
  Description of Artificial Sequence: Synthetic coding sequence
atgttccaggccttccccggcgactacgacagcggcagcagatgcagcagcagccccagcgccgagagccagtacctgagcagcgtggacagcttcggcagcccccccaccgccgccgccagccaggagtgcgccggcctgggcgagatgcccggcagcttcgtgcccaccgtgaccgccatcaccaccagccaggacctgcagtggctggtgcagcccaccctgatcagcagcatggcccagagccagggccagcccctggccagccagccccccgtggtggacccctacgacatgcccggcaccagctacagcacccccggcatgagcggctacagcagcggcggcgccagcggcagcggcggccccagcaccagcggcaccaccagcggccccggccccgccagacccgccagagccagacccagaagacccagagaggagaccctgacccccgaggaggaggagaagagaagagtgagaagagagagaaacaagctggccgccgccaagtgcagaaacagaagaagagagctgaccgacagactgcaggccgagaccgaccagctggaggaggagaaggccgagctggagagcgagatcgccgagctgcagaaggagaaggagagactggagttcgtgctggtggcccacaagcccggctgcaagatcccctacgaggagggccccggccccggccccctggccgaggtgagagacctgcccggcagcgcccccgccaaggaggacggcttcagctggctgctgcccccccccccccccccccccctgcccttccagaccagccaggacgccccccccaacctgaccgccagcctgttcacccacagcgaggtgcaggtgctgggcgaccccttccccgtggtgaaccccagctacaccagcagcttcgtgctgacctgccccgaggtgagcgccttcgccggcgcccagagaaccagcggcagcgaccagcccagcgaccccctgaacagccccagcctgctggccctgtag

SEQ ID NO: 81343 - DNA, 909 bp, Artificial Sequence
  Description of Artificial Sequence: Synthetic coding sequence
atgttccaggccttccccggcgactacgacagcggcagcagatgcagcagcagccccagcgccgagagccagtacctgagcagcgtggacagcttcggcagcccccccaccgccgccgccagccaggagtgcgccggcctgggcgagatgcccggcagcttcgtgcccaccgtgaccgccatcaccaccagccaggacctgcagtggctggtgcagcccaccctgatcagcagcatggcccagagccagggccagcccctggccagccagccccccgtggtggacccctacgacatgcccggcaccagctacagcacccccggcatgagcggctacagcagcggcggcgccagcggcagcggcggccccagcaccagcggcaccaccagcggccccggccccgccagacccgccagagccagacccagaagacccagagaggagaccgagaccgaccagctggaggaggagaaggccgagctggagagcgagatcgccgagctgcagaaggagaaggagagactggagttcgtgctggtggcccacaagcccggctgcaagatcccctacgaggagggccccggccccggccccctggccgaggtgagagacctgcccggcagcgcccccgccaaggaggacggcttcagctggctgctgcccccccccccccccccccccctgcccttccagaccagccaggacgccccccccaacctgaccgccagcctgttcacccacagcgaggtgcaggtgctgggcgaccccttccccgtggtgaaccccagctacaccagcagcttcgtgctgacctgccccgaggtgagcgccttcgccggcgcccagagaaccagcggcagcgaccagcccagcgaccccctgaacagccccagcctgctggccctgtag

SEQ ID NO: 81344 - DNA, 588 bp, Artificial Sequence
  Description of Artificial Sequence: Synthetic coding sequence
atgttccaggccttccccggcgactacgacagcggcagcagatgcagcagcagccccagcgccgagagccagtacctgagcagcgtggacagcttcggcagcccccccaccgccgccgccagccaggagaccgaccagctggaggaggagaaggccgagctggagagcgagatcgccgagctgcagaaggagaaggagagactggagttcgtgctggtggcccacaagcccggctgcaagatcccctacgaggagggccccggccccggccccctggccgaggtgagagacctgcccggcagcgcccccgccaaggaggacggcttcagctggctgctgcccccccccccccccccccccctgcccttccagaccagccaggacgccccccccaacctgaccgccagcctgttcacccacagcgaggtgcaggtgctgggcgaccccttccccgtggtgaaccccagctacaccagcagcttcgtgctgacctgccccgaggtgagcgccttcgccggcgcccagagaaccagcggcagcgaccagcccagcgaccccctgaacagccccagcctgctggccctgtag

SEQ ID NO: 81345 - DNA, 876 bp, Artificial Sequence
  Description of Artificial Sequence: Synthetic coding sequence
atgttccaggccttccccggcgactacgacagcggcagcagatgcagcagcagccccagcgccgagagccagtacctgagcagcgtggacagcttcggcagcccccccaccgccgccgccagccaggagtgcgccggcctgggcgagatgcccggcagcttcgtgcccaccgtgaccgccatcaccaccagccaggacctgcagtggctggtgcagcccaccctgatcagcagcatggcccagagccagggccagcccctggccagccagccccccgtggtggacccctacgacatgcccggcaccagctacagcacccccggcatgagcggctacagcagcggcggcgccagcggcagcggcggccccagcaccagcggcaccaccagcggccccggccccgccagacccgccagagccagacccagaagacccagagaggagaccctgacccccgaggaggaggagaagagaagagtgagaagagagagaaacaagctggccgccgccaagtgcagaaacagaagaagagagctgaccgacagactgcaggccgagaccgaccagctggaggaggagaaggccgagctggagagcgagatcgccgagctgcagaaggagaaggagagactggagttcgtgctggtggcccacaagcccggctgcaagatcccctacgaggagggccccggccccggccccctggccgaggaggtgcaggtgctgggcgaccccttccccgtggtgaaccccagctacaccagcagcttcgtgctgacctgccccgaggtgagcgccttcgccggcgcccagagaaccagcggcagcgaccagcccagcgaccccctgaacagccccagcctgctggccctgtag

SEQ ID NO: 81346 - DNA, 912 bp, Artificial Sequence
  Description of Artificial Sequence: Synthetic coding sequence
atgagcgacaacggcgtgtgcgtgctggccttcaagtgccccggcctgctgagatacaccgcctacagatgcaagcagctgagcgacaccagcatcatcgccgtggccagccactgccccctgctgcagaaggtgcacgtgggcaaccaggacaagctgaccgacgagggcctgaagcagctgggcagcaagtgcagagagctgaaggacatccacttcggccagtgctacaagatcagcgacgagggcatgatcgtgatcgccaagggctgcctgaagctgcagagaatctacatgcaggagaacaagctggtgaccgaccagagcgtgaaggccttcgccgagcactgccccgagctgcagtacgtgggcttcatgggctgcagcgtgaccagcaagggcgtgatccacctgaccaagctgagaaacctgagcagcctggacctgagacacatcaccgagctggacaacgagaccgtgatggagatcgtgaagagatgcaagaacctgagcagcctgaacctgtgcctgaactggatcatcaacgacagatgcgtggaggtgatcgccaaggagggccagaacctgaaggagctgtacctggtgagctgcaagatcaccgactacgccctgatcgccatcggcagatacagcatgaccatcgagaccgtggacgtgggctggtgcaaggagatcaccgaccagggcgccaccctgatcgcccagagcagcaagagcctgagatacctgggcctgatgagatgcgacaaggtgaacgaggtgaccgtggagcagctggtgcagcagtacccccacatcaccttcagcaccgtgctgcaggactgcaagagaaccctggagagagcctaccagatgggctggacccccaacatgagcgccgccagcagctag

SEQ ID NO: 81347 - DNA, 945 bp, Artificial Sequence
  Description of Artificial Sequence: Synthetic coding sequence
atgagcgacaacggcgtgtgcgtgctggccttcaagtgccccggcctgctgagatacaccgcctacagatgcaagcagctgagcgacaccagcatcatcgccgtggccagccactgccccctgctgcagaaggtgcacgtgggcaaccaggacaagctgaccgacgagggcctgaagcagctgggcagcaagtgcagagagctgaaggacatccacttcggccagtgctacaagatcagcgacgagggcatgatcgtgatcgccaagggctgcctgaagctgcagagaatctacatgcaggagaacaagctggtgaccgaccagagcgtgaaggccttcgccgagcactgccccgagctgcagtacgtgggcttcatgggctgcagcgtgaccagcaagggcgtgatccacctgaccaagctgagaaacctgagcagcctggacctgagacacatcaccgagctggacaacgagaccgtgatggagatcgtgaagagatgcaagaacctgagcagcctgaacctgtgcctgaactggatcatcaacgacagatgcgtggaggtgatcgccaaggagggccagaacctgaaggagctgtacctggtgagctgcaagatcaccgactacgccctgatcgccatcggcagatacagcatgaccatcgagaccgtggacgtgggctggtgcaaggagatcaccgaccagggcgccaccctgatcgcccagagcagcaagagcctgagatacctgggcctgatgagatgcgacaaggtgagagtggactaccaggtggtgtgcttcctgcacatcagcatcgtgaacagcctgatgagctaccccctgagcttcagcatcagcacccccgtgtactacatcctgtacatccacttcatctgcatctacgccatcatcgccatgcactgcctgcccgccttcgtgaactag

SEQ ID NO: 81348 - DNA, 2106 bp, Artificial Sequence
  Description of Artificial Sequence: Synthetic coding sequence
atgggccacctgctgagcaaggagcccagaaacagacccagccagaagagacccagatgctgcagctggtgcagaagaagaagacccctgctgagactgcccagaagaacccccgccaaggtgcccccccagcccgccgcccccagaagcagagactgcttcttcagaggcccctgcatgctgtgcttcatcgtgcacagccccggcgcccccgcccccgccggccccgaggaggagccccccctgagccccccccccagagacggcgcctacgccgccgccagcagcagccagcacctggccagaagatacgccgccctggccgccgaggactgcgccgccgccgccagaagattcctgctgagcagcgccgccgccgccgccgccgccgccgccagcgccagcagccccgccagctgctgcaaggagctgggcctggccgccgccgccgcctgggagcagcagggcagaagcctgttcctggccagcctgggccccgtgagattcctgggcccccccgccgccgtgcagctgttcagaggccccacccccagccccgccgagctgcccaccccccccgagatggtgtgcaagagaaagggcgccggcgtgcccgcctgcaccccctgcaagcagcccagatgcggcggcggcggctgcggcggcggcggcggcggcggcggcggcggcggccccgccggcggcggcgccagcccccccagaccccccgacgccggctgctgccaggcccccgagcagcccccccagcccctgtgccccccccccagcagccccaccagcgagggcgcccccaccgaggccggcggcgacgccgtgagagccggcggcaccgcccccctgagcgcccagcagcagcacgagtgcggcgacgccgactgcagagagagccccgagaacccctgcgactgccacagagagcccccccccgagacccccgacatcaaccagctgccccccagcatcctgctgaagatcttcagcaacctgagcctggacgagagatgcctgagcgccagcctggtgtgcaagtactggagagacctgtgcctggacttccagttctggaagcagctggacctgagcagcagacagcaggtgaccgacgagctgctggagaagatcgccagcagaagccagaacatcatcgagatcaacatcagcgactgcagaagcatgagcgacaacggcgtgtgcgtgctggccttcaagtgccccggcctgctgagatacaccgcctacagatgcaagcagctgagcgacaccagcatcatcgccgtggccagccactgccccctgctgcagaaggtgcacgtgggcaaccaggacaagctgaccgacgagggcctgaagcagctgggcagcaagtgcagagagctgaaggacatccacttcggccagtgctacaagatcagcgacgagggcatgatcgtgatcgccaagggctgcctgaagctgcagagaatctacatgcaggagaacaagctggtgaccgaccagagcgtgaaggccttcgccgagcactgccccgagctgcagtacgtgggcttcatgggctgcagcgtgaccagcaagggcgtgatccacctgaccaagctgagaaacctgagcagcctggacctgagacacatcaccgagctggacaacgagaccgtgatggagatcgtgaagagatgcaagaacctgagcagcctgaacctgtgcctgaactggatcatcaacgacagatgcgtggaggtgatcgccaaggagggccagaacctgaaggagctgtacctggtgagctgcaagatcaccgactacgccctgatcgccatcggcagatacagcatgaccatcgagaccgtggacgtgggctggtgcaaggagatcaccgaccagggcgccaccctgatcgcccagagcagcaagagcctgagatacctgggcctgatgagatgcgacaaggtgaacgaggtgaccgtggagcagctggtgcagcagtacccccacatcaccttcagcaccgtgctgcaggactgcaagagaaccctggagagagcctaccagatgggctggacccccaacatgagcgccgccagcagctag

SEQ ID NO: 81349 - DNA, 2025 bp, Artificial Sequence
  Description of Artificial Sequence: Synthetic coding sequence
atgagcagcagcagcagaggccccggcgccggcgccagaagaagaagaaccagatgcagaagatgcagagcctgcgtgagaaccgagtgcggcgactgccacttctgcagagacatgaagaagttcggcggccccggcagaatgaagcagagctgcctgctgagacagtgcaccgcccccgtgctgccccacaccgccgtgtgcctgctgtgcggcgaggccggcaaggaggacaccgtggagggcgaggaggagaagttcggcctgagcctgatggagtgcaccatctgcaacgagatcgtgcaccccggctgcctgaagatgggcaaggccgagggcgtgatcaacgccgagatccccaactgctgggagtgccccagatgcacccaggagggcagaaccagcaaggacagcggcgagggccccggcagaagaagagccgacaacggcgaggagggcgccagcctgggcagcggctggaagctgaccgaggagccccccctgcccccccccccccccagaagaaagggccccctgcccgccggccccccccccgaggacgtgcccggcccccccaagagaaaggagagagaggccggcaacgagccccccacccccagaaagaaggtgaagggcggcagagagagacacctgaagaaggtgggcggcgacgcctgcctgctgagaggcagcgaccccggcggccccggcctgctgccccccagagtgctgaaccccagccaggccttcagcagctgccaccccggcctgccccccgagaactgggagaagcccaagccccccctggccagcgccgagggccccgccgtgcccagccccagcccccagagagagaagctggagagattcaagagaatgtgccagctgctggagagagtgcccgacaccagcagcagcagcagcgacagcgacagcgacagcgacagcagcggcaccagcctgagcgaggacgaggcccccggcgaggccagaaacggcagaagacccgccagaggcagcagcggcgagaaggagaacagaggcggcagaagagccgtgagacccggcagcggcggccccctgctgagctggcccctgggccccgcccccccccccagacccccccagctggagagacacgtggtgagacccccccccagaagccccgagcccgacaccctgcccctggccgccggcagcgaccaccccctgcccagagccgcctggctgagagtgttccagcacctgggccccagagagctgtgcatctgcatgagagtgtgcagaacctggagcagatggtgctacgacaagagactgtggcccagaatggacctgagcagaagaaagagcctgaccccccccatgctgagcggcgtggtgagaagacagcccagagccctggacctgagctggaccggcgtgagcaagaagcagctgatgtggctgctgaacagactgcagggcctgcaggagctggtgctgagcggctgcagctggctgagcgtgagcgccctgggcagcgcccccctgcccgccctgagactgctggacctgagatggatcgaggacgtgaaggacagccagctgagagagctgctgctgcccccccccgacaccaagcccggccagaccgagagcagaggcagactgcagggcgtggccgagctgagactggccggcctggagctgaccgacgccagcctgagactgctgctgagacacgccccccagctgagcgccctggacctgagccactgcgcccacgtgggcgaccccagcgtgcacctgctgaccgcccccaccagccccctgagagagaccctggtgcacctgaacctggccggctgccacagactgaccgaccactgcctgcccctgttcagaagatgccccagactgagaagactggacctgagaagctgcagacagctgagccccgaggcctgcgccagactggccgccgccggcccccccggccccttcagatgccccgaggagaagctgctgctgaaggacagctag

SEQ ID NO: 81350 - DNA, 2085 bp, Artificial Sequence
  Description of Artificial Sequence: Synthetic coding sequence
atgggcatgaaggtgcccggcaagggcgagagcggccccagcgccctgctgaccccccccatgagcagcagcagcagaggccccggcgccggcgccagaagaagaagaaccagatgcagaagatgcagagcctgcgtgagaaccgagtgcggcgactgccacttctgcagagacatgaagaagttcggcggccccggcagaatgaagcagagctgcctgctgagacagtgcaccgcccccgtgctgccccacaccgccgtgtgcctgctgtgcggcgaggccggcaaggaggacaccgtggagggcgaggaggagaagttcggcctgagcctgatggagtgcaccatctgcaacgagatcgtgcaccccggctgcctgaagatgggcaaggccgagggcgtgatcaacgccgagatccccaactgctgggagtgccccagatgcacccaggagggcagaaccagcaaggacagcggcgagggccccggcagaagaagagccgacaacggcgaggagggcgccagcctgggcagcggctggaagctgaccgaggagccccccctgcccccccccccccccagaagaaagggccccctgcccgccggccccccccccgaggacgtgcccggcccccccaagagaaaggagagagaggccggcaacgagccccccacccccagaaagaaggtgaagggcggcagagagagacacctgaagaaggtgggcggcgacgcctgcctgctgagaggcagcgaccccggcggccccggcctgctgccccccagagtgctgaaccccagccaggccttcagcagctgccaccccggcctgccccccgagaactgggagaagcccaagccccccctggccagcgccgagggccccgccgtgcccagccccagcccccagagagagaagctggagagattcaagagaatgtgccagctgctggagagagtgcccgacaccagcagcagcagcagcgacagcgacagcgacagcgacagcagcggcaccagcctgagcgaggacgaggcccccggcgaggccagaaacggcagaagacccgccagaggcagcagcggcgagaaggagaacagaggcggcagaagagccgtgagacccggcagcggcggccccctgctgagctggcccctgggccccgcccccccccccagacccccccagctggagagacacgtggtgagacccccccccagaagccccgagcccgacaccctgcccctggccgccggcagcgaccaccccctgcccagagccgcctggctgagagtgttccagcacctgggccccagagagctgtgcatctgcatgagagtgtgcagaacctggagcagatggtgctacgacaagagactgtggcccagaatggacctgagcagaagaaagagcctgaccccccccatgctgagcggcgtggtgagaagacagcccagagccctggacctgagctggaccggcgtgagcaagaagcagctgatgtggctgctgaacagactgcagggcctgcaggagctggtgctgagcggctgcagctggctgagcgtgagcgccctgggcagcgcccccctgcccgccctgagactgctggacctgagatggatcgaggacgtgaaggacagccagctgagagagctgctgctgcccccccccgacaccaagcccggccagaccgagagcagaggcagactgcagggcgtggccgagctgagactggccggcctggagctgaccgacgccagcctgagactgctgctgagacacgccccccagctgagcgccctggacctgagccactgcgcccacgtgggcgaccccagcgtgcacctgctgaccgcccccaccagccccctgagagagaccctggtgcacctgaacctggccggctgccacagactgaccgaccactgcctgcccctgttcagaagatgccccagactgagaagactggacctgagaagctgcagacagctgagccccgaggcctgcgccagactggccgccgccggcccccccggccccttcagatgccccgaggagaagctgctgctgaaggacagctag

SEQ ID NO: 81351 - DNA, 1761 bp, Artificial Sequence
  Description of Artificial Sequence: Synthetic coding sequence
tgaagaatgaagcagagctgcctgctgagacagtgcaccgcccccgtgctgccccacaccgccgtgtgcctgctgtgcggcgaggccggcaaggaggacaccgtggagggcgaggaggagaagttcggcctgagcctgatggagtgcaccatctgcaacgagatcgtgcaccccggctgcctgaagatgggcaaggccgagggcgtgatcaacgccgagatccccaactgctgggagtgccccagatgcacccaggagggcagaaccagcaaggacagcggcgagggccccggcagaagaagagccgacaacggcgaggagggcgccagcctgggcagcggctggaagctgaccgaggagccccccctgcccccccccccccccagaagaaagggccccctgcccgccggccccccccccgaggacgtgcccggcccccccaagagaaaggagagagaggccggcaacgagccccccacccccagaaagaaggtgaagggcggcagagagagacacctgaagaagaagcccaagccccccctggccagcgccgagggccccgccgtgcccagccccagcccccagagagagaagctggagagattcaagagaatgtgccagctgctggagagagtgcccgacaccagcagcagcagcagcgacagcgacagcgacagcgacagcagcggcaccagcctgagcgaggacgaggcccccggcgaggccagaaacggcagaagacccgccagaggcagcagcggcgagaaggagaacagaggcggcagaagagccgtgagacccggcagcggcggccccctgctgagctggcccctgggccccgcccccccccccagacccccccagctggagagacacgtggtgagacccccccccagaagccccgagcccgacaccctgcccctggccgccggcagcgaccaccccctgcccagagccgcctggctgagagtgttccagcacctgggccccagagagctgtgcatctgcatgagagtgtgcagaacctggagcagatggtgctacgacaagagactgtggcccagaatggacctgagcagaagaaagagcctgaccccccccatgctgagcggcgtggtgagaagacagcccagagccctggacctgagctggaccggcgtgagcaagaagcagctgatgtggctgctgaacagactgcagggcctgcaggagctggtgctgagcggctgcagctggctgagcgtgagcgccctgggcagcgcccccctgcccgccctgagactgctggacctgagatggatcgaggacgtgaaggacagccagctgagagagctgctgctgcccccccccgacaccaagcccggccagaccgagagcagaggcagactgcagggcgtggccgagctgagactggccggcctggagctgaccgacgccagcctgagactgctgctgagacacgccccccagctgagcgccctggacctgagccactgcgcccacgtgggcgaccccagcgtgcacctgctgaccgcccccaccagccccctgagagagaccctggtgcacctgaacctggccggctgccacagactgaccgaccactgcctgcccctgttcagaagatgccccagactgagaagactggacctgagaagctgcagacagctgagccccgaggcctgcgccagactggccgccgccggcccccccggccccttcagatgccccgaggagaagctgctgctgaaggacagctag

SEQ ID NO: 81352 - DNA, 495 bp, Artificial Sequence
  Description of Artificial Sequence: Synthetic coding sequence
atggacctggaggagtgcatcctgatcaccgacagcaccctgatccagctgagcatccactgccccaagctgcaggccctggtgagcctgagcttcagcgacatcatccacctgctgaagatgaaggagcccagccaccacaacaagaagctgttcggcttcagcttctgcaagagcctgagccactgcgagctgatcaccgacgacggcatcctgcacctgagcaacagcacctgcggccacgagagactgagagtgctggagctggacaactgcctgctgatcaccgacgtggccctggagcacctggagaactgcagaggcctggagagactggagctgtacgactgccagcaggtgaccagagccggcatcaagagaatgagagcccagctgccccacgtgaaggtgcacgcctacttcgcccccgtgaccccccccaccgccgtggccggcagcggccagagactgtgcagatgctgcgtgatcctgtag

SEQ ID NO: 81353 - DNA, 1272 bp, Artificial Sequence
  Description of Artificial Sequence: Synthetic coding sequence
atggtgttcagcaacaacgacgagggcctgatcaacaagaagctgcccaaggagctgctgctgagaatcttcagcttcctggacatcgtgaccctgtgcagatgcgcccagatcagcaaggcctggaacatcctggccctggacggcagcaactggcagagaatcgacctgttcaacttccagaccgacgtggagggcagagtggtggagaacatcagcaagagatgcggcggcttcctgagaaagctgagcctgagaggctgcatcggcgtgggcgacagcagcctgaagaccttcgcccagaactgcagaaacatcgagcacctgaacctgaacggctgcaccaagatcaccgacagcacctgctacagcctgagcagattctgcagcaagctgaagcacctggacctgaccagctgcgtgagcatcaccaacagcagcctgaagggcatcagcgagggctgcagaaacctggagtacctgaacctgagctggtgcgaccagatcaccaaggacggcatcgaggccctggtgagaggctgcagaggcctgaaggccctgctgctgagaggctgcacccagctggaggacgaggccctgaagcacatccagaactactgccacgagctggtgagcctgaacctgcagagctgcagcagaatcaccgacgagggcgtggtgcagatctgcagaggctgccacagactgcaggccctgtgcctgagcggctgcagcaacctgaccgacgccagcctgaccgccctgggcctgaactgccccagactgcagatcctggaggccgccagatgcagccacctgaccgacgccggcttcaccctgctggccagaaactgccacgagctggagaagatggacctggaggagtgcatcctgatcaccgacagcaccctgatccagctgagcatccactgccccaagctgcaggccctgagcctgagccactgcgagctgatcaccgacgacggcatcctgcacctgagcaacagcacctgcggccacgagagactgagagtgctggagctggacaactgcctgctgatcaccgacgtggccctggagcacctggagaactgcagaggcctggagagactggagctgtacgactgccagcaggtgaccagagccggcatcaagagaatgagagcccagctgccccacgtgaaggtgcacgcctacttcgcccccgtgaccccccccaccgccgtggccggcagcggccagagactgtgcagatgctgcgtgatcctgtag

SEQ ID NO: 81354 - DNA, 1020 bp, Artificial Sequence
  Description of Artificial Sequence: Synthetic coding sequence
atgtacatcgccctggtgtggatcctgttcgtgatgtggaccttcgcccagaactgcagaaacatcgagcacctgaacctgaacggctgcaccaagatcaccgacagcacctgctacagcctgagcagattctgcagcaagctgaagcacctggacctgaccagctgcgtgagcatcaccaacagcagcctgaagggcatcagcgagggctgcagaaacctggagtacctgaacctgagctggtgcgaccagatcaccaaggacggcatcgaggccctggtgagaggctgcagaggcctgaaggccctgctgctgagaggctgcacccagctggaggacgaggccctgaagcacatccagaactactgccacgagctggtgagcctgaacctgcagagctgcagcagaatcaccgacgagggcgtggtgcagatctgcagaggctgccacagactgcaggccctgtgcctgagcggctgcagcaacctgaccgacgccagcctgaccgccctgggcctgaactgccccagactgcagatcctggaggccgccagatgcagccacctgaccgacgccggcttcaccctgctggccagaaactgccacgagctggagaagatggacctggaggagtgcatcctgatcaccgacagcaccctgatccagctgagcatccactgccccaagctgcaggccctgagcctgagccactgcgagctgatcaccgacgacggcatcctgcacctgagcaacagcacctgcggccacgagagactgagagtgctggagctggacaactgcctgctgatcaccgacgtggccctggagcacctggagaactgcagaggcctggagagactggagctgtacgactgccagcaggtgaccagagccggcatcaagagaatgagagcccagctgccccacgtgaaggtgcacgcctacttcgcccccgtgaccccccccaccgccgtggccggcagcggccagagactgtgcagatgctgcgtgatcctgtag

SEQ ID NO: 81355 - DNA, 1068 bp, Artificial Sequence
  Description of Artificial Sequence: Synthetic coding sequence
atggtgttcagcaacaacgacgagggcctgatcaacaagaagctgcccaaggagctgctgctgagaatcttcagcttcctggacatcgtgaccctgtgcagatgcgcccagatcagcaaggcctggaacatcctggccctggacggcagcaactggcagagaatcgacctgttcaacttccagaccgacgtggagggcagagtggtggagaacatcagcaagagatgcggcggcttcctgagaaagctgagcctgagaggctgcatcggcgtgggcgacagcagcctgaagaccttcgcccagaactgcagaaacatcgagcacctgaacctgaacggctgcaccaagatcaccgacagcacctgctacagcctgagcagattctgcagcaagctgaagcacatccagaactactgccacgagctggtgagcctgaacctgcagagctgcagcagaatcaccgacgagggcgtggtgcagatctgcagaggctgccacagactgcaggccctgtgcctgagcggctgcagcaacctgaccgacgccagcctgaccgccctgggcctgaactgccccagactgcagatcctggaggccgccagatgcagccacctgaccgacgccggcttcaccctgctggccagaaactgccacgagctggagaagatggacctggaggagtgcatcctgatcaccgacagcaccctgatccagctgagcatccactgccccaagctgcaggccctgagcctgagccactgcgagctgatcaccgacgacggcatcctgcacctgagcaacagcacctgcggccacgagagactgagagtgctggagctggacaactgcctgctgatcaccgacgtggccctggagcacctggagaactgcagaggcctggagagactggagctgtacgactgccagcaggtgaccagagccggcatcaagagaatgagagcccagctgccccacgtgaaggtgcacgcctacttcgcccccgtgaccccccccaccgccgtggccggcagcggccagagactgtgcagatgctgcgtgatcctgtag

SEQ ID NO: 81356 - DNA, 402 bp, Artificial Sequence
  Description of Artificial Sequence: Synthetic coding sequence
atggacctggaggagtgcatcctgatcaccgacagcaccctgatccagctgagcatccactgccccaagctgcaggccctgagcctgagccactgcgagctgatcaccgacgacggcatcctgcacctgagcaacagcacctgcggccacgagagactgagagtgctggagctggacaactgcctgctgatcaccgacgtggccctggagcacctggagaactgcagaggcctggagagactggagctgtacgactgccagcaggtgaccagagccggcatcaagagaatgagagcccagctgccccacgtgaaggtgcacgcctacttcgcccccgtgaccccccccaccgccgtggccggcagcggccagagactgtgcagatgctgcgtgatcctgtag

SEQ ID NO: 81357 - DNA, 1068 bp, Artificial Sequence; identical to SEQ ID NO: 81355
  Description of Artificial Sequence: Synthetic coding sequence

SEQ ID NO: 81358 - DNA, 1260 bp, Artificial Sequence
  Description of Artificial Sequence: Synthetic coding sequence
atggtgttcagcgccgtgctgaccgccttccacaccggcaccagcaacaccaccttcgtggtgtacgagaacacctacatgaacatcaccctgcccccccccttccagcaccccgacctgagccccctgctgagatacagcttcgagaccatggcccccaccggcctgagcagcctgaccgtgaacagcaccgccgtgcccaccacccccgccgccttcaagagcctgaacctgcccctgcagatcaccctgagcgccatcatgatcttcatcctgttcgtgagcttcctgggcaacctggtggtgtgcctgatggtgtaccagaaggccgccatgagaagcgccatcaacatcctgctggccagcctggccttcgccgacatgctgctggccgtgctgaacatgcccttcgccctggtgaccatcctgaccaccagatggatcttcggcaagttcttctgcagagtgagcgccatgttcttctggctgttcgtgatcgagggcgtggccatcctgctgatcatcagcatcgacagattcctgatcatcgtgcagagacaggacaagctgaacccctacagagccaaggtgctgatcgccgtgagctgggccaccagcttctgcgtggccttccccctggccgtgggcaaccccgacctgcagatccccagcagagccccccagtgcgtgttcggctacaccaccaaccccggctaccaggcctacgtgatcctgatcagcctgatcagcttcttcatccccttcctggtgatcctgtacagcttcatgggcatcctgaacaccctgagacacaacgccctgagaatccacagctaccccgagggcatctgcctgagccaggccagcaagctgggcctgatgagcctgcagagacccttccagatgagcatcgacatgggcttcaagaccagagccttcaccaccatcctgatcctgttcgccgtgttcatcgtgtgctgggcccccttcaccacctacagcctggtggccaccttcagcaagcacttctactaccagcacaacttcttcgagatcagcacctggctgctgtggctgtgctacctgaagagcgccctgaaccccctgatctactactggagaatcaagaagttccacgacgcctgcctggacatgatgcccaagagcttcaagttcctgccccagctgcccggccacaccaagagaagaatcagacccagcgccgtgtacgtgtgcggcgagcacagaaccgtggtgtag

SEQ ID NO: 81359 - DNA, 1866 bp, Artificial Sequence
  Description of Artificial Sequence: Synthetic coding sequence
atgagccccgtgttccccatgctgaccgtgctgaccatgttctactacatctgcctgagaagaagagccagaaccgccaccagaggcgagatgatgaacacccacagagccatcgagagcaacagccagaccagccccctgaacgccgaggtggtgcagtacgccaaggaggtggtggacttcagcagccactacggcagcgagaacagcatgagctacaccatgtggaacctggccggcgtgcccaacgtgttccccagcagcggcgacttcacccagaccgccgtgttcagaacctacggcacctggtgggaccagtgccccagcgccagcctgcccttcaagagaaccccccccaacttccagagccaggactacgtggagctgaccttcgagcagcaggtgtaccccaccgccgtgcacgtgctggagacctaccaccccggcgccgtgatcagaatcctggcctgcagcgccaacccctacagccccaacccccccgccgaggtgagatgggagatcctgtggagcgagagacccaccaaggtgaacgccagccaggccagacagttcaagccctgcatcaagcagatcaacttccccaccaacctgatcagactggaggtgaacagcagcctgctggagtactacaccgagctggacgccgtggtgctgcacggcgtgaaggacaagcccgtgctgagcctgaagaccagcctgatcgacatgaacgacatcgaggacgacgcctacgccgagaaggacggctgcggcatggacagcctgaacaagaagttcagcagcgccgtgctgggcgagggccccaacaacggctacttcgacaagctgccctacgagctgatccagctgatcctgaaccacctgaccctgcccgacctgtgcagactggcccagacctgcaagctgctgagccagcactgctgcgaccccctgcagtacatccacctgaacctgcagccctactgggccaagctggacgacaccagcctggagttcctgcagagcagatgcaccctggtgcagtggctgaacctgagctggaccggcaacagaggcttcatcagcgtggccggcttcagcagattcctgaaggtgtgcggcagcgagctggtgagactggagctgagctgcagccacttcctgaacgagacctgcctggaggtgatcagcgagatgtgccccaacctgcaggccctgaacctgagcagctgcgacaagctgcccccccaggccttcaaccacatcgccaagctgtgcagcctgaagagactggtgctgtacagaaccaaggtggagcagaccgccctgctgagcatcctgaacttctgcagcgagctgcagcacctgagcctgggcagctgcgtgatgatcgaggactacgacgtgatcgccagcatgatcggcgccaagtgcaagaagctgagaaccctggacctgtggagatgcaagaacatcaccgagaacggcatcgccgagctggccagcggctgccccctgctggaggagctggacctgggctggtgccccaccctgcagagcagcaccggctgcttcaccagactggcccaccagctgcccaacctgcagaagctgttcctgaccgccaacagaagcgtgtgcgacaccgacatcgacgagctggcctgcaactgcaccagactgcagcagctggacatcctgggcaccagaatggtgagccccgccagcctgagaaagctgctggagagctgcaaggacctgagcctgctggacgtgagcttctgcagccagatcgacaacagagccgtgctggagctgaacgccagcttccccaaggtgttcatcaagaagagcttcacccagtag

SEQ ID NO: 81360 - DNA, 2076 bp, Artificial Sequence
  Description of Artificial Sequence: Synthetic coding sequence
atggcccccttccccgaggaggtggacgtgttcaccgccccccactggagaatgaagcagctggtgggcctgtactgcgacaagctgagcaagaccaacttcagcaacaacaacgacttcagagccctgctgcagagcctgtacgccaccttcaaggagttcaagatgcacgagcagatcgagaacgagtacatcatcggcctgctgcagcagagaagccagaccatctacaacgtgcacagcgacaacaagctgagcgagatgctgagcctgttcgagaagggcctgaagaacgtgaagaacgagtacgagcagctgaactacgccaagcagctgaaggagagactggaggccttcaccagagacttcctgccccacatgaaggaggaggaggaggtgttccagcccatgctgatggagtacttcacctacgaggagctgaaggacatcaagaagaaggtgatcgcccagcactgcagccagaaggacaccgccgagctgctgagaggcctgagcctgtggaaccacgccgaggagagacagaagttcttcaagtacagcgtggacgagaagagcgacaaggaggccgaggtgagcgagcacagcaccggcatcacccacctgccccccgaggtgatgctgagcatcttcagctacctgaacccccaggagctgtgcagatgcagccaggtgagcatgaagtggagccagctgaccaagaccggcagcctgtggaagcacctgtaccccgtgcactgggccagaggcgactggtacagcggccccgccaccgagctggacaccgagcccgacgacgagtgggtgaagaacagaaaggacgagagcagagccttccacgagtgggacgaggacgccgacatcgacgagagcgaggagagcgccgaggagagcatcgccatcagcatcgcccagatggagaagagactgctgcacggcctgatccacaacgtgctgccctacgtgggcaccagcgtgaagaccctggtgctggcctacagcagcgccgtgagcagcaagatggtgagacagatcctggagctgtgccccaacctggagcacctggacctgacccagaccgacatcagcgacagcgccttcgacagctggagctggctgggctgctgccagagcctgagacacctggacctgagcggctgcgagaagatcaccgacgtggccctggagaagatcagcagagccctgggcatcctgaccagccaccagagcggcttcctgaagaccagcaccagcaagatcaccagcaccgcctggaagaacaaggacatcaccatgcagagcaccaagcagtacgcctgcctgcacgacctgaccaacaagggcatcggcgaggagatcgacaacgagcacccctggaccaagcccgtgagcagcgagaacttcaccagcccctacgtgtggatgctggacgccgaggacctggccgacatcgaggacaccgtggagtggagacacagaaacgtggagagcctgtgcgtgatggagaccgccagcaacttcagctgcagcaccagcggctgcttcagcaaggacatcgtgggcctgagaaccagcgtgtgctggcagcagcactgcgccagccccgccttcgcctactgcggccacagcttctgctgcaccggcaccgccctgagaaccatgagcagcctgcccgagagcagcgccatgtgcagaaaggccgccagaaccagactgcccagaggcaaggacctgatctacttcggcagcgagaagagcgaccaggagaccggcagagtgctgctgttcctgagcctgagcggctgctaccagatcaccgaccacggcctgagagtgctgaccctgggcggcggcctgccctacctggagcacctgaacctgagcggctgcctgaccatcaccggcgccggcctgcaggacctggtgagcgcctgccccagcctgaacgacgagtacttctactactgcgacaacatcaacggcccccacgccgacaccgccagcggctgccagaacctgcagtgcggcttcagagcctgctgcagaagcggcgagtag

SEQ ID NO: 81361 - DNA, 1698 bp, Artificial Sequence
  Description of Artificial Sequence: Synthetic coding sequence
atgaaggaggaggaggaggtgttccagcccatgctgatggagtacttcacctacgaggagctgaaggacatcaagaagaaggtgatcgcccagcactgcagccagaaggacaccgccgagctgctgagaggcctgagcctgtggaaccacgccgaggagagacagaagttcttcaagtacagcgtggacgagaagagcgacaaggaggccgaggtgagcgagcacagcaccggcatcacccacctgccccccgaggtgatgctgagcatcttcagctacctgaacccccaggagctgtgcagatgcagccaggtgagcatgaagtggagccagctgaccaagaccggcagcctgtggaagcacctgtaccccgtgcactgggccagaggcgactggtacagcggccccgccaccgagctggacaccgagcccgacgacgagtgggtgaagaacagaaaggacgagagcagagccttccacgagtgggacgaggacgccgacatcgacgagagcgaggagagcgccgaggagagcatcgccatcagcatcgcccagatggagaagagactgctgcacggcctgatccacaacgtgctgccctacgtgggcaccagcgtgaagaccctggtgctggcctacagcagcgccgtgagcagcaagatggtgagacagatcctggagctgtgccccaacctggagcacctggacctgacccagaccgacatcagcgacagcgccttcgacagctggagctggctgggctgctgccagagcctgagacacctggacctgagcggctgcgagaagatcaccgacgtggccctggagaagatcagcagagccctgggcatcctgaccagccaccagagcggcttcctgaagaccagcaccagcaagatcaccagcaccgcctggaagaacaaggacatcaccatgcagagcaccaagcagtacgcctgcctgcacgacctgaccaacaagggcatcggcgaggagatcgacaacgagcacccctggaccaagcccgtgagcagcgagaacttcaccagcccctacgtgtggatgctggacgccgaggacctggccgacatcgaggacaccgtggagtggagacacagaaacgtggagagcctgtgcgtgatggagaccgccagcaacttcagctgcagcaccagcggctgcttcagcaaggacatcgtgggcctgagaaccagcgtgtgctggcagcagcactgcgccagccccgccttcgcctactgcggccacagcttctgctgcaccggcaccgccctgagaaccatgagcagcctgcccgagagcagcgccatgtgcagaaaggccgccagaaccagactgcccagaggcaaggacctgatctacttcggcagcgagaagagcgaccaggagaccggcagagtgctgctgttcctgagcctgagcggctgctaccagatcaccgaccacggcctgagagtgctgaccctgggcggcggcctgccctacctggagcacctgaacctgagcggctgcctgaccatcaccggcgccggcctgcaggacctggtgagcgcctgccccagcctgaacgacgagtacttctactactgcgacaacatcaacggcccccacgccgacaccgccagcggctgccagaacctgcagtgcggcttcagagcctgctgcagaagcggcgagtag

SEQ ID NO: 81362 - DNA, 2025 bp, Artificial Sequence
  Description of Artificial Sequence: Synthetic coding sequence
atggcccccttccccgaggaggtggacgtgttcaccgccccccactggagaatgaagcagctggtgggcctgtactgcgacaagagcctgtacgccaccttcaaggagttcaagatgcacgagcagatcgagaacgagtacatcatcggcctgctgcagcagagaagccagaccatctacaacgtgcacagcgacaacaagctgagcgagatgctgagcctgttcgagaagggcctgaagaacgtgaagaacgagtacgagcagctgaactacgccaagcagctgaaggagagactggaggccttcaccagagacttcctgccccacatgaaggaggaggaggaggtgttccagcccatgctgatggagtacttcacctacgaggagctgaaggacatcaagaagaaggtgatcgcccagcactgcagccagaaggacaccgccgagctgctgagaggcctgagcctgtggaaccacgccgaggagagacagaagttcttcaagtacagcgtggacgagaagagcgacaaggaggccgaggtgagcgagcacagcaccggcatcacccacctgccccccgaggtgatgctgagcatcttcagctacctgaacccccaggagctgtgcagatgcagccaggtgagcatgaagtggagccagctgaccaagaccggcagcctgtggaagcacctgtaccccgtgcactgggccagaggcgactggtacagcggccccgccaccgagctggacaccgagcccgacgacgagtgggtgaagaacagaaaggacgagagcagagccttccacgagtgggacgaggacgccgacatcgacgagagcgaggagagcgccgaggagagcatcgccatcagcatcgcccagatggagaagagactgctgcacggcctgatccacaacgtgctgccctacgtgggcaccagcgtgaagaccctggtgctggcctacagcagcgccgtgagcagcaagatggtgagacagatcctggagctgtgccccaacctggagcacctggacctgacccagaccgacatcagcgacagcgccttcgacagctggagctggctgggctgctgccagagcctgagacacctggacctgagcggctgcgagaagatcaccgacgtggccctggagaagatcagcagagccctgggcatcctgaccagccaccagagcggcttcctgaagaccagcaccagcaagatcaccagcaccgcctggaagaacaaggacatcaccatgcagagcaccaagcagtacgcctgcctgcacgacctgaccaacaagggcatcggcgaggagatcgacaacgagcacccctggaccaagcccgtgagcagcgagaacttcaccagcccctacgtgtggatgctggacgccgaggacctggccgacatcgaggacaccgtggagtggagacacagaaacgtggagagcctgtgcgtgatggagaccgccagcaacttcagctgcagcaccagcggctgcttcagcaaggacatcgtgggcctgagaaccagcgtgtgctggcagcagcactgcgccagccccgccttcgcctactgcggccacagcttctgctgcaccggcaccgccctgagaaccatgagcagcctgcccgagagcagcgccatgtgcagaaaggccgccagaaccagactgcccagaggcaaggacctgatctacttcggcagcgagaagagcgaccaggagaccggcagagtgctgctgttcctgagcctgagcggctgctaccagatcaccgaccacggcctgagagtgctgaccctgggcggcggcctgccctacctggagcacctgaacctgagcggctgcctgaccatcaccggcgccggcctgcaggacctggtgagcgcctgccccagcctgaacgacgagtacttctactactgcgacaacatcaacggcccccacgccgacaccgccagcggctgccagaacctgcagtgcggcttcagagcctgctgcagaagcggcgagtag

SEQ ID NO: 81363 - DNA, 1440 bp, Artificial Sequence
  Description of Artificial Sequence: Synthetic coding sequence
ggcaagggcagcagcagcatcagcagcgacgtgagcagcagcaccgaccacacccccaccaaggcccagaagaacgtggccaccagcgaggacagcgacctgagcatgagaaccctgagcacccccagccccgccctgatctgcccccccaacctgcccggcttccagaacggcagaggcagcagcaccagcagcagcagcatcaccggcgagaccgtggccatggtgcacagccccccccccaccagactgacccaccccctgatcagactggccagcagaccccagaaggagcaggccagcatcgacagactgcccgaccacagcatggtgcagatcttcagcttcctgcccaccaaccagctgtgcagatgcgccagagtgtgcagaagatggtacaacctggcctgggaccccagactgtggagaaccatcagactgaccggcgagaccatcaacgtggacagagccctgaaggtgctgaccagaagactgtgccaggacacccccaacgtgtgcctgatgctggagaccgtgaccgtgagcggctgcagaagactgaccgacagaggcctgtacaccatcgcccagtgctgccccgagctgagaagactggaggtgagcggctgctacaacatcagcaacgaggccgtgttcgacgtggtgagcctgtgccccaacctggagcacctggacgtgagcggctgcagcaaggtgacctgcatcagcctgaccagagaggccagcatcaagctgagccccctgcacggcaagcagatcagcatcagatacctggacatgaccgactgcttcgtgctggaggacgagggcctgcacaccatcgccgcccactgcacccagctgacccacctgtacctgagaagatgcgtgagactgaccgacgagggcctgagatacctggtgatctactgcgccagcatcaaggagctgagcgtgagcgactgcagattcgtgagcgacttcggcctgagagagatcgccaagctggagagcagactgagatacctgagcatcgcccactgcggcagagtgaccgacgtgggcatcagatacgtggccaagtactgcagcaagctgagatacctgaacgccagaggctgcgagggcatcaccgaccacggcgtggagtacctggccaagaactgcaccaagctgaagagcctggacatcggcaagtgccccctggtgagcgacaccggcctggagtgcctggccctgaactgcttcaacctgaagagactgagcctgaagagctgcgagagcatcaccggccagggcctgcagatcgtggccgccaactgcttcgacctgcagaccctgaacgtgcaggactgcgaggtgagcgtggaggccctgagattcgtgaagagacactgcaagagatgcgtgatcgagcacaccaaccccgccttcttctag

SEQ ID NO: 81364 - DNA, 1476 bp, Artificial Sequence
  Description of Artificial Sequence: Synthetic coding sequence
atgggcgccaacaacggcaagcagtacggcagcgagggcaagggcagcagcagcatcagcagcgacgtgagcagcagcaccgaccacacccccaccaaggcccagaagaacgtggccaccagcgaggacagcgacctgagcatgagaaccctgagcacccccagccccgccctgatctgcccccccaacctgcccggcttccagaacggcagaggcagcagcaccagcagcagcagcatcaccggcgagaccgtggccatggtgcacagccccccccccaccagactgacccaccccctgatcagactggccagcagaccccagaaggagcaggccagcatcgacagactgcccgaccacagcatggtgcagatcttcagcttcctgcccaccaaccagctgtgcagatgcgccagagtgtgcagaagatggtacaacctggcctgggaccccagactgtggagaaccatcagactgaccggcgagaccatcaacgtggacagagccctgaaggtgctgaccagaagactgtgccaggacacccccaacgtgtgcctgatgctggagaccgtgaccgtgagcggctgcagaagactgaccgacagaggcctgtacaccatcgcccagtgctgccccgagctgagaagactggaggtgagcggctgctacaacatcagcaacgaggccgtgttcgacgtggtgagcctgtgccccaacctggagcacctggacgtgagcggctgcagcaaggtgacctgcatcagcctgaccagagaggccagcatcaagctgagccccctgcacggcaagcagatcagcatcagatacctggacatgaccgactgcttcgtgctggaggacgagggcctgcacaccatcgccgcccactgcacccagctgacccacctgtacctgagaagatgcgtgagactgaccgacgagggcctgagatacctggtgatctactgcgccagcatcaaggagctgagcgtgagcgactgcagattcgtgagcgacttcggcctgagagagatcgccaagctggagagcagactgagatacctgagcatcgcccactgcggcagagtgaccgacgtgggcatcagatacgtggccaagtactgcagcaagctgagatacctgaacgccagaggctgcgagggcatcaccgaccacggcgtggagtacctggccaagaactgcaccaagctgaagagcctggacatcggcaagtgccccctggtgagcgacaccggcctggagtgcctggccctgaactgcttcaacctgaagagactgagcctgaagagctgcgagagcatcaccggccagggcctgcagatcgtggccgccaactgcttcgacctgcagaccctgaacgtgcaggactgcgaggtgagcgtggaggccctgagattcgtgaagagacactgcaagagatgcgtgatcgagcacaccaaccccgccttcttctag

SEQ ID NO: 81365 - DNA, 3000 bp, Artificial Sequence
  Description of Artificial Sequence: Synthetic coding sequence
atggagaacctggagagcagactgaagaacgccccctacttcagatgcgagaagggcaccgacagcatccccctgtgcagaaagtgcgagacctgcgtgctggcctggaagatcttcagcaccaaggagtggttctgcagaatcaacgacatcagccagagaagattcctggtgggcatcctgaagcagctgaacagcctgtacctgctgcactacttccagaacatcctgcagaccacccagggcaaggacttcatctacaacagaagcagaatcaacctgagcaagaaggagggcaaggtggtgaagagcagcctgaaccagatgctggacaagaccgtggagcagaagatgaaggagatcctgtactggttcgccaacagcacccagtggaccaaggccaactacaccctgctgctgctgcagatgtgcaaccccaagctgctgctgaccgccgccaacgtgatcagagtgctgttcctgagagaggagaacaacatcagcggcctgaaccaggacatcaccgacgtgtgcttcagccccgagaaggaccacagcagcaagagcgccaccagccaggtgtactggaccgccaagacccagcacaccagcctgcccctgagcaaggcccccgagaacgagcacctgctgggcgccgccagcaaccccgaggagccctggagaaacagcctgagatgcatcagcgagatgaacagactgttcagcggcaagggcgacatcaccaagcccggctacgacccctgcaacctgctggtggacctggacgacatcagagacctgagcagcggcttcagcaagtacagagacttcatcagatacctgcccatccacctgagcaagtacatcctgagaatgctggacagacacaccctgaacaagtgcgccagcgtgagccagcactgggccgccatggcccagcaggtgaagatggacctgagcgcccacggcttcatccagaaccagatcaccttcctgcagggcagctacaccagaggcatcgaccccaactacgccaacaaggtgagcatccccgtgcccaagatggtggacgacggcaagagcatgagagtgaagcaccccaagtggaagctgagaaccaagaacgagtacaacctgtggaccgcctaccagaacgaggagacccagcaggtgctgatcgaggagagaaacgtgttctgcggcacctacaacgtgagaatcctgagcgacacctgggaccagaacagagtgatccactacagcggcggcgacctgatcgccgtgagcagcaacagaaagatccacctgctggacatcatccaggtgaaggccatccccgtggagttcagaggccacgccggcagcgtgagagccctgttcctgtgcgaggaggagaacttcctgctgagcggcagctacgacctgagcatcagatactgggacctgaagagcggcgtgtgcaccagaatcttcggcggccaccagggcaccatcacctgcatggacctgtgcaagaacagactggtgagcggcggcagagactgccaggtgaaggtgtgggacgtggacaccggcaagtgcctgaagaccttcagacacaaggaccccatcctggccaccagaatcaacgacacctacatcgtgagcagctgcgagagaggcctggtgaaggtgtggcacatcgccatggcccagctggtgaagaccctgagcggccacgagggcgccgtgaagtgcctgttcttcgaccagtggcacctgctgagcggcagcaccgacggcctggtgatggcctggagcatggtgggcaagtacgagagatgcctgatggccttcaagcaccccaagatggtggtgaacaccgagagcaacgtgctgatgttccagttcgagcacatcaagtggcagtacgccgtggagaagaccaagcagaagaagaacaaggagaaggaggaggagaaggaggagaacagcctgatggagatcctgagcaagtgcaacatccaggtgcacagccccagagagagcgtgagcagcaagcagaccgtgatccaggagctgctgcccggcaagccccccaagagcagagtgctgctgaagcccgccaagttcagcagcgccgtgctgatcgaggagctgcagagccagggcaagagcaagagccccagaagagacgccgacgacgtggagaaggcccagaagcagggccagctggagacccccggcaagctgcccagccaccccaagaagaagagctggaagatccccatgagccccgaccagttcctgctgaccgtgagcgccctgcagcacgcccacaacagcggcgagttcgcctacccctgcagaccccagaccgagatcaccgacgtgtggggccccagcatcagctaccccagaaaggtgctgaacttcaagggcaagagcatccagagagccgtggacagactgagactgagcaacccccccatcgacgtgaagagaaccagcatccccctggagatccagaagctgcagcccaacctgaagatcagcctgcacagccccagagtgcagagcaccatcccccagcccatgatcatcagaagcagattcagcggcagcctgaagggcggcgaccaggtgaccagcagcatcgagagagccgtgtgcagcaccggccccctgaccagcatgcaggtgatcaagcccaacagaatgctggccccccaggtgggcaccgccaccctgagcctgaagaaggagagacccagaatctacaccgccctggaccccttcagagtgaacaccgagttcgtgctgctgaccgtgaaggaggagaaggagcaccaggaggccaagatgaaggagtaccaggccagagagagcaccggcgtggtggaccccggcaaggtgagcaaggccgcctggatcagaaagatcaagggcctgcccatcgacaacttcaccaagcagggcaagaccgccgcccccgagctgggccagaacgtgttcatctag

SEQ ID NO: 81366 - DNA, 3186 bp, Artificial Sequence
  Description of Artificial Sequence: Synthetic coding sequence
atggagaacctggagagcagactgaagaacgccccctacttcagatgcgagaagggcaccgacagcatccccctgtgcagaaagtgcgagacctgcgtgctggcctggaagatcttcagcaccaaggagtggttctgcagaatcaacgacatcagccagagaagattcctggtgggcatcctgaagcagctgaacagcctgtacctgctgcactacttccagaacatcctgcagaccacccagggcaaggacttcatctacaacagaagcagaatcaacctgagcaagaaggagggcaaggtggtgaagagcagcctgaaccagatgctggacaagaccgtggagcagaagatgaaggagatcctgtactggttcgccaacagcacccagtggaccaaggccaactacaccctgctgctgctgcagatgtgcaaccccaagctgctgctgaccgccgccaacgtgatcagagtgctgttcctgagagaggagaacaacatcagcggcctgaaccaggacatcaccgacgtgtgcttcagccccgagaaggaccacagcagcaagagcgccaccagccaggtgtactggaccgccaagacccagcacaccagcctgcccctgagcaaggcccccgagaacgagcacctgctgggcgccgccagcaaccccgaggagccctggagaaacagcctgagatgcatcagcgagatgaacagactgttcagcggcaagggcgacatcaccaagcccggctacgacccctgcaacctgctggtggacctggacgacatcagagacctgagcagcggcttcagcaagtacagagacttcatcagatacctgcccatccacctgagcaagtacatcctgagcatgctgggctgcatgagaggcttccccagacacctgcccagctggcccagcagcggcgtgagcggcagcatcttcttcttccccggcatgctggacagacacaccctgaacaagtgcgccagcgtgagccagcactgggccgccatggcccagcaggtgaagatggacctgagcgcccacggcttcatccagaaccagatcaccttcctgcagggcagctacaccagaggcatcgaccccaactacgccaacaaggtgagcatccccgtgcccaagatggtggacgacggcaagagcatgagagtgaagcaccccaagtggaagctgagaaccaagaacgagtacaacctgtggaccgcctaccagaacgaggagacccagcaggtgctgatcgaggagagaaacgtgttctgcggcacctacaacgtgagaatcctgagcgacacctgggaccagaacagagtgatccactacagcggcggcgacctgatcgccgtgagcagcaacagaaagatccacctgctggacatcatccaggtgaaggccatccccgtggagttcagaggccacgccggcagcgtgagagccctgttcctgtgcgaggaggagaacttcctgctgagcggcagctacgacctgagcatcagatactgggacctgaagagcggcgtgtgcaccagaatcttcggcggccaccagggcaccatcacctgcatggacctgtgcaagaacagactggtgagcggcggcagagactgccaggtgaaggtgtgggacgtggacaccggcaagtgcctgaagaccttcagacacaaggaccccatcctggccaccagaatcaacgacacctacatcgtgagcagctgcgagagaggcctggtgaaggtgtggcacatcgccatggcccagctggtgaagaccctgagcggccacgagggcgccgtgaagtgcctgttcttcgaccagtggcacctgctgagcggcagcaccgacggcctggtgatggcctggagcatggtgggcaagtacgagagatgcctgatggccttcaagcaccccaaggaggtgctggacgtgagcctgctgttcctgagagtgatcagcgcctgcgccgacggcaagatcagaatctacaacttcctgaacggcaactgcatgaaggtgctgaaggccaacggcagaggcgaccccgtgctgagcttcttcatccagggcaacagaatggtggtgaacaccgagagcaacgtgctgatgttccagttcgagcacatcaagtggcagtacgccgtggagaagaccaagcagaagaagaacaaggagaaggaggaggagaaggaggagaacagcctgatggagatcctgagcaagtgcaacatccaggtgcacagccccagagagagcgtgagcagcaagcagaccgtgatccaggagctgctgcccggcaagccccccaagagcagagtgctgctgaagcccgccaagttcagcagcgacgacgtggagaaggcccagaagcagggccagctggagacccccggcaagctgcccagccaccccaagaagaagagctggaagatccccatgagccccgaccagttcctgctgaccgtgagcgccctgcagcacgcccacaacagcggcgagttcgcctacccctgcagaccccagaccgagatcaccgacgtgtggggccccagcatcagctaccccagaaaggtgctgaacttcaagggcaagagcatccagagagccgtggacagactgagactgagcaacccccccatcgacgtgaagagaaccagcatccccctggagatccagaagctgcagcccaacctgaagatcagcctgcacagccccagagtgcagagcaccatcccccagcccatgatcatcagaagcagattcagcggcagcctgaagggcggcgaccaggtgaccagcagcatcgagagagccgtgtgcagcaccggccccctgaccagcatgcaggtgatcaagcccaacagaatgctggccccccaggtgggcaccgccaccctgagcctgaagaaggagagacccagaatctacaccgccctggaccccttcagagtgaacaccgagttcgtgctgctgaccgtgaaggaggagaaggagcaccaggaggccaagatgaaggagtaccaggccagagagagcaccggcgtggtggaccccggcaaggtgagcaaggccgcctggatcagaaagatcaagggcctgcccatcgacaacttcaccaagcagggcaagaccgccgcccccgagctgggccagaacgtgttcatctag

SEQ ID NO: 81367 - DNA, 3159 bp, Artificial Sequence
  Description of Artificial Sequence: Synthetic coding sequence
atggagaacctggagagcagactgaagaacgccccctacttcagatgcgagaagggcaccgacagcatccccctgtgcagaaagtgcgagacctgcgtgctggcctggaagatcttcagcaccaaggagtggttctgcagaatcaacgacatcagccagagaagattcctggtgggcatcctgaagcagctgaacagcctgtacctgctgcactacttccagaacatcctgcagaccacccagggcaaggacttcatctacaacagaagcagaatcaacctgagcaagaaggagggcaaggtggtgaagagcagcctgaaccagatgctggacaagaccgtggagcagaagatgaaggagatcctgtactggttcgccaacagcacccagtggaccaaggccaactacaccctgctgctgctgcagatgtgcaaccccaagctgctgctgaccgccgccaacgtgatcagagtgctgttcctgagagaggagaacaacatcagcggcctgaaccaggacatcaccgacgtgtgcttcagccccgagaaggaccacagcagcaagagcgccaccagccaggtgtactggaccgccaagacccagcacaccagcctgcccctgagcaaggcccccgagaacgagcacctgctgggcgccgccagcaaccccgaggagccctggagaaacagcctgagatgcatcagcgagatgaacagactgttcagcggcaagggcgacatcaccaagcccggctacgacccctgcaacctgctggtggacctggacgacatcagagacctgagcagcggcttcagcaagtacagagacttcatcagatacctgcccatccacctgagcaagtacatcctgagaatgctggacagacacaccctgaacaagtgcgccagcgtgagccagcactgggccgccatggcccagcaggtgaagatggacctgagcgcccacggcttcatccagaaccagatcaccttcctgcagggcagctacaccagaggcatcgaccccaactacgccaacaaggtgagcatccccgtgcccaagatggtggacgacggcaagagcatgagagtgaagcaccccaagtggaagctgagaaccaagaacgagtacaacctgtggaccgcctaccagaacgaggagacccagcaggtgctgatcgaggagagaaacgtgttctgcggcacctacaacgtgagaatcctgagcgacacctgggaccagaacagagtgatccactacagcggcggcgacctgatcgccgtgagcagcaacagaaagatccacctgctggacatcatccaggtgaaggccatccccgtggagttcagaggccacgccggcagcgtgagagccctgttcctgtgcgaggaggagaacttcctgctgagcggcagctacgacctgagcatcagatactgggacctgaagagcggcgtgtgcaccagaatcttcggcggccaccagggcaccatcacctgcatggacctgtgcaagaacagactggtgagcggcggcagagactgccaggtgaaggtgtgggacgtggacaccggcaagtgcctgaagaccttcagacacaaggaccccatcctggccaccagaatcaacgacacctacatcgtgagcagctgcgagagaggcctggtgaaggtgtggcacatcgccatggcccagctggtgaagaccctgagcggccacgagggcgccgtgaagtgcctgttcttcgaccagtggcacctgctgagcggcagcaccgacggcctggtgatggcctggagcatggtgggcaagtacgagagatgcctgatggccttcaagcaccccaaggaggtgctggacgtgagcctgctgttcctgagagtgatcagcgcctgcgccgacggcaagatcagaatctacaacttcctgaacggcaactgcatgaaggtgctgaaggccaacggcagaggcgaccccgtgctgagcttcttcatccagggcaacagaatggtggtgaacaccgagagcaacgtgctgatgttccagttcgagcacatcaagtggcagtacgccgtggagaagaccaagcagaagaagaacaaggagaaggaggaggagaaggaggagaacagcctgatggagatcctgagcaagtgcaacatccaggtgcacagccccagagagagcgtgagcagcaagcagaccgtgatccaggagctgctgcccggcaagccccccaagagcagagtgctgctgaagcccgccaagttcagcagcgccgtgctgatcgaggagctgcagagccagggcaagagcaagagccccagaagagacgccgacgacgtggagaaggcccagaagcagggccagctggagacccccggcaagctgcccagccaccccaagaagaagagctggaagatccccatgagccccgaccagttcctgctgaccgtgagcgccctgcagcacgcccacaacagcggcgagttcgcctacccctgcagaccccagaccgagatcaccgacgtgtggggccccagcatcagctaccccagaaaggtgctgaacttcaagggcaagagcatccagagagccgtggacagactgagactgagcaacccccccatcgacgtgaagagaaccagcatccccctggagatccagaagctgcagcccaacctgaagatcagcctgcacagccccagagtgcagagcaccatcccccagcccatgatcatcagaagcagattcagcggcagcctgaagggcggcgaccaggtgaccagcagcatcgagagagccgtgtgcagcaccggccccctgaccagcatgcaggtgatcaagcccaacagaatgctggccccccaggtgggcaccgccaccctgagcctgaagaaggagagacccagaatctacaccgccctggaccccttcagagtgaacaccgagttcgtgctgctgaccgtgaaggaggagaaggagcaccaggaggccaagatgaaggagtaccaggccagagagagcaccggcgtggtggaccccggcaaggtgagcaaggccgcctggatcagaaagatcaagggcctgcccatcgacaacttcaccaagcagggcaagaccgccgcccccgagctgggccagaacgtgttcatctag

SEQ ID NO: 81368 - DNA, 3156 bp, Artificial Sequence
  Description of Artificial Sequence: Synthetic coding sequence
atggagaacctggagagcagactgaagaacgccccctacttcagatgcgagaagggcaccgacagcatccccctgtgcagaaagtgcgagacctgcgtgctggcctggaagatcttcagcaccaaggagtggttctgcagaatcaacgacatcagccagagaagattcctggtgggcatcctgaagcagctgaacagcctgtacctgctgcactacttccagaacatcctgcagaccacccagggcaaggacttcatctacaacagaagcagaatcaacctgagcaagaaggagggcaaggtggtgaagagcagcctgaaccagatgctggacaagaccgtggagcagaagatgaaggagatcctgtactggttcgccaacagcacccagtggaccaaggccaactacaccctgctgctgctgcagatgtgcaaccccaagctgctgctgaccgccgccaacgtgatcagagtgctgttcctgagagaggagaacaacatcagcggcctgaaccaggacatcaccgacgtgtgcttcagccccgagaaggaccacagcagcaagagcgccaccagccaggtgtactggaccgccaagacccagcacaccagcctgcccctgagcaaggcccccgagaacgagcacctgctgggcgccgccagcaaccccgaggagccctggagaaacagcctgagatgcatcagcgagatgaacagactgttcagcggcaagggcgacatcaccaagcccggctacgacccctgcaacctgctggtggacctggacgacatcagagacctgagcagcggcttcagcaagtacagagacttcatcagatacctgcccatccacctgagcaagtacatcctgagaatgctggacagacacaccctgaacaagtgcgccagcgtgagccagcactgggccgccatggcccagcaggtgaagatggacctgagcgcccacggcttcatccagaaccagatcaccttcctgcagggcagctacaccagaggcatcgaccccaactacgccaacaaggtgagcatccccgtgcccaagatggtggacgacggcaagagcatgagagtgaagcaccccaagtggaagctgagaaccaagaacgagtacaacctgtggaccgcctaccagaacgaggagacccagcaggtgctgatcgaggagagaaacgtgttctgcggcacctacaacgtgagaatcctgagcgacacctgggaccagaacagagtgatccactacagcggcggcgacctgatcgccgtgagcagcaacagaaagatccacctgctggacatcatccaggtgaaggccatccccgtggagttcagaggccacgccggcagcgtgagagccctgttcctgtgcgaggaggagaacttcctgctgagcggcagctacgacctgagcatcagatactgggacctgaagagcggcgtgtgcaccagaatcttcggcggccaccagggcaccatcacctgcatggacctgtgcaagaacagactggtgagcggcggcagagactgccaggtgaaggtgtgggacgtggacaccggcaagtgcctgaagaccttcagacacaaggaccccatcctggccaccagaatcaacgacacctacatcgtgagcagctgcgagagaggcctggtgaaggtgtggcacatcgccatggcccagctggtgaagaccctgagcggccacgagggcgccgtgaagtgcctgttcttcgaccagtggcacctgctgagcggcagcaccgacggcctggtgatggcctggagcatggtgggcaagtacgagagatgcctgatggccttcaagcaccccaaggaggtgctggacgtgagcctgctgttcctgagagtgatcagcgcctgcgccgacggcaagatcagaatctacaacttcctgaacggcaactgcatgaaggtgctgaaggccaacggcagaggcgaccccgtgctgagcttcttcatccagggcaacagaatggtggtgaacaccgagagcaacgtgctgatgttccagttcgagcacatcaagtggcagtacgccgtggagaagaccaagcagaagaagaacaaggagaaggaggaggagaaggaggagaacagcctgatggagatcctgagcaagtgcaacatccaggtgcacagccccagagagagcgtgagcagcaagcagaccgtgatccaggagctgctgcccggcaagccccccaagagcagagtgctgctgaagcccgccaagttcagcagcgccgtgctgatcgaggagctgcagagccagggcaagagcaagagccccagaagagacgacgacgtggagaaggcccagaagcagggccagctggagacccccggcaagctgcccagccaccccaagaagaagagctggaagatccccatgagccccgaccagttcctgctgaccgtgagcgccctgcagcacgcccacaacagcggcgagttcgcctacccctgcagaccccagaccgagatcaccgacgtgtggggccccagcatcagctaccccagaaaggtgctgaacttcaagggcaagagcatccagagagccgtggacagactgagactgagcaacccccccatcgacgtgaagagaaccagcatccccctggagatccagaagctgcagcccaacctgaagatcagcctgcacagccccagagtgcagagcaccatcccccagcccatgatcatcagaagcagattcagcggcagcctgaagggcggcgaccaggtgaccagcagcatcgagagagccgtgtgcagcaccggccccctgaccagcatgcaggtgatcaagcccaacagaatgctggccccccaggtgggcaccgccaccctgagcctgaagaaggagagacccagaatctacaccgccctggaccccttcagagtgaacaccgagttcgtgctgctgaccgtgaaggaggagaaggagcaccaggaggccaagatgaaggagtaccaggccagagagagcaccggcgtggtggaccccggcaaggtgagcaaggccgcctggatcagaaagatcaagggcctgcccatcgacaacttcaccaagcagggcaagaccgccgcccccgagctgggccagaacgtgttcatctag

SEQ ID NO: 81369 - DNA, 1629 bp, Artificial Sequence
  Description of Artificial Sequence: Synthetic coding sequence
atggagcccgacagcgtgatcgaggacaagaccatcgagctgatgtgcagcgtgcccagaagcctgtggctgggctgcgccaacctggtggagagcatgtgcgccctgagctgcctgcagagcatgcccagcgtgagatgcctgcagatcagcaacggcaccagcagcgtgatcgtgagcagaaagagacccagcgagggcaactaccagaaggagaaggacctgtgcatcaagtacttcgaccagtggagcgagagcgaccaggtggagttcgtggagcacctgatcagcagaatgtgccactaccagcacggccacatcaacagctacctgaagcccatgctgcagagagacttcatcaccgccctgcccgagcagggcctggaccacatcgccgagaacatcctgagctacctggacgccagaagcctgtgcgccgccgagctggtgtgcaaggagtggcagagagtgatcagcgagggcatgctgtggaagaagctgatcgagagaatggtgagaaccgaccccctgtggaagggcctgagcgagagaagaggctgggaccagtacctgttcaagaacagacccaccgacggcccccccaacagcttctacagaagcctgtaccccaagatcatccaggacatcgagaccatcgagagcaactggagatgcggcagacacaacctgcagagaatccagtgcagaagcgagaacagcaagggcgtgtactgcctgcagtacgacgacgagaagatcatcagcggcctgagagacaacagcatcaagatctgggacaagaccagcctggagtgcctgaaggtgctgaccggccacaccggcagcgtgctgtgcctgcagtacgacgagagagtgatcgtgaccggcagcagcgacagcaccgtgagagtgtgggacgtgaacaccggcgaggtgctgaacaccctgatccaccacaacgaggccgtgctgcacctgagattcagcaacggcctgatggtgacctgcagcaaggacagaagcatcgccgtgtgggacatggccagcgccaccgacatcaccctgagaagagtgctggtgggccacagagccgccgtgaacgtggtggacttcgacgacaagtacatcgtgagcgccagcggcgacagaaccatcaaggtgtggagcaccagcacctgcgagttcgtgagaaccctgaacggccacaagagaggcatcgcctgcctgcagtacagagacagactggtggtgagcggcagcagcgacaacaccatcagactgtgggacatcgagtgcggcgcctgcctgagagtgctggagggccacgaggagctggtgagatgcatcagattcgacaacaagagaatcgtgagcggcgcctacgacggcaagatcaaggtgtgggacctgcaggccgccctggaccccagagcccccgccagcaccctgtgcctgagaaccctggtggagcacagcggcagagtgttcagactgcagttcgacgagttccagatcatcagcagcagccacgacgacaccatcctgatctgggacttcctgaacgtgccccccagcgcccagaacgagaccagaagccccagcagaacctacacctacatcagcagatag

SEQ ID NO: 81370 - DNA, 1590 bp, Artificial Sequence
  Description of Artificial Sequence: Synthetic coding sequence
atggagcccgacagcgtgatcgaggacaagaccatcgagctgatgaacaccagcgtgatggaggaccagaacgaggacgagagccccaagaagaacaccctgtggcagatcagcaacggcaccagcagcgtgatcgtgagcagaaagagacccagcgagggcaactaccagaaggagaaggacctgtgcatcaagtacttcgaccagtggagcgagagcgaccaggtggagttcgtggagcacctgatcagcagaatgtgccactaccagcacggccacatcaacagctacctgaagcccatgctgcagagagacttcatcaccgccctgcccgagcagggcctggaccacatcgccgagaacatcctgagctacctggacgccagaagcctgtgcgccgccgagctggtgtgcaaggagtggcagagagtgatcagcgagggcatgctgtggaagaagctgatcgagagaatggtgagaaccgaccccctgtggaagggcctgagcgagagaagaggctgggaccagtacctgttcaagaacagacccaccgacggcccccccaacagcttctacagaagcctgtaccccaagatcatccaggacatcgagaccatcgagagcaactggagatgcggcagacacaacctgcagagaatccagtgcagaagcgagaacagcaagggcgtgtactgcctgcagtacgacgacgagaagatcatcagcggcctgagagacaacagcatcaagatctgggacaagaccagcctggagtgcctgaaggtgctgaccggccacaccggcagcgtgctgtgcctgcagtacgacgagagagtgatcgtgaccggcagcagcgacagcaccgtgagagtgtgggacgtgaacaccggcgaggtgctgaacaccctgatccaccacaacgaggccgtgctgcacctgagattcagcaacggcctgatggtgacctgcagcaaggacagaagcatcgccgtgtgggacatggccagcgccaccgacatcaccctgagaagagtgctggtgggccacagagccgccgtgaacgtggtggacttcgacgacaagtacatcgtgagcgccagcggcgacagaaccatcaaggtgtggagcaccagcacctgcgagttcgtgagaaccctgaacggccacaagagaggcatcgcctgcctgcagtacagagacagactggtggtgagcggcagcagcgacaacaccatcagactgtgggacatcgagtgcggcgcctgcctgagagtgctggagggccacgaggagctggtgagatgcatcagattcgacaacaagagaatcgtgagcggcgcctacgacggcaagatcaaggtgtgggacctgcaggccgccctggaccccagagcccccgccagcaccctgtgcctgagaaccctggtggagcacagcggcagagtgttcagactgcagttcgacgagttccagatcatcagcagcagccacgacgacaccatcctgatctgggacttcctgaacgtgccccccagcgcccagaacgagaccagaagccccagcagaacctacacctacatcagcagatag

SEQ ID NO: 81371 - DNA, 1527 bp, Artificial Sequence
  Description of Artificial Sequence: Synthetic coding sequence
atggagcccgacagcgtgatcgaggacaagaccatcgagctgatgatcagcaacggcaccagcagcgtgatcgtgagcagaaagagacccagcgagggcaactaccagaaggagaaggacctgtgcatcaagtacttcgaccagtggagcgagagcgaccaggtggagttcgtggagcacctgatcagcagaatgtgccactaccagcacggccacatcaacagctacctgaagcccatgctgcagagagacttcatcaccgccctgcccgagcagggcctggaccacatcgccgagaacatcctgagctacctggacgccagaagcctgtgcgccgccgagctggtgtgcaaggagtggcagagagtgatcagcgagggcatgctgtggaagaagctgatcgagagaatggtgagaaccgaccccctgtggaagggcctgagcgagagaagaggctgggaccagtacctgttcaagaacagacccaccgacggcccccccaacagcttctacagaagcctgtaccccaagatcatccaggacatcgagaccatcgagagcaactggagatgcggcagacacaacctgcagagaatccagtgcagaagcgagaacagcaagggcgtgtactgcctgcagtacgacgacgagaagatcatcagcggcctgagagacaacagcatcaagatctgggacaagaccagcctggagtgcctgaaggtgctgaccggccacaccggcagcgtgctgtgcctgcagtacgacgagagagtgatcgtgaccggcagcagcgacagcaccgtgagagtgtgggacgtgaacaccggcgaggtgctgaacaccctgatccaccacaacgaggccgtgctgcacctgagattcagcaacggcctgatggtgacctgcagcaaggacagaagcatcgccgtgtgggacatggccagcgccaccgacatcaccctgagaagagtgctggtgggccacagagccgccgtgaacgtggtggacttcgacgacaagtacatcgtgagcgccagcggcgacagaaccatcaaggtgtggagcaccagcacctgcgagttcgtgagaaccctgaacggccacaagagaggcatcgcctgcctgcagtacagagacagactggtggtgagcggcagcagcgacaacaccatcagactgtgggacatcgagtgcggcgcctgcctgagagtgctggagggccacgaggagctggtgagatgcatcagattcgacaacaagagaatcgtgagcggcgcctacgacggcaagatcaaggtgtgggacctgcaggccgccctggaccccagagcccccgccagcaccctgtgcctgagaaccctggtggagcacagcggcagagtgttcagactgcagttcgacgagttccagatcatcagcagcagccacgacgacaccatcctgatctgggacttcctgaacgtgccccccagcgcccagaacgagaccagaagccccagcagaacctacacctacatcagcagatag

SEQ ID NO: 81372 - DNA, 1533 bp, Artificial Sequence
  Description of Artificial Sequence: Synthetic coding sequence
atggaggaccagaacgaggacgagagccccaagaagaacaccctgtggcagatcagcaacggcaccagcagcgtgatcgtgagcagaaagagacccagcgagggcaactaccagaaggagaaggacctgtgcatcaagtacttcgaccagtggagcgagagcgaccaggtggagttcgtggagcacctgatcagcagaatgtgccactaccagcacggccacatcaacagctacctgaagcccatgctgcagagagacttcatcaccgccctgcccgagcagggcctggaccacatcgccgagaacatcctgagctacctggacgccagaagcctgtgcgccgccgagctggtgtgcaaggagtggcagagagtgatcagcgagggcatgctgtggaagaagctgatcgagagaatggtgagaaccgaccccctgtggaagggcctgagcgagagaagaggctgggaccagtacctgttcaagaacagacccaccgacggcccccccaacagcttctacagaagcctgtaccccaagatcatccaggacatcgagaccatcgagagcaactggagatgcggcagacacaacctgcagagaatccagtgcagaagcgagaacagcaagggcgtgtactgcctgcagtacgacgacgagaagatcatcagcggcctgagagacaacagcatcaagatctgggacaagaccagcctggagtgcctgaaggtgctgaccggccacaccggcagcgtgctgtgcctgcagtacgacgagagagtgatcgtgaccggcagcagcgacagcaccgtgagagtgtgggacgtgaacaccggcgaggtgctgaacaccctgatccaccacaacgaggccgtgctgcacctgagattcagcaacggcctgatggtgacctgcagcaaggacagaagcatcgccgtgtgggacatggccagcgccaccgacatcaccctgagaagagtgctggtgggccacagagccgccgtgaacgtggtggacttcgacgacaagtacatcgtgagcgccagcggcgacagaaccatcaaggtgtggagcaccagcacctgcgagttcgtgagaaccctgaacggccacaagagaggcatcgcctgcctgcagtacagagacagactggtggtgagcggcagcagcgacaacaccatcagactgtgggacatcgagtgcggcgcctgcctgagagtgctggagggccacgaggagctggtgagatgcatcagattcgacaacaagagaatcgtgagcggcgcctacgacggcaagatcaaggtgtgggacctgcaggccgccctggaccccagagcccccgccagcaccctgtgcctgagaaccctggtggagcacagcggcagagtgttcagactgcagttcgacgagttccagatcatcagcagcagccacgacgacaccatcctgatctgggacttcctgaacgtgccccccagcgcccagaacgagaccagaagccccagcagaacctacacctacatcagcagatag

SEQ ID NO: 81373 - DNA, 1395 bp, Artificial Sequence
  Description of Artificial Sequence: Synthetic coding sequence
atggagatcagactgcccgacctggccctgaagagaatcttcagcttcctggacctgttcggcctgctgcaggtgagccaggtgaacaagcactggaacagaatcgccgacagcgactacctgtggagaagcctgagcctgcagagatgggactgcagcaacttcaccaaccagcacctgggcacccacacctggaagcagttcttcctgcaccagagaagaaaggagctgagactggccctggcccagccccacaacttcatctacaaggtgaccaagaacatcgccttcgagaccgagctggcctacctgagcggcaacagactgaccgtggacgagcaggagaagagcatcatctgcagcgtgagccccaagcaggagctgtgcgcctgggacgtgcaggagggcaccatgatctggagcagccccgtgcaggagttccacttcagcaacctggtgaccctgccccagatgcacctggccatcaccatggacagaaagaagaccatcaaggtgtggaactgccaggacagagacgccctggccgtgctgcccatgccccagccctgctactgcatggaggcctacctgaccaaggacggccccttcctgatggtgggcgacgccgccggcgacatctacaccttcaccctgcccggcctgagagacgtgagcaaggtgaccgccttccagtacggcatcgtgctgctgcactgcagccccgacaagaagtgggtgttcgcctgcggcacctacagcagaaccctgccccaggtgttcctgaccgagagcctgctgagacccagcgagggcagcgtgcccctgagcaccttcctgccccacaagctgtgcgccagcgcctgctggacccccaaggtgaagaacagaatcaccctgatgagccagagcagcaccggcaagaagaccgagttcatcaccttcgacctgaccaccaagaagaccggcggccagaccgtgatccaggcctacgagatcgccagcttccaggtggccgcccacctgaagtgccccatctggatgggcgccagcgacggctacatgatcgtgttcaccagcggcccctacctgctgctgttcagcatcaccggcttcctgctgcagagattcgaggaccaccaggccgccatcaacaacttctgggtggacccctgctacgtgctgaccaccagcgagaacagcgtgcacgtgtacatgtgggaggagggcggcagacacccctacctgagaagctgctgccacctggagaacacctggcacgaccacaccaccgacagctgcatcagcagcgtgatgtgcgacaacgccagcatcgtgctgagagtgagaaaggtgagcgacagcagcatcctggtgatgtacagcctgaacacctag

SEQ ID NO: 81374 - DNA, 1092 bp, Artificial Sequence
  Description of Artificial Sequence: Synthetic coding sequence
atgctggccctgagagacgagccccacagccccgacagcagaagccaggccttcgagaccgagctggcctacctgagcggcaacagactgaccgtggacgagcaggagaagagcatcatctgcagcgtgagccccaagcaggagctgtgcgcctgggacgtgcaggagatgcacctggccatcaccatggacagaaagaagaccatcaaggtgtggaactgccaggacagagacgccctggccgtgctgcccatgccccagccctgctactgcatggaggcctacctgaccaaggacggccccttcctgatggtgggcgacgccgccggcgacatctacaccttcaccctgcccggcctgagagacgtgagcaaggtgaccgccttccagtacggcatcgtgctgctgcactgcagccccgacaagaagtgggtgttcgcctgcggcacctacagcagaaccctgccccaggtgttcctgaccgagagcctgctgagacccagcgagggcagcgtgcccctgagcaccttcctgccccacaagctgtgcgccagcgcctgctggacccccaaggtgaagaacagaatcaccctgatgagccagagcagcaccggcaagaagaccgagttcatcaccttcgacctgaccaccaagaagaccggcggccagaccgtgatccaggcctacgagatcgccagcttccaggtggccgcccacctgaagtgccccatctggatgggcgccagcgacggctacatgatcgtgttcaccagcggcccctacctgctgctgttcagcatcaccggcttcctgctgcagagattcgaggaccaccaggccgccatcaacaacttctgggtggacccctgctacgtgctgaccaccagcgagaacagcgtgcacgtgtacatgtgggaggagggcggcagacacccctacctgagaagctgctgccacctggagaacacctggcacgaccacaccaccgacagctgcatcagcagcgtgatgtgcgacaacgccagcatcgtgctgagagtgagaaaggtgagcgacagcagcatcctggtgatgtacagcctgaacacctag

SEQ ID NO: 81375 - DNA, 1185 bp, Artificial Sequence
  Description of Artificial Sequence: Synthetic coding sequence
atggagatcagactgcccgacctggccctgaagagaatcttcagcttcctggacctgttcggcctgctgcaggtgagccaggtgaacaagcactggaacagaatcgccgacagcgactacctgtggagaagcctgagcctgcagagatgggactgcagcaacttcaccaaccagcacctgggcacccacacctggaagcagttcttcctgcaccagagaagaaaggagctgagactggccctggcccagccccacaacttcatctacaaggtgaccaagaacatcgccttcgagaccgagctggcctacctgagcggcaacagactgaccgtggacgagcaggagaagagcatcatctgcagcgtgagccccaagcaggagctgtgcgcctgggacgtgcaggaggtgggcgacgccgccggcgacatctacaccttcaccctgcccggcctgagagacgtgagcaaggtgaccgccttccagtacggcatcgtgctgctgcactgcagccccgacaagaagtgggtgttcgcctgcggcacctacagcagaaccctgccccaggtgttcctgaccgagagcctgctgagacccagcgagggcagcgtgcccctgagcaccttcctgccccacaagctgtgcgccagcgcctgctggacccccaaggtgaagaacagaatcaccctgatgagccagagcagcaccggcaagaagaccgagttcatcaccttcgacctgaccaccaagaagaccggcggccagaccgtgatccaggcctacgagatcgccagcttccaggtggccgcccacctgaagtgccccatctggatgggcgccagcgacggctacatgatcgtgttcaccagcggcccctacctgctgctgttcagcatcaccggcttcctgctgcagagattcgaggaccaccaggccgccatcaacaacttctgggtggacccctgctacgtgctgaccaccagcgagaacagcgtgcacgtgtacatgtgggaggagggcggcagacacccctacctgagaagctgctgccacctggagaacacctggcacgaccacaccaccgacagctgcatcagcagcgtgatgtgcgacaacgccagcatcgtgctgagagtgagaaaggtgagcgacagcagcatcctggtgatgtacagcctgaacacctag

SEQ ID NO: 81376 - DNA, 1338 bp, Artificial Sequence
  Description of Artificial Sequence: Synthetic coding sequence
atgagccccacccaccagatccaggaccccaagcactggaacagaatcgccgacagcgactacctgtggagaagcctgagcctgcagagatgggactgcagcaacttcaccaaccagcacctgggcacccacacctggaagcagttcttcctgcaccagagaagaaaggagctgagactggccctggcccagccccacaacttcatctacaaggtgaccaagaacatcgccttcgagaccgagctggcctacctgagcggcaacagactgaccgtggacgagcaggagaagagcatcatctgcagcgtgagccccaagcaggagctgtgcgcctgggacgtgcaggagggcaccatgatctggagcagccccgtgcaggagttccacttcagcaacctggtgaccctgccccagatgcacctggccatcaccatggacagaaagaagaccatcaaggtgtggaactgccaggacagagacgccctggccgtgctgcccatgccccagccctgctactgcatggaggcctacctgaccaaggacggccccttcctgatggtgggcgacgccgccggcgacatctacaccttcaccctgcccggcctgagagacgtgagcaaggtgaccgccttccagtacggcatcgtgctgctgcactgcagccccgacaagaagtgggtgttcgcctgcggcacctacagcagaaccctgccccaggtgttcctgaccgagagcctgctgagacccagcgagggcagcgtgcccctgagcaccttcctgccccacaagctgtgcgccagcgcctgctggacccccaaggtgaagaacagaatcaccctgatgagccagagcagcaccggcaagaagaccgagttcatcaccttcgacctgaccaccaagaagaccggcggccagaccgtgatccaggcctacgagatcgccagcttccaggtggccgcccacctgaagtgccccatctggatgggcgccagcgacggctacatgatcgtgttcaccagcggcccctacctgctgctgttcagcatcaccggcttcctgctgcagagattcgaggaccaccaggccgccatcaacaacttctgggtggacccctgctacgtgctgaccaccagcgagaacagcgtgcacgtgtacatgtgggaggagggcggcagacacccctacctgagaagctgctgccacctggagaacacctggcacgaccacaccaccgacagctgcatcagcagcgtgatgtgcgacaacgccagcatcgtgctgagagtgagaaaggtgagcgacagcagcatcctggtgatgtacagcctgaacacctag

SEQ ID NO: 81377 - DNA, 1239 bp, Artificial Sequence
  Description of Artificial Sequence: Synthetic coding sequence
atggccgccgccgccggcgaggaggaggaggaggaggaggccgccagagagagcgccgccagacccgccgccggccccgccctgtggagactgcccgaggagctgctgctgctgatctgcagctacctggacatgagagccctgggcagactggcccaggtgtgcagatggctgagaagattcaccagctgcgacctgctgtggagaagaatcgccagagccagcctgaacagcggcttcaccagactgggcaccgacctgatgaccagcgtgcccgtgaaggagagagtgaaggtgagccagaactggagactgggcagatgcagagagggcatcctgctgaagtggagatgcagacagatgccctggatgcagctggaggacgacagcctgtacatcagccaggccaacttcatcctggcctaccagttcagacccgacggcgccagcctgaacagaagacccctgggcgtgttcgccggccacgacgaggacgtgtgccacttcgtgctggccaacagccacatcgtgagcgccggcggcgacggcaagatcggcatccacaagatccacagcaccttcaccgtgaagtacagcgcccacgagcaggaggtgaactgcgtggactgcaagggcggcatcatcgtgagcggcagcagagacagaaccgccaaggtgtggcccctggccagcggcagactgggccagtgcctgcacaccatccagaccgaggacagagtgtggagcatcgccatcagccccctgctgagcagcttcgtgaccggcaccgcctgctgcggccacttcagccccctgagaatctgggacctgaacagcggccagctgatgacccacctgggcagcgacttcccccccggcgccggcgtgctggacgtgatgtacgagagccccttcaccctgctgagctgcggctacgacacctacgtgagatactgggacctgagaaccagcgtgagaaagtgcgtgatggagtgggaggagccccacgacagcaccctgtactgcctgcagaccgacggcaaccacctgctggccaccggcagcagctactacggcgtggtgagactgtgggacagaagacagagagcctgcctgcacgccttccccctgaccagcacccccctgagcagccccgtgtactgcctgagactgaccaccaagcacctgtacgccgccctgagctacaacctgcacgtgctggacttccagaacccctag

SEQ ID NO: 81378 - DNA, 1239 bp, Artificial Sequence
  Description of Artificial Sequence: Synthetic coding sequence
atggccgccgccgccggcgaggaggaggaggaggaggaggccgccagagagagcgccgccagacccgccgccggccccgccctgtggagactgcccgaggagctgctgctgctgatctgcagctacctggacatgagagccctgggcagactggcccaggtgtgcagatggctgagaagattcaccagctgcgacctgctgtggagaagaatcgccagagccagcctgaacagcggcttcaccagactgggcaccgacctgatgaccagcgtgcccgtgaaggagagagtgaaggtgagccagaactggagactgggcagatgcagagagggcatcctgctgaagtggagatgcagccagatgccctggatgcagctggaggacgacagcctgtacatcagccaggccaacttcatcctggcctaccagttcagacccgacggcgccagcctgaacagaagacccctgggcgtgttcgccggccacgacgaggacgtgtgccacttcgtgctggccaacagccacatcgtgagcgccggcggcgacggcaagatcggcatccacaagatccacagcaccttcaccgtgaagtacagcgcccacgagcaggaggtgaactgcgtggactgcaagggcggcatcatcgtgagcggcagcagagacagaaccgccaaggtgtggcccctggccagcggcagactgggccagtgcctgcacaccatccagaccgaggacagagtgtggagcatcgccatcagccccctgctgagcagcttcgtgaccggcaccgcctgctgcggccacttcagccccctgagaatctgggacctgaacagcggccagctgatgacccacctgggcagcgacttcccccccggcgccggcgtgctggacgtgatgtacgagagccccttcaccctgctgagctgcggctacgacacctacgtgagatactgggacctgagaaccagcgtgagaaagtgcgtgatggagtgggaggagccccacgacagcaccctgtactgcctgcagaccgacggcaaccacctgctggccaccggcagcagctactacggcgtggtgagactgtgggacagaagacagagagcctgcctgcacgccttccccctgaccagcacccccctgagcagccccgtgtactgcctgagactgaccaccaagcacctgtacgccgccctgagctacaacctgcacgtgctggacttccagaacccctag

SEQ ID NO: 81379 - DNA, 639 bp, Artificial Sequence
  Description of Artificial Sequence: Synthetic coding sequence
atgagagccctgggcagactggcccaggtgtgcagatggctgagaagattcaccagctgcgacctgctgtggagaagaatcgccagagccagcctgaacagcggcttcaccagactgggcaccgacctgatgaccagcgtgcccgtgaaggagagagtgaaggtgagccagaactggagactgggcagatgcagagagggcatcctgctgaagtggagatgcagacagatgccctggatgcagctggaggacgacagcctgtacatcagccaggccaacttcatcctggcctaccagttcagacccgacggcgccagcctgaacagaagacccctgggcgtgttcgccggccacgacgaggacgtgtgccacttcgtgctggccaacagccacatcgtgagcgccggcggcgacggcaagatcggcatccacaagatccacagcaccttcaccgtgaagtacagcgcccacgagcaggaggtgaactgcgtggactgcaagggcggcatcatcgtgagcggcagcagagacagaaccgccaaggtgtggcccctggccagcggcagactgggccagtgcctgcacaccatccagaccgaggacagagtgtggagcatcgccatcagccccctgctgtag

SEQ ID NO: 81380 - DNA, 576 bp, Artificial Sequence
  Description of Artificial Sequence: Synthetic coding sequence
atgaccagcgtgcccgtgaaggagagagtgaaggtgagccagaactggagactgggcagatgcagagagggcatcctgctgaagtggagatgcagacagatgccctggatgcagctggaggacgacagcctgtacatcagccaggccaacttcatcctggcctaccagttcagacccgacggcgccagcctgaacagaagacccctgggcgtgttcgccggccacgacgaggacgtgtgccacttcgtgctggccaacagccacatcgtgagcgccggcggcgacggcaagatcggcatccacaagatccacagcaccttcaccgtgaagtacagcgcccacgagcaggaggtgaactgcgtggactgcaagggcggcatcatcgtgagcggcagcagagacagaaccgccaaggtgtggcccctggccagcggcagactgggccagtgcctgcacaccatccagaccgaggacagagtgtggagcatcgccatcagccccctgctgagcagcttcgtgaccggcaccgcctgctgcggccacttcagccccctgagaatctgggacctgaactag

SEQ ID NO: 81381 - DNA, 1884 bp, Artificial Sequence
  Description of Artificial Sequence: Synthetic coding sequence
atgtgcgtgcccagaagcggcctgatcctgagctgcatctgcctgtactgcggcgtgctgctgcccgtgctgctgcccaacctgcccttcctgacctgcctgagcatgagcaccctggagagcgtgacctacctgcccgagaagggcctgtactgccagagactgcccagcagcagaacccacggcggcaccgagagcctgaagggcaagaacaccgagaacatgggcttctacggcaccctgaagatgatcttctacaagatgaagagaaagctggaccacggcagcgaggtgagaagcttcagcctgggcaagaagccctgcaaggtgagcgagtacaccagcaccaccggcctggtgccctgcagcgccacccccaccaccttcggcgacctgagagccgccaacggccagggccagcagagaagaagaatcaccagcgtgcagccccccaccggcctgcaggagtggctgaagatgttccagagctggagcggccccgagaagctgctggccctggacgagctgatcgacagctgcgagcccacccaggtgaagcacatgatgcaggtgatcgagccccagttccagagagacttcatcagcctgctgcccaaggagctggccctgtacgtgctgagcttcctggagcccaaggacctgctgcaggccgcccagacctgcagatactggagaatcctggccgaggacaacctgctgtggagagagaagtgcaaggaggagggcatcgacgagcccctgcacatcaagagaagaaaggtgatcaagcccggcttcatccacagcccctggaagagcgcctacatcagacagcacagaatcgacaccaactggagaagaggcgagctgaagagccccaaggtgctgaagggccacgacgaccacgtgatcacctgcctgcagttctgcggcaacagaatcgtgagcggcagcgacgacaacaccctgaaggtgtggagcgccgtgaccggcaagtgcctgagaaccctggtgggccacaccggcggcgtgtggagcagccagatgagagacaacatcatcatcagcggcagcaccgacagaaccctgaaggtgtggaacgccgagaccggcgagtgcatccacaccctgtacggccacaccagcaccgtgagatgcatgcacctgcacgagaagagagtggtgagcggcagcagagacgccaccctgagagtgtgggacatcgagaccggccagtgcctgcacgtgctgatgggccacgtggccgccgtgagatgcgtgcagtacgacggcagaagagtggtgagcggcgcctacgacttcatggtgaaggtgtgggaccccgagaccgagacctgcctgcacaccctgcagggccacaccaacagagtgtacagcctgcagttcgacggcatccacgtggtgagcggcagcctggacaccagcatcagagtgtgggacgtggagaccggcaactgcatccacaccctgaccggccaccagagcctgaccagcggcatggagctgaaggacaacatcctggtgagcggcaacgccgacagcaccgtgaagatctgggacatcaagaccggccagtgcctgcagaccctgcagggccccaacaagcaccagagcgccgtgacctgcctgcagttcaacaagaacttcgtgatcaccagcagcgacgacggcaccgtgaagctgtgggacctgaagaccggcgagttcatcagaaacctggtgaccctggagagcggcggcagcggcggcgtggtgtggagaatcagagccagcaacaccaagctggtgtgcgccgtgggcagcagaaacggcaccgaggagaccaagctgctggtgctggacttcgacgtggacatgaagtag

SEQ ID NO: 81382 - DNA, 2124 bp, Artificial Sequence
  Description of Artificial Sequence: Synthetic coding sequence
atgaaccaggagctgctgagcgtgggcagcaagagaagaagaaccggcggcagcctgagaggcaaccccagcagcagccaggtggacgaggagcagatgaacagagtggtggaggaggagcagcagcagcagctgagacagcaggaggaggagcacaccgccagaaacggcgaggtggtgggcgtggagcccagacccggcggccagaacgacagccagcagggccagctggaggagaacaacaacagattcatcagcgtggacgaggacagcagcggcaaccaggaggagcaggaggaggacgaggagcacgccggcgagcaggacgaggaggacgaggaggaggaggagatggaccaggagagcgacgacttcgaccagagcgacgacagcagcagagaggacgagcacacccacaccaacagcgtgaccaacagcagcagcatcgtggacctgcccgtgcaccagctgagcagccccttctacaccaagaccaccaagatgaagagaaagctggaccacggcagcgaggtgagaagcttcagcctgggcaagaagccctgcaaggtgagcgagtacaccagcaccaccggcctggtgccctgcagcgccacccccaccaccttcggcgacctgagagccgccaacggccagggccagcagagaagaagaatcaccagcgtgcagccccccaccggcctgcaggagtggctgaagatgttccagagctggagcggccccgagaagctgctggccctggacgagctgatcgacagctgcgagcccacccaggtgaagcacatgatgcaggtgatcgagccccagttccagagagacttcatcagcctgctgcccaaggagctggccctgtacgtgctgagcttcctggagcccaaggacctgctgcaggccgcccagacctgcagatactggagaatcctggccgaggacaacctgctgtggagagagaagtgcaaggaggagggcatcgacgagcccctgcacatcaagagaagaaaggtgatcaagcccggcttcatccacagcccctggaagagcgcctacatcagacagcacagaatcgacaccaactggagaagaggcgagctgaagagccccaaggtgctgaagggccacgacgaccacgtgatcacctgcctgcagttctgcggcaacagaatcgtgagcggcagcgacgacaacaccctgaaggtgtggagcgccgtgaccggcaagtgcctgagaaccctggtgggccacaccggcggcgtgtggagcagccagatgagagacaacatcatcatcagcggcagcaccgacagaaccctgaaggtgtggaacgccgagaccggcgagtgcatccacaccctgtacggccacaccagcaccgtgagatgcatgcacctgcacgagaagagagtggtgagcggcagcagagacgccaccctgagagtgtgggacatcgagaccggccagtgcctgcacgtgctgatgggccacgtggccgccgtgagatgcgtgcagtacgacggcagaagagtggtgagcggcgcctacgacttcatggtgaaggtgtgggaccccgagaccgagacctgcctgcacaccctgcagggccacaccaacagagtgtacagcctgcagttcgacggcatccacgtggtgagcggcagcctggacaccagcatcagagtgtgggacgtggagaccggcaactgcatccacaccctgaccggccaccagagcctgaccagcggcatggagctgaaggacaacatcctggtgagcggcaacgccgacagcaccgtgaagatctgggacatcaagaccggccagtgcctgcagaccctgcagggccccaacaagcaccagagcgccgtgacctgcctgcagttcaacaagaacttcgtgatcaccagcagcgacgacggcaccgtgaagctgtgggacctgaagaccggcgagttcatcagaaacctggtgaccctggagagcggcggcagcggcggcgtggtgtggagaatcagagccagcaacaccaagctggtgtgcgccgtgggcagcagaaacggcaccgaggagaccaagctgctggtgctggacttcgacgtggacatgaagtag

SEQ ID NO: 81383 - DNA, 1770 bp, Artificial Sequence
  Description of Artificial Sequence: Synthetic coding sequence
atgagcaagcccggcaagcccaccctgaaccacggcctggtgcccgtggacctgaagagcgccaaggagcccctgccccaccagaccgtgatgaagatcttcagcatcagcatcatcgcccagggcctgcccttctgcagaagaagaatgaagagaaagctggaccacggcagcgaggtgagaagcttcagcctgggcaagaagccctgcaaggtgagcgagtacaccagcaccaccggcctggtgccctgcagcgccacccccaccaccttcggcgacctgagagccgccaacggccagggccagcagagaagaagaatcaccagcgtgcagccccccaccggcctgcaggagtggctgaagatgttccagagctggagcggccccgagaagctgctggccctggacgagctgatcgacagctgcgagcccacccaggtgaagcacatgatgcaggtgatcgagccccagttccagagagacttcatcagcctgctgcccaaggagctggccctgtacgtgctgagcttcctggagcccaaggacctgctgcaggccgcccagacctgcagatactggagaatcctggccgaggacaacctgctgtggagagagaagtgcaaggaggagggcatcgacgagcccctgcacatcaagagaagaaaggtgatcaagcccggcttcatccacagcccctggaagagcgcctacatcagacagcacagaatcgacaccaactggagaagaggcgagctgaagagccccaaggtgctgaagggccacgacgaccacgtgatcacctgcctgcagttctgcggcaacagaatcgtgagcggcagcgacgacaacaccctgaaggtgtggagcgccgtgaccggcaagtgcctgagaaccctggtgggccacaccggcggcgtgtggagcagccagatgagagacaacatcatcatcagcggcagcaccgacagaaccctgaaggtgtggaacgccgagaccggcgagtgcatccacaccctgtacggccacaccagcaccgtgagatgcatgcacctgcacgagaagagagtggtgagcggcagcagagacgccaccctgagagtgtgggacatcgagaccggccagtgcctgcacgtgctgatgggccacgtggccgccgtgagatgcgtgcagtacgacggcagaagagtggtgagcggcgcctacgacttcatggtgaaggtgtgggaccccgagaccgagacctgcctgcacaccctgcagggccacaccaacagagtgtacagcctgcagttcgacggcatccacgtggtgagcggcagcctggacaccagcatcagagtgtgggacgtggagaccggcaactgcatccacaccctgaccggccaccagagcctgaccagcggcatggagctgaaggacaacatcctggtgagcggcaacgccgacagcaccgtgaagatctgggacatcaagaccggccagtgcctgcagaccctgcagggccccaacaagcaccagagcgccgtgacctgcctgcagttcaacaagaacttcgtgatcaccagcagcgacgacggcaccgtgaagctgtgggacctgaagaccggcgagttcatcagaaacctggtgaccctggagagcggcggcagcggcggcgtggtgtggagaatcagagccagcaacaccaagctggtgtgcgccgtgggcagcagaaacggcaccgaggagaccaagctgctggtgctggacttcgacgtggacatgaagtag

SEQ ID NO: 81384 - DNA, 1596 bp, Artificial Sequence
  Description of Artificial Sequence: Synthetic coding sequence
atgctgttcttcaagtgcatcagcctgctgctgatctggctgatccccggccagagcaccaccggcctggtgccctgcagcgccacccccaccaccttcggcgacctgagagccgccaacggccagggccagcagagaagaagaatcaccagcgtgcagccccccaccggcctgcaggagtggctgaagatgttccagagctggagcggccccgagaagctgctggccctggacgagctgatcgacagctgcgagcccacccaggtgaagcacatgatgcaggtgatcgagccccagttccagagagacttcatcagcctgctgcccaaggagctggccctgtacgtgctgagcttcctggagcccaaggacctgctgcaggccgcccagacctgcagatactggagaatcctggccgaggacaacctgctgtggagagagaagtgcaaggaggagggcatcgacgagcccctgcacatcaagagaagaaaggtgatcaagcccggcttcatccacagcccctggaagagcgcctacatcagacagcacagaatcgacaccaactggagaagaggcgagctgaagagccccaaggtgctgaagggccacgacgaccacgtgatcacctgcctgcagttctgcggcaacagaatcgtgagcggcagcgacgacaacaccctgaaggtgtggagcgccgtgaccggcaagtgcctgagaaccctggtgggccacaccggcggcgtgtggagcagccagatgagagacaacatcatcatcagcggcagcaccgacagaaccctgaaggtgtggaacgccgagaccggcgagtgcatccacaccctgtacggccacaccagcaccgtgagatgcatgcacctgcacgagaagagagtggtgagcggcagcagagacgccaccctgagagtgtgggacatcgagaccggccagtgcctgcacgtgctgatgggccacgtggccgccgtgagatgcgtgcagtacgacggcagaagagtggtgagcggcgcctacgacttcatggtgaaggtgtgggaccccgagaccgagacctgcctgcacaccctgcagggccacaccaacagagtgtacagcctgcagttcgacggcatccacgtggtgagcggcagcctggacaccagcatcagagtgtgggacgtggagaccggcaactgcatccacaccctgaccggccaccagagcctgaccagcggcatggagctgaaggacaacatcctggtgagcggcaacgccgacagcaccgtgaagatctgggacatcaagaccggccagtgcctgcagaccctgcagggccccaacaagcaccagagcgccgtgacctgcctgcagttcaacaagaacttcgtgatcaccagcagcgacgacggcaccgtgaagctgtgggacctgaagaccggcgagttcatcagaaacctggtgaccctggagagcggcggcagcggcggcgtggtgtggagaatcagagccagcaacaccaagctggtgtgcgccgtgggcagcagaaacggcaccgaggagaccaagctgctggtgctggacttcgacgtggacatgaagtag

SEQ ID NO: 81385 - DNA, 1797 bp, Artificial Sequence
  Description of Artificial Sequence: Synthetic coding sequence
atggacgactacagcctggacgagttcagaagaagatggcaggaggagctggcccaggcccaggcccccaagaagagaagaagacccgaggccgccgagagaagagccagaagacccgaggtgggcagcggcagaggcgagcaggccagcggcgaccccgccctggcccagagactgctggagggcgccggcagaccccccgccgccagagccaccagagccgagggccaggacgtggccagcagaagcagaagccccctggccagagagggcgccggcggcggcgagcagctggtggaccagctgatcagagacctgaacgagatgaacgacgtgcccttcttcgacatccagctgccctacgagctggccatcaacatcttccagtacctggacagaaaggagctgggcagatgcgcccaggtgagcaagacctggaaggtgatcgccgaggacgaggtgctgtggtacagactgtgccagcaggagggccacctgcccgacagcagcatcagcgactacagctgctggaagctgatcttccaggagtgcagagccaaggagcacatgctgagaaccaactggaagaacagaaagggcgccgtgagcgagctggagcacgtgcccgacaccgtgctgtgcgacgtgcacagccacgacggcgtggtgatcgccggctacaccagcggcgacgtgagagtgtgggacaccagaacctgggactacgtggcccccttcctggagagcgaggacgaggaggacgagcccggcatgcagcccaacgtgagcttcgtgagaatcaacagcagcctggccgtggccgcctacgaggacggcttcctgaacatctgggacctgagaaccggcaagtaccccgtgcacagattcgagcacgacgccagaatccaggccctggccctgagccaggacgacgccaccgtggccaccgccagcgccttcgacgtggtgatgctgagccccaacgaggagggctactggcagatcgccgccgagttcgaggtgcccaagctggtgcagtacctggagatcgtgcccgagaccagaagataccccgtggccgtggccgccgccggcgacctgatgtacctgctgaaggccgaggacagcgccagaaccctgctgtacgcccacggcccccccgtgacctgcctggacgtgagcgccaaccaggtggccttcggcgtgcagggcctgggctgggtgtacgagggcagcaagatcctggtgtacagcctggaggccggcagaagactgctgaagctgggcaacgtgctgagagacttcacctgcgtgaacctgagcgacagcccccccaacctgatggtgagcggcaacatggacggcagagtgagaatccacgacctgagaagcggcaacatcgccctgagcctgagcgcccaccagctgagagtgagcgccgtgcagatggacgactggaagatcgtgagcggcggcgaggagggcctggtgagcgtgtgggactacagaatgaaccagaagctgtgggaggtgtacagcggccaccccgtgcagcacatcagcttcagcagccacagcctgatcaccgccaacgtgccctaccagaccgtgatgagaaacgccgacctggacagcttcaccacccacagaagacacagaggcctgatcagagcctacgagttcgccgtggaccagctggccttccagagccccctgcccgtgtgcagaagcagctgcgacgccatggccacccactactacgacctggccctggccttcccctacaaccacgtgtag

SEQ ID NO: 81386 - DNA, 1599 bp, Artificial Sequence
  Description of Artificial Sequence: Synthetic coding sequence
atggacgactacagcctggacgagttcagaagaagatggcaggaggagctggcccaggcccaggcccccaagaagagaagaagacccgaggccgccgagagaagagccagaagacccgagaacgagatgaacgacgtgcccttcttcgacatccagctgccctacgagctggccatcaacatcttccagtacctggacagaaaggagctgggcagatgcgcccaggtgagcaagacctggaaggtgatcgccgaggacgaggtgctgtggtacagactgtgccagcaggagggccacctgcccgacagcagcatcagcgactacagctgctggaagctgatcttccaggagtgcagagccaaggagcacatgctgagaaccaactggaagaacagaaagggcgccgtgagcgagctggagcacgtgcccgacaccgtgctgtgcgacgtgcacagccacgacggcgtggtgatcgccggctacaccagcggcgacgtgagagtgtgggacaccagaacctgggactacgtggcccccttcctggagagcgaggacgaggaggacgagcccggcatgcagcccaacgtgagcttcgtgagaatcaacagcagcctggccgtggccgcctacgaggacggcttcctgaacatctgggacctgagaaccggcaagtaccccgtgcacagattcgagcacgacgccagaatccaggccctggccctgagccaggacgacgccaccgtggccaccgccagcgccttcgacgtggtgatgctgagccccaacgaggagggctactggcagatcgccgccgagttcgaggtgcccaagctggtgcagtacctggagatcgtgcccgagaccagaagataccccgtggccgtggccgccgccggcgacctgatgtacctgctgaaggccgaggacagcgccagaaccctgctgtacgcccacggcccccccgtgacctgcctggacgtgagcgccaaccaggtggccttcggcgtgcagggcctgggctgggtgtacgagggcagcaagatcctggtgtacagcctggaggccggcagaagactgctgaagctgggcaacgtgctgagagacttcacctgcgtgaacctgagcgacagcccccccaacctgatggtgagcggcaacatggacggcagagtgagaatccacgacctgagaagcggcaacatcgccctgagcctgagcgcccaccagctgagagtgagcgccgtgcagatggacgactggaagatcgtgagcggcggcgaggagggcctggtgagcgtgtgggactacagaatgaaccagaagctgtgggaggtgtacagcggccaccccgtgcagcacatcagcttcagcagccacagcctgatcaccgccaacgtgccctaccagaccgtgatgagaaacgccgacctggacagcttcaccacccacagaagacacagaggcctgatcagagcctacgagttcgccgtggaccagctggccttccagagccccctgcccgtgtgcagaagcagctgcgacgccatggccacccactactacgacctggccctggccttcccctacaaccacgtgtag

SEQ ID NO: 81387 - DNA, 1599 bp, Artificial Sequence; identical to SEQ ID NO: 81386
  Description of Artificial Sequence: Synthetic coding sequence

SEQ ID NO: 81388 - DNA, 2871 bp, Artificial Sequence
  Description of Artificial Sequence: Synthetic coding sequence
atggaggccggcggcctgcccctggagctgtggagaatgatcctggcctacctgcacctgcccgacctgggcagatgcagcctggtgtgcagagcctggtacgagctgatcctgagcctggacagcaccagatggagacagctgtgcctgggctgcaccgagtgcagacaccccaactggcccaaccagcccgacgtggagcccgagagctggagagaggccttcaagcagcactacctggccagcaagacctggaccaagaacgccctggacctggagagcagcatctgcttcagcctgttcagaagaagaagagagagaagaaccctgagcgtgggccccggcagagagttcgacagcctgggcagcgccctggccatggccagcctgtacgacagaatcgtgctgttccccggcgtgtacgaggagcagggcgagatcatcctgaaggtgcccgtggagatcgtgggccagggcaagctgggcgaggtggccctgctggccagcatcgaccagcactgcagcaccaccagactgtgcaacctggtgttcacccccgcctggttcagccccatcatgtacaagaccaccagcggccacgtgcagttcgacaactgcaacttcgagaacggccacatccaggtgcacggccccggcacctgccaggtgaagttctgcaccttcaagaacacccacatcttcctgcacaacgtgcccctgtgcgtgctggagaactgcgagttcgtgggcagcgagaacaacagcgtgaccgtggagggccaccccagcgccgacaagaactgggcctacaagtacctgctgggcctgatcaagagcagccccaccttcctgcccaccgaggacagcgacttcctgatgagcctggacctggagagcagagaccaggcctggagccccaagacctgcgacatcgtgatcgagggcagccagagccccaccagccccgccagcagcagccccaagcccggcagcaaggccggcagccaggaggccgaggtgggcagcgacggcgagagagtggcccagacccccgacagcagcgacggcggcctgagccccagcggcgaggacgaggacgaggaccagctgatgtacagactgagctaccaggtgcagggccccagacccgtgctgggcggcagcttcctgggcccccccctgcccggcgccagcatccagctgcccagctgcctggtgctgaacagcctgcagcaggagctgcagaaggacaaggaggccatggccctggccaacagcgtgcagggctgcctgatcagaaagtgcctgttcagagacggcaagggcggcgtgttcgtgtgcagccacggcagagccaagatggagggcaacatcttcagaaacctgacctacgccgtgagatgcatccacaacagcaagatcatcatgctgagaaacgacatctacagatgcagagccagcggcatcttcctgagactggagggcggcggcctgatcgccggcaacaacatctaccacaacgccgaggccggcgtggacatcagaaagaagagcaaccccctgatcctgtgcaaccagatccaccacggcctgagaagcggcatcgtggtgctgggcaacggcaagggcatcatcagaaacaaccagatcttcagcaacaaggaggccggcatctacatcctgtaccacggcaaccccgtggtgagcggcaaccacatcttcaagggcagagccgccggcatcgccgtgaacgagaacggcaagggcctgatcaccgagaacgtgatcagagagaaccagtggggcggcgtggacatcagaagaggcggcatccccgtgctgagaagcaacctgatctgcttcggctacagcgacggcgtggtggtgggcgacgagggcaagggcctgatcgagggcaacaccatctacgccaacaagggctgcggcgtgtggatgatgagcagcagcctgccccacgtgaccagcaaccacgtgagctacaacggcctgtacggcgtggccgtgttcagccagaaggacggcagcagcgagctgcccagaggccacagagcccaggagaacttcagcgaggacggcgacgccatcctgtgggagaccgagctggagaaggaggacgaccccctgagaagacccatcaccatcgccctggtggagagcaacagcatcaaccacaacggcgccagcggcctgtacgtgcagagcagcgaggccctgcacgtgatcaccaacgtgatccacgccaacggcgacagaggcatcaccgtggcccagagcagccagcccaccagagtggccaacaacagcatcagctgcaacagacagagcggcgtgaaggtggaggcccagtgcaaggtggagctgagaggcaacggcatctacgacaacagaggccacggcatcatcaccaagggcgacagcaccatcgtgatcgagaacgacatcatcggcaacagaggcagcggcctgcagctgctgcccagaagcgacaccaaggtgatcaagaacagaatccacagcttcagagcctacggcatcgccgtgagaggcagagccaaggccctggtgcaggagaacatcatcttccagggcaagaccagcaagaccatcttccagcagatcagcaacaacagagagtgcatcatgcagaacaacaagttcctggtgttcaagaagaagagcgacacctggagactggtgaacccccccgccagaccccacctggagaacagcctgagaagacccagcgccgcccacaacggccagaaggtgaccgccatggccaccagaatcaccgccagagtggagggcggctaccacagcaacagaagcgtgttctgcaccatcctgtag

SEQ ID NO: 81389 - DNA, 216 bp, Artificial Sequence
  Description of Artificial Sequence: Synthetic coding sequence
atggaggccggcggcctgcccctggagctgtggagaatgatcctggcctacctgcacctgcccgacctgggcagatgcagcctggtgtgcagagcctggtacgagctgatcctgagcctggacagcaccagatggagacagctgtgcctgggctgcaccgagtgcagacaccccaactggcccaaccagcccgacgtggagcccgagagctggtag

SEQ ID NO: 81390 - DNA, 1446 bp, Artificial Sequence
  Description of Artificial Sequence: Synthetic coding sequence
atgctgagaaacgacatctacagatgcagagccagcggcatcttcctgagactggagggcggcggcctgatcgccggcaacaacatctaccacaacgccgaggccggcgtggacatcagaaagaagagcaaccccctgatcctgtgcaaccagatccaccacggcctgagaagcggcatcgtggtgctgggcaacggcaagggcatcatcagaaacaaccagatcttcagcaacaaggaggccggcatctacatcctgtaccacggcaaccccgtggtgagcggcaaccacatcttcaagggcagagccgccggcatcgccgtgaacgagaacggcaagggcctgatcaccgagaacgtgatcagagagaaccagtggggcggcgtggacatcagaagaggcggcatccccgtgctgagaagcaacctgatctgcttcggctacagcgacggcgtggtggtgggcgacgagggcaagggcctgatcgagggcaacaccatctacgccaacaagggctgcggcgtgtggatgatgagcagcagcctgccccacgtgaccagcaaccacgtgagctacaacggcctgtacggcgtggccgtgttcagccagaaggacggcagcagcgagctgcccagaggccacagagcccaggagaacttcagcgaggacggcgacgccatcctgtgggagaccgagctggagaaggaggacgaccccctgagaagacccatcaccatcgccctggtggagagcaacagcatcaaccacaacggcgccagcggcctgtacgtgcagagcagcgaggccctgcacgtgatcaccaacgtgatccacgccaacggcgacagaggcatcaccgtggcccagagcagccagcccaccagagtggccaacaacagcatcagctgcaacagacagagcggcgtgaaggtggaggcccagtgcaaggtggagctgagaggcaacggcatctacgacaacagaggccacggcatcatcaccaagggcgacagcaccatcgtgatcgagaacgacatcatcggcaacagaggcagcggcctgcagctgctgcccagaagcgacaccaaggtgatcaagaacagaatccacagcttcagagcctacggcatcgccgtgagaggcagagccaaggccctggtgcaggagaacatcatcttccagggcaagaccagcaagaccatcttccagcagatcagcaacaacagagagtgcatcatgcagaacaacaagttcctggtgttcaagaagaagagcgacacctggagactggtgaacccccccgccagaccccacctggagaacagcctgagaagacccagcgccgcccacaacggccagaaggtgaccgccatggccaccagaatcaccgccagagtggagggcggctaccacagcaacagaagcgtgttctgcaccatcctgtag

SEQ ID NO: 81391 - DNA, 2532 bp, Artificial Sequence
  Description of Artificial Sequence: Synthetic coding sequence
atggtggccgaggagagcggccccggcgcccagaacagcccctaccagctgagaagaaagaccctgctgcccaagagaaccgcctgccccaccaagaacagcatggagggcgccagcaccagcaccaccgagaacttcggccacagagccaagagagccagagtgagcggcaagagccaggacctgagcgccgcccccgccgagcagtacctgcaggagaagctgcccgacgaggtggtgctgaagatcttcagctacctgctggagcaggacctgtgcagagccgcctgcgtgtgcaagagattcagcgagctggccaacgaccccatcctgtggaagagactgtacatggaggtgttcgagtacaccagacccatgatgcaccccgagcccggcaagttctaccagatcaaccccgaggagtacgagcaccccaacccctggaaggagagcttccagcagctgtacaagggcgcccacgtgaagcccggcttcgccgagcacttctacagcaaccccgccagatacaagggcagagagaacatgctgtactacgacaccatcgaggacgccctgggcggcgtgcaggaggcccacttcgacggcctgatcttcgtgcacagcggcatctacaccgacgagtggatctacatcgagagccccatcaccatgatcggcgccgcccccggcaaggtggccgacaaggtgatcatcgagaacaccagagacagcaccttcgtgttcatggagggcagcgaggacgcctacgtgggctacatgaccatcagattcaaccccgacgacaagagcgcccagcaccacaacgcccaccactgcctggagatcaccgtgaactgcagccccatcatcgaccactgcatcatcagaagcacctgcaccgtgggcagcgccgtgtgcgtgagcggccagggcgcctgccccaccatcaagcactgcaacatcagcgactgcgagaacgtgggcctgtacatcaccgaccacgcccagggcatctacgaggacaacgagatcagcaacaacgccctggccggcatctgggtgaagaaccacggcaaccccatcatcagaagaaaccacatccaccacggcagagacgtgggcgtgttcaccttcgaccacggcatgggctacttcgagagctgcaacatccacagaaacagaatcgccggcttcgaggtgaaggcctacgccaaccccaccgtggtgagatgcgagatccaccacggccagaccggcggcatctacgtgcacgagaagggcagaggccagttcatcgagaacaagatctacgccaacaacttcgccggcgtgtggatcaccagcaacagcgaccccaccatcagaggcaacagcatcttcaacggcaaccagggcggcgtgtacatcttcggcgacggcagaggcctgatcgagggcaacgacatctacggcaacgccctggccggcatccagatcagaaccaacagctgccccatcgtgagacacaacaagatccacgacggccagcacggcggcatctacgtgcacgagaagggccagggcgtgatcgaggagaacgaggtgtacagcaacaccctggccggcgtgtgggtgaccaccggcagcacccccgtgctgagaagaaacagaatccacagcggcaagcaggtgggcgtgtacttctacgacaacggccacggcgtgctggaggacaacgacatctacaaccacatgtacagcggcgtgcagatcagaaccggcagcaaccccaagatcagaagaaacaagatctggggcggccagaacggcggcatcctggtgtacaacagcggcctgggctgcatcgaggacaacgagatcttcgacaacgccatggccggcgtgtggatcaagaccgacagcaaccccaccctgagaagaaacaagatccacgacggcagagacggcggcatctgcatcttcaacggcggcagaggcctgctggaggagaacgacatcttcagaaacgcccaggccggcgtgctgatcagcaccaacagccaccccatcctgagaaagaacagaatcttcgacggcttcgccgccggcatcgagatcaccaaccacgccaccgccaccctggagggcaaccagatcttcaacaacagattcggcggcctgttcctggccagcggcgtgaacgtgaccatgaaggacaacaagatcatgaacaaccaggacgccatcgagaaggccgtgagcagaggccagtgcctgtacaagatcagcagctacaccagctaccccatgcacgacttctacagatgccacacctgcaacaccaccgacagaaacgccatctgcgtgaactgcatcaagaagtgccaccagggccacgacgtggagttcatcagacacgacagattcttctgcgactgcggcgccggcaccctgagcaacccctgcaccctggccggcgagcccacccacgacaccgacaccctgtacgacagcgccccccccatcgagagcaacaccctgcagcacaactag

SEQ ID NO: 81392 - DNA, 282 bp, Artificial Sequence
  Description of Artificial Sequence: Synthetic coding sequence
atggagggcgccagcaccagcaccaccgagaacttcggccacagagccaagagagccagagtgagcggcaagagccaggacctgagcgccgcccccgccgagcagtacctgcaggagaagctgcccgacgaggtggtgctgaagatcttcagctacctgctggagcaggacctgtgcagagccgcctgcgtgtgcaagagattcagcgagctggccaacgaccccatcctgtggctgggcgaggtggcccacgcctacaaccccagcaccctgggcggctag

SEQ ID NO: 81393 - DNA, 2532 bp, Artificial Sequence; identical to SEQ ID NO: 81391
  Description of Artificial Sequence: Synthetic coding sequence

SEQ ID NO: 81394 - DNA, 2784 bp, Artificial Sequence
  Description of Artificial Sequence: Synthetic coding sequence
atgaacagcgtgagagccgccaacagaagacccagaagagtgagcagacccagacccgtgcagcagcagcagcagcagcccccccagcagccccccccccagcccccccagcagcagcccccccagcagcagccccccccccccccccagcagcagcagcagcagcagccccccccccccccccccccccccccccccctgccccaggagagaaacaacgtgggcgagagagacgacgacgtgcccgccgacatggtggccgaggagagcggccccggcgcccagaacagcccctaccagctgagaagaaagaccctgctgcccaagagaaccgcctgccccaccaagaacagcatggagggcgccagcaccagcaccaccgagaacttcggccacagagccaagagagccagagtgagcggcaagagccaggacctgagcgccgcccccgccgagcagtacctgcaggagaagctgcccgacgaggtggtgctgaagatcttcagctacctgctggagcaggacctgtgcagagccgcctgcgtgtgcaagagattcagcgagctggccaacgaccccatcctgtggaagagactgtacatggaggtgttcgagtacaccagacccatgatgcaccccgagcccggcaagttctaccagatcaaccccgaggagtacgagcaccccaacccctggaaggagagcttccagcagctgtacaagggcgcccacgtgaagcccggcttcgccgagcacttctacagcaaccccgccagatacaagggcagagagaacatgctgtactacgacaccatcgaggacgccctgggcggcgtgcaggaggcccacttcgacggcctgatcttcgtgcacagcggcatctacaccgacgagtggatctacatcgagagccccatcaccatgatcggcgccgcccccggcaaggtggccgacaaggtgatcatcgagaacaccagagacagcaccttcgtgttcatggagggcagcgaggacgcctacgtgggctacatgaccatcagattcaaccccgacgacaagagcgcccagcaccacaacgcccaccactgcctggagatcaccgtgaactgcagccccatcatcgaccactgcatcatcagaagcacctgcaccgtgggcagcgccgtgtgcgtgagcggccagggcgcctgccccaccatcaagcactgcaacatcagcgactgcgagaacgtgggcctgtacatcaccgaccacgcccagggcatctacgaggacaacgagatcagcaacaacgccctggccggcatctgggtgaagaaccacggcaaccccatcatcagaagaaaccacatccaccacggcagagacgtgggcgtgttcaccttcgaccacggcatgggctacttcgagagctgcaacatccacagaaacagaatcgccggcttcgaggtgaaggcctacgccaaccccaccgtggtgagatgcgagatccaccacggccagaccggcggcatctacgtgcacgagaagggcagaggccagttcatcgagaacaagatctacgccaacaacttcgccggcgtgtggatcaccagcaacagcgaccccaccatcagaggcaacagcatcttcaacggcaaccagggcggcgtgtacatcttcggcgacggcagaggcctgatcgagggcaacgacatctacggcaacgccctggccggcatccagatcagaaccaacagctgccccatcgtgagacacaacaagatccacgacggccagcacggcggcatctacgtgcacgagaagggccagggcgtgatcgaggagaacgaggtgtacagcaacaccctggccggcgtgtgggtgaccaccggcagcacccccgtgctgagaagaaacagaatccacagcggcaagcaggtgggcgtgtacttctacgacaacggccacggcgtgctggaggacaacgacatctacaaccacatgtacagcggcgtgcagatcagaaccggcagcaaccccaagatcagaagaaacaagatctggggcggccagaacggcggcatcctggtgtacaacagcggcctgggctgcatcgaggacaacgagatcttcgacaacgccatggccggcgtgtggatcaagaccgacagcaaccccaccctgagaagaaacaagatccacgacggcagagacggcggcatctgcatcttcaacggcggcagaggcctgctggaggagaacgacatcttcagaaacgcccaggccggcgtgctgatcagcaccaacagccaccccatcctgagaaagaacagaatcttcgacggcttcgccgccggcatcgagatcaccaaccacgccaccgccaccctggagggcaaccagatcttcaacaacagattcggcggcctgttcctggccagcggcgtgaacgtgaccatgaaggacaacaagatcatgaacaaccaggacgccatcgagaaggccgtgagcagaggccagtgcctgtacaagatcagcagctacaccagctaccccatgcacgacttctacagatgccacacctgcaacaccaccgacagaaacgccatctgcgtgaactgcatcaagaagtgccaccagggccacgacgtggagttcatcagacacgacagattcttctgcgactgcggcgccggcaccctgagcaacccctgcaccctggccggcgagcccacccacgacaccgacaccctgtacgacagcgccccccccatcgagagcaacaccctgcagcacaactag

SEQ ID NO: 81395 - DNA, 1056 bp, Artificial Sequence
  Description of Artificial Sequence: Synthetic coding sequence
atggagatcaaggaggagttcaccagcctggtgatggacgaggccctgctgaaggagatgaccttcatgcacgagaagggccagggcgtgatcgaggagaacgaggtgtacagcaacaccctggccggcgtgtgggtgaccaccggcagcacccccgtgctgagaagaaacagaatccacagcggcaagcaggtgggcgtgtacttctacgacaacggccacggcgtgctggaggacaacgacatctacaaccacatgtacagcggcgtgcagatcagaaccggcagcaaccccaagatcagaagaaacaagatctggggcggccagaacggcggcatcctggtgtacaacagcggcctgggctgcatcgaggacaacgagatcttcgacaacgccatggccggcgtgtggatcaagaccgacagcaaccccaccctgagaagaaacaagatccacgacggcagagacggcggcatctgcatcttcaacggcggcagaggcctgctggaggagaacgacatcttcagaaacgcccaggccggcgtgctgatcagcaccaacagccaccccatcctgagaaagaacagaatcttcgacggcttcgccgccggcatcgagatcaccaaccacgccaccgccaccctggagggcaaccagatcttcaacaacagattcggcggcctgttcctggccagcggcgtgaacgtgaccatgaaggacaacaagatcatgaacaaccaggacgccatcgagaaggccgtgagcagaggccagtgcctgtacaagatcagcagctacaccagctaccccatgcacgacttctacagatgccacacctgcaacaccaccgacagaaacgccatctgcgtgaactgcatcaagaagtgccaccagggccacgacgtggagttcatcagacacgacagattcttctgcgactgcggcgccggcaccctgagcaacccctgcaccctggccggcgagcccacccacgacaccgacaccctgtacgacagcgccccccccatcgagagcaacaccctgcagcacaactag

SEQ ID NO: 81396 - DNA, 1305 bp, Artificial Sequence
  Description of Artificial Sequence: Synthetic coding sequence
atgcccagcgagatcctgctgaagatcttcagctacctggacgccgtgagcctgctgtgcaccggctgcgtgagcagaagattctaccacctggccaacgacaacttcatctggatcggcatctacagcaccgccttcagccccgccagaagcaactggaagttcaacagcgtggagaagatcgccatgagcatgagcttcctgagcgtgcaggacaaggaggccggctactggaagaaggagtacatcaccaagcagatcgccagcgtgaaggccgccctggccgacatcctgaagcccgtgaacccctacaccggcctgcccgtgaagaccaaggaggccctgagaatcttcggcctgggctgggccatcatcctgaaggagaagggcggcaaggagtacatcatggagcacgtggacctgagcatcaacgacaccagcgtgaccgtgatctggtacggcaagaagtggccctgcctggccagcctgagcaccctggacctgtgcggcatgacccccgtgttcaccgactggtacaagacccccaccaagcacagactgagatggcacagcctgatcgccaagtacaacctgagccacctgaccatcagcaccatgatcggctgcgacagactgatcagaatcttctgcctgcaccccggcctgctggtgggcgtgtggaagaaggaggaggagctggccttcgtgatggccaacctgcacttccaccacctggtggagagaagcaccctgggcagcgccaccatcccctacgagctgcccccccacagccccttcctggacgacagccccgagtacggcctgcacggctaccagctgcacgtggacctgcacagcggcggcgtgttctacctgtgcggcaccttcagaaacctgttcaccaagagaggcaacatcgagaacggccacgtgaagctgatcgtgatccacctgaagaacaacagagagcacctgcccctgatcggcaaggtgggcctgagctggaagaccgacatcttcgacggctgcatcaagagctgcagcatgatggacgtgaccctgctggacgagcacggcaagcccttctggtgcttcagcagccccgtgtgcctgagaagccccgccacccccagcgacagcagcagcttcctgggccagacctacaacgtggactacgtggacgccgagggcagagtgcacgtggagctggtgtggatcagagagaccgaggagtacctgatcgtgaacctggtgctgtacctgagcatcgccaagatcaaccactggttcggcaccgagtactag

SEQ ID NO: 81397 - DNA, 1533 bp, Artificial Sequence
  Description of Artificial Sequence: Synthetic coding sequence
atggccaccggcagaggcagaatcctgcagcagcactggctgggcctgcagaccctgagaggccccagcagaggcggcggcgccgccagaggcagagccagagccttcggctgcagaaagggccccggcgtgaagctgagcgccggcagcgccgccctgagatgccacgccggcggcggccagcactgggagagcagcttcagctgctgcagcggcttcctggacggcatgcccagcgagatcctgctgaagatcttcagctacctggacgccgtgagcctgctgtgcaccggctgcgtgagcagaagattctaccacctggccaacgacaacttcatctggatcggcatctacagcaccgccttcagccccgccagaagcaactggaagttcaacagcgtggagaagatcgccatgagcatgagcttcctgagcgtgcaggacaaggaggccggctactggaagaaggagtacatcaccaagcagatcgccagcgtgaaggccgccctggccgacatcctgaagcccgtgaacccctacaccggcctgcccgtgaagaccaaggaggccctgagaatcttcggcctgggctgggccatcatcctgaaggagaagggcggcaaggagtacatcatggagcacgtggacctgagcatcaacgacaccagcgtgaccgtgatctggtacggcaagaagtggccctgcctggccagcctgagcaccctggacctgtgcggcatgacccccgtgttcaccgactggtacaagacccccaccaagcacagactgagatggcacagcctgatcgccaagtacaacctgagccacctgaccatcagcaccatgatcggctgcgacagactgatcagaatcttctgcctgcaccccggcctgctggtgggcgtgtggaagaaggaggaggagctggccttcgtgatggccaacctgcacttccaccacctggtggagagaagcaccctgggcagcgccaccatcccctacgagctgcccccccacagccccttcctggacgacagccccgagtacggcctgcacggctaccagctgcacgtggacctgcacagcggcggcgtgttctacctgtgcggcaccttcagaaacctgttcaccaagagaggcaacatcgagaacggccacgtgaagctgatcgtgatccacctgaagaacaacagagagcacctgcccctgatcggcaaggtgggcctgagctggaagaccgacatcttcgacggctgcatcaagagctgcagcatgatggacgtgaccctgctggacgagcacggcaagcccttctggtgcttcagcagccccgtgtgcctgagaagccccgccacccccagcgacagcagcagcttcctgggccagacctacaacgtggactacgtggacgccgagggcagagtgcacgtggagctggtgtggatcagagagaccgaggagtacctgatcgtgaacctggtgctgtacctgagcatcgccaagatcaaccactggttcggcaccgagtactag

SEQ ID NO: 81398 - DNA, 879 bp, Artificial Sequence
  Description of Artificial Sequence: Synthetic coding sequence
atgatggccttcgccccccccaagaacaccgacggccccaagatgcagaccaagatgagcacctggacccccctgaaccaccagctgctgaacgacagagtgttcgaggagagaagagccctgctgggcaagtggttcgacaagtggaccgacagccagagaagaagaatcctgaccggcctgctggagagatgcagcctgagccagcagaagttctgctgcagaaagctgcaggagaagatccccgccgaggccctggacttcaccaccaagctgcccagagtgctgagcctgtacatcttcagcttcctggaccccagaagcctgtgcagatgcgcccaggtgtgctggcactggaagaacctggccgagctggaccagctgtggatgctgaagtgcctgagattcaactggtacatcaacttcagccccacccccttcgagcagggcatctggaagaagcactacatccagatggtgaaggagctgcacatcaccaagcccaagaccccccccaaggacggcttcgtgatcgccgacgtgcagctggtgaccagcaacagccccgaggagaagcagagccccctgagcgccttcagaagcagcagcagcctgagaaagaagaacaacagcggcgagaaggccctgcccccctggagaagcagcgacaagcaccccaccgacatcatcagattcaactacctggacaacagagaccccatggagaccgtgcagcagggcagaagaaagagaaaccagatgacccccgacttcagcagacagagccacgacaagaagaacaagctgcaggacagaaccagactgagaaaggcccagagcatgatgagcagaagaaaccccttccccctgtgcccctag

SEQ ID NO: 81399 - DNA, 891 bp, Artificial Sequence
  Description of Artificial Sequence: Synthetic coding sequence
atggacggcgacggcgaccccgagagcgtgggccagcccgaggaggccagccccgaggagcagcccgaggaggccagcgccgaggaggagagacccgaggaccagcaggaggaggaggccgccgccgccgccgcctacctggacgagctgcccgagcccctgctgctgagagtgctggccgccctgcccgccgccgagctggtgcaggcctgcagactggtgtgcctgagatggaaggagctggtggacggcgcccccctgtggctgctgaagtgccagcaggagggcctggtgcccgagggcggcgtggaggaggagagagaccactggcagcagttctacttcctgagcaagagaagaagaaacctgctgagaaacccctgcggcgaggaggacctggagggctggtgcgacgtggagcacggcggcgacggctggagagtggaggagctgcccggcgacagcggcgtggagttcacccacgacgagagcgtgaagaagtacttcgccagcagcttcgagtggtgcagaaaggcccaggtgatcgacctgcaggccgagggctactgggaggagctgctggacaccacccagcccgccatcgtggtgaaggactggtacagcggcagaagcgacgccggctgcctgtacgagctgaccgtgaagctgctgagcgagcacgagaacgtgctggccgagttcagcagcggccaggtggccgtgccccaggacagcgacggcggcggctggatggagatcagccacaccttcaccgactacggccccggcgtgagattcgtgagattcgagcacggcggccaggacagcgtgtactggaagggctggttcggcgccagagtgaccaacagcagcgtgtgggtggagccctag

SEQ ID NO: 81400 - DNA, 594 bp, Artificial Sequence
  Description of Artificial Sequence: Synthetic coding sequence
atggacggcgacggcgaccccgagagcgtgggccagcccgaggaggccagccccgaggagcagcccgaggaggccagcgccgaggaggagagacccgaggaccagcaggaggaggaggccgccgccgccgccgcctacctggacgagctgcccgagcccctgctgctgagagtgctggccgccctgcccgccgccgagctggtgcaggcctgcagactggtgtgcctgagatggaaggagctggtggacggcgcccccctgtggctgctgaagtgccagcaggagggcctggtgcccgagggcggcgtggaggaggagagagaccactggcagcagttctacttcctgagcaagagaagaagaaacctgctgagaaacccctgcggcgaggaggacctggagggctggtgcgacgtggagcacggcggcgacggctggagagtggaggagctgcccggcgacagcggcgtggagttcacccacgacgagagcgcccccgtgctgcccggcggcgtggccaagcacagaggcctgctgggcggcgccgccggccacgacagcgccggccacagaggcgagggcctggtgagatag

SEQ ID NO: 81401 - DNA, 1614 bp, Artificial Sequence
  Description of Artificial Sequence: Synthetic coding sequence
atgaagcactacagccccaccgactacgtgaactggctggaggagtacaaggtgagacagaaggccggcctggaggccagaaagatcgtggccagcttcagcaagagattcttcagcgagcacgtgccctgcaacggcttcagcgacatcgagaacctggagggccccgagatcttcttcgaggacgagctggtgtgcatcctgaacatggagggcagaaaggccctgacctggaagtactacgccaagaagatcctgtactacctgagacagcagaagatcctgaacaacctgaaggccttcctgcagcagcccgacgactacgagagctacctggagggcgccgtgtacatcgaccagtactgcaaccccctgagcgacatcagcctgaaggacatccaggcccagatcgacagcatcgtggagctggtgtgcaagaccctgagaggcatcaacagcagacaccccagcctggccttcaaggccggcgagagcagcatgatcatggagatcgagctgcagagccaggtgctggacgccatgaactacgtgctgtacgaccagctgaagttcaagggcaacagaatggactactacaacgccctgaacctgtacatgcaccaggtgctgatcagaagaaccggcatccccatcagcatgagcctgctgtacctgaccatcgccagacagctgggcgtgcccctggagcccgtgaacttccccagccacttcctgctgagatggtgccagggcgccgagggcgccaccctggacatcttcgactacatctacatcgacgccttcggcaagggcaagcagctgaccgtgaaggagtgcgagtacctgatcggccagcacgtgaccgccgccctgtacggcgtggtgaacgtgaagaaggtgctgcagagaatggtgggcaacctgctgagcctgggcaagagagagggcatcgaccagagctaccagctgctgagagacagcctggacctgtacctggccatgtaccccgaccaggtgcagctgctgctgctgcaggccagactgtacttccacctgggcatctggcccgagaaggtgctggacatcctgcagcacatccagaccctggaccccggccagcacggcgccgtgggctacctggtgcagcacaccctggagcacatcgagagaaagaaggaggaggtgggcgtggaggtgaagctgagaagcgacgagaagcacagagacgtgtgctacagcatcggcctgatcatgaagcacaagagatacggctacaactgcgtgatctacggctgggaccccacctgcatgatgggccacgagtggatcagaaacatgaacgtgcacagcctgccccacggccaccaccagcccttctacaacgtgctggtggaggacggcagctgcagatacgccgcccaggagaacctggagtacaacgtggagccccaggagatcagccaccccgacgtgggcagatacttcagcgagttcaccggcacccactacatccccaacgccgagctggagatcagataccccgaggacctggagttcgtgtacgagaccgtgcagaacatctacagcgccaagaaggagaacatcgacgagtag

SEQ ID NO: 81402 - DNA, 1887 bp, Artificial Sequence
  Description of Artificial Sequence: Synthetic coding sequence
atggccgccgccgccgtggacagcgccatggaggtggtgcccgccctggccgaggaggccgcccccgaggtggccggcctgagctgcctggtgaacctgcccggcgaggtgctggagtacatcctgtgctgcggcagcctgaccgccgccgacatcggcagagtgagcagcacctgcagaagactgagagagctgtgccagagcagcggcaaggtgtggaaggagcagttcagagtgagatggcccagcctgatgaagcactacagccccaccgactacgtgaactggctggaggagtacaaggtgagacagaaggccggcctggaggccagaaagatcgtggccagcttcagcaagagattcttcagcgagcacgtgccctgcaacggcttcagcgacatcgagaacctggagggccccgagatcttcttcgaggacgagctggtgtgcatcctgaacatggagggcagaaaggccctgacctggaagtactacgccaagaagatcctgtactacctgagacagcagaagatcctgaacaacctgaaggccttcctgcagcagcccgacgactacgagagctacctggagggcgccgtgtacatcgaccagtactgcaaccccctgagcgacatcagcctgaaggacatccaggcccagatcgacagcatcgtggagctggtgtgcaagaccctgagaggcatcaacagcagacaccccagcctggccttcaaggccggcgagagcagcatgatcatggagatcgagctgcagagccaggtgctggacgccatgaactacgtgctgtacgaccagctgaagttcaagggcaacagaatggactactacaacgccctgaacctgtacatgcaccaggtgctgatcagaagaaccggcatccccatcagcatgagcctgctgtacctgaccatcgccagacagctgggcgtgcccctggagcccgtgaacttccccagccacttcctgctgagatggtgccagggcgccgagggcgccaccctggacatcttcgactacatctacatcgacgccttcggcaagggcaagcagctgaccgtgaaggagtgcgagtacctgatcggccagcacgtgaccgccgccctgtacggcgtggtgaacgtgaagaaggtgctgcagagaatggtgggcaacctgctgagcctgggcaagagagagggcatcgaccagagctaccagctgctgagagacagcctggacctgtacctggccatgtaccccgaccaggtgcagctgctgctgctgcaggccagactgtacttccacctgggcatctggcccgagaagagcttctgcctggtgctgaaggtgctggacatcctgcagcacatccagaccctggaccccggccagcacggcgccgtgggctacctggtgcagcacaccctggagcacatcgagagaaagaaggaggaggtgggcgtggaggtgaagctgagaagcgacgagaagcacagagacgtgtgctacagcatcggcctgatcatgaagcacaagagatacggctacaactgcgtgatctacggctgggaccccacctgcatgatgggccacgagtggatcagaaacatgaacgtgcacagcctgccccacggccaccaccagcccttctacaacgtgctggtggaggacggcagctgcagatacgccgcccaggagaacctggagtacaacgtggagccccaggagatcagccaccccgacgtgggcagatacttcagcgagttcaccggcacccactacatccccaacgccgagctggagatcagataccccgaggacctggagttcgtgtacgagaccgtgcagaacatctacagcgccaagaaggagaacatcgacgagtag

SEQ ID NO: 81403 - DNA, 1866 bp, Artificial Sequence
  Description of Artificial Sequence: Synthetic coding sequence
atggccgccgccgccgtggacagcgccatggaggtggtgcccgccctggccgaggaggccgcccccgaggtggccggcctgagctgcctggtgaacctgcccggcgaggtgctggagtacatcctgtgctgcggcagcctgaccgccgccgacatcggcagagtgagcagcacctgcagaagactgagagagctgtgccagagcagcggcaaggtgtggaaggagcagttcagagtgagatggcccagcctgatgaagcactacagccccaccgactacgtgaactggctggaggagtacaaggtgagacagaaggccggcctggaggccagaaagatcgtggccagcttcagcaagagattcttcagcgagcacgtgccctgcaacggcttcagcgacatcgagaacctggagggccccgagatcttcttcgaggacgagctggtgtgcatcctgaacatggagggcagaaaggccctgacctggaagtactacgccaagaagatcctgtactacctgagacagcagaagatcctgaacaacctgaaggccttcctgcagcagcccgacgactacgagagctacctggagggcgccgtgtacatcgaccagtactgcaaccccctgagcgacatcagcctgaaggacatccaggcccagatcgacagcatcgtggagctggtgtgcaagaccctgagaggcatcaacagcagacaccccagcctggccttcaaggccggcgagagcagcatgatcatggagatcgagctgcagagccaggtgctggacgccatgaactacgtgctgtacgaccagctgaagttcaagggcaacagaatggactactacaacgccctgaacctgtacatgcaccaggtgctgatcagaagaaccggcatccccatcagcatgagcctgctgtacctgaccatcgccagacagctgggcgtgcccctggagcccgtgaacttccccagccacttcctgctgagatggtgccagggcgccgagggcgccaccctggacatcttcgactacatctacatcgacgccttcggcaagggcaagcagctgaccgtgaaggagtgcgagtacctgatcggccagcacgtgaccgccgccctgtacggcgtggtgaacgtgaagaaggtgctgcagagaatggtgggcaacctgctgagcctgggcaagagagagggcatcgaccagagctaccagctgctgagagacagcctggacctgtacctggccatgtaccccgaccaggtgcagctgctgctgctgcaggccagactgtacttccacctgggcatctggcccgagaaggtgctggacatcctgcagcacatccagaccctggaccccggccagcacggcgccgtgggctacctggtgcagcacaccctggagcacatcgagagaaagaaggaggaggtgggcgtggaggtgaagctgagaagcgacgagaagcacagagacgtgtgctacagcatcggcctgatcatgaagcacaagagatacggctacaactgcgtgatctacggctgggaccccacctgcatgatgggccacgagtggatcagaaacatgaacgtgcacagcctgccccacggccaccaccagcccttctacaacgtgctggtggaggacggcagctgcagatacgccgcccaggagaacctggagtacaacgtggagccccaggagatcagccaccccgacgtgggcagatacttcagcgagttcaccggcacccactacatccccaacgccgagctggagatcagataccccgaggacctggagttcgtgtacgagaccgtgcagaacatctacagcgccaagaaggagaacatcgacgagtag

SEQ ID NO: 81404 - DNA, 1434 bp, Artificial Sequence
  Description of Artificial Sequence: Synthetic coding sequence
atgaagcactacagccccaccgactacgtgaactggctggaggagtacaaggtgagacagaaggccggcctggaggccagaaagatcgtggccagcttcagcaagagattcttcagcgagcacgtgccctgcaacggcttcagcgacatcgagaacctggagggccccgagatcttcttcgaggacgagctggtgtgcatcctgaacatggagggcagaaaggccctgacctggaagtactacgccaagaagatcctgtactacctgagacagcagaagatcctgaacaacctgaaggccttcctgcagcagcccgacgactacgagagctacctggagggcgccgtgtacatcgaccagtactgcaaccccctgagcgacatcagcctgaaggacatccaggcccagatcgacagcatcgtggagctggtgtgcaagaccctgagaggcatcaacagcagacaccccagcctggccttcaaggccggcgagagcagcatgatcatggagatcgagctgcagagccaggtgctggacgccatgaactacgtgctgtacgaccagctgaagttcaagggcaacagaatggactactacaacgccctgaacctgtacatgcaccaggtgctgatcagaagaaccggcatccccatcagcatgagcctgctgtacctgaccatcgccagacagctgggcgtgcccctggagcccgtgaacttccccagccacttcctgctgagatggtgccagggcgccgagggcgagggcatcgaccagagctaccagctgctgagagacagcctggacctgtacctggccatgtaccccgaccaggtgcagctgctgctgctgcaggccagactgtacttccacctgggcatctggcccgagaaggtgctggacatcctgcagcacatccagaccctggaccccggccagcacggcgccgtgggctacctggtgcagcacaccctggagcacatcgagagaaagaaggaggaggtgggcgtggaggtgaagctgagaagcgacgagaagcacagagacgtgtgctacagcatcggcctgatcatgaagcacaagagatacggctacaactgcgtgatctacggctgggaccccacctgcatgatgggccacgagtggatcagaaacatgaacgtgcacagcctgccccacggccaccaccagcccttctacaacgtgctggtggaggacggcagctgcagatacgccgcccaggagaacctggagtacaacgtggagccccaggagatcagccaccccgacgtgggcagatacttcagcgagttcaccggcacccactacatccccaacgccgagctggagatcagataccccgaggacctggagttcgtgtacgagaccgtgcagaacatctacagcgccaagaaggagaacatcgacgagtag

SEQ ID NO: 81405 - DNA, 1212 bp, Artificial Sequence
  Description of Artificial Sequence: Synthetic coding sequence
atggagcccgtgggctgctgcggcgagtgcagaggcagcagcgtggaccccagaagcaccttcgtgctgagcaacctggccgaggtggtggagagagtgctgaccttcctgcccgccaaggccctgctgagagtggcctgcgtgtgcagactgtggagagagtgcgtgagaagagtgctgagaacccacagaagcgtgacctggatcagcgccggcctggccgaggccggccacctggagggccactgcctggtgagagtggtggccgaggagctggagaacgtgagaatcctgccccacaccgtgctgtacatggccgacagcgagaccttcatcagcctggaggagtgcagaggccacaagagagccagaaagagaaccagcatggagaccgccctggccctggagaagctgttccccaagcagtgccaggtgctgggcatcgtgacccccggcatcgtggtgacccccatgggcagcggcagcaacagaccccaggagatcgagatcggcgagagcggcttcgccctgctgttcccccagatcgagggcatcaagatccagcccttccacttcatcaaggaccccaagaacctgaccctggagagacaccagctgaccgaggtgggcctgctggacaaccccgagctgagagtggtgctggtgttcggctacaactgctgcaaggtgggcgccagcaactacctgcagcaggtggtgagcaccttcagcgacatgaacatcatcctggccggcggccaggtggacaacctgagcagcctgaccagcgagaagaaccccctggacatcgacgccagcggcgtggtgggcctgagcttcagcggccacagaatccagagcgccaccgtgctgctgaacgaggacgtgagcgacgagaagaccgccgaggccgccatgcagagactgaaggccgccaacatccccgagcacaacaccatcggcttcatgttcgcctgcgtgggcagaggcttccagtactacagagccaagggcaacgtggaggccgacgccttcagaaagttcttccccagcgtgcccctgttcggcttcttcggcaacggcgagatcggctgcgacagaatcgtgaccggcaacttcatcctgagaaagtgcaacgaggtgaaggacgacgacctgttccacagctacaccaccatcatggccctgatccacctgggcagcagcaagtag

SEQ ID NO: 81406 - DNA, 831 bp, Artificial Sequence
  Description of Artificial Sequence: Synthetic coding sequence
atggagcccgtgggctgctgcggcgagtgcagaggcagcagcgtggaccccagaagcaccttcgtgctgagcaacctggccgaggtggtggagagagtgctgaccttcctgcccgccaaggccctgctgagagtggcctgcgtgtgcagactgtggagagagtgcgtgagaagagtgctgagaacccacagaagcgtgacctggatcagcgccggcctggccgaggccggccacctggagggccactgcctggtgagagtggtggccgaggagctggagaacgtgagaatcctgccccacaccgtgctgtacatggccgacagcgagaccttcatcagcctggaggagtgcagaggccacaagagagccagaaagagaaccagcatggagaccgccctggccctggagaagctgttccccaagcagtgccaggtgctgggcatcgtgacccccggcatcgtggtgacccccatgggcagcggcagcaacagaccccaggagatcgagatcggcgagagcggcttcgccctgctgttcccccagatcgagggcatcaagatccagcccttccacttcatcaaggaccccaagaacctgaccctggagagacaccagctgaccgaggtgggcctgctggacaaccccgagctgagagtggtgctggtgttcggctacaactgctgcaaggtgggcgccagcaactacctgcagcaggtggtgagcaccttcagcgacatgaacatcatcctggccggcggccaggtggacaacctgagcagcctgaccagcgagaagtacgtgctgtgcgccagcgacttcgtgtgcgagtag

SEQ ID NO: 81407 - DNA, 900 bp, Artificial Sequence
  Description of Artificial Sequence: Synthetic coding sequence
atggccgacagcgagaccttcatcagcctggaggagtgcagaggccacaagagagccagaaagagaaccagcatggagaccgccctggccctggagaagctgttccccaagcagtgccaggtgctgggcatcgtgacccccggcatcgtggtgacccccatgggcagcggcagcaacagaccccaggagatcgagatcggcgagagcggcttcgccctgctgttcccccagatcgagggcatcaagatccagcccttccacttcatcaaggaccccaagaacctgaccctggagagacaccagctgaccgaggtgggcctgctggacaaccccgagctgagagtggtgctggtgttcggctacaactgctgcaaggtgggcgccagcaactacctgcagcaggtggtgagcaccttcagcgacatgaacatcatcctggccggcggccaggtggacaacctgagcagcctgaccagcgagaagaaccccctggacatcgacgccagcggcgtggtgggcctgagcttcagcggccacagaatccagagcgccaccgtgctgctgaacgaggacgtgagcgacgagaagaccgccgaggccgccatgcagagactgaaggccgccaacatccccgagcacaacaccatcggcttcatgttcgcctgcgtgggcagaggcttccagtactacagagccaagggcaacgtggaggccgacgccttcagaaagttcttccccagcgtgcccctgttcggcttcttcggcaacggcgagatcggctgcgacagaatcgtgaccggcaacttcatcctgagaaagtgcaacgaggtgaaggacgacgacctgttccacagctacaccaccatcatggccctgatccacctgggcagcagcaagtag

SEQ ID NO: 81408 - DNA, 1743 bp, Artificial Sequence
  Description of Artificial Sequence: Synthetic coding sequence
atgggcgagaaggccgtgcccctgctgagaagaagaagagtgaagagaagctgccccagctgcggcagcgagctgggcgtggaggagaagagaggcaagggcaaccccatcagcatccagctgttcccccccgagctggtggagcacatcatcagcttcctgcccgtgagagacctggtggccctgggccagacctgcagatacttccacgaggtgtgcgacggcgagggcgtgtggagaagaatctgcagaagactgagccccagactgcaggaccagggcagcggcgtgagaccctggaagagagccgccatcctgaactacaccaagggcctgtacttccaggccttcggcggcagaagaagatgcctgagcaagagcgtggcccccctgctggcccacggctacagaagattcctgcccaccaaggaccacgtgttcatcctggactacgtgggcaccctgttcttcctgaagaacgccctggtgagcaccctgggccagatgcagtggaagagagcctgcagatacgtggtgctgtgcagaggcgccaaggacttcgccagcgaccccagatgcgacaccgtgtacagaaagtacctgtacgtgctggccaccagagagccccaggaggtggtgggcaccaccagcagcagagcctgcgactgcgtggaggtgtacctgcagagcagcggccagagagtgttcaagatgaccttccaccacagcatgaccttcaagcagatcgtgctggtgggccaggagacccagagagccctgctgctgctgaccgaggagggcaagatctacagcctggtggtgaacgagacccagctggaccagcccagaagctacaccgtgcagctggccctgagaaaggtgagccactacctgccccacctgagagtggcctgcatgaccagcaaccagagcagcaccctgtacgtgaccgaccagggcggcgtgtacttcgaggtgcacacccccggcgtgtacagagacctgttcggcaccctgcaggccttcgaccccctggaccagcagatgcccctggccctgagcctgcccgccaagatcctgttctgcgccctgggctacaaccacctgggcctggtggacgagttcggcagaatcttcatgcagggcaacaacagatacggccagctgggcaccggcgacaagatggacagaggcgagcccacccaggtgtgctacctgcagagacccatcaccctgtggtgcggcctgaaccacagcctggtgctgagccagagcagcgagttcagcaaggagctgctgggctgcggctgcggcgccggcggcagactgcccggctggcccaagggcagcgccagcttcgtgaagctgcaggtgaaggtgcccctgtgcgcctgcgccctgtgcgccaccagagagtgcctgtacatcctgagcagccacgacatcgagcagcacgccccctacagacacctgcccgccagcagagtggtgggcacccccgagcccagcctgggcgccagagccccccaggaccccggcggcatggcccaggcctgcgaggagtacctgagccagatccacagctgccagaccctgcaggacagaaccgagaagatgaaggagatcgtgggctggatgcccctgatggccgcccagaaggacttcttctgggaggccctggacatgctgcagagagccgagggcggcggcggcggcgtgggcccccccgcccccgagacctag

SEQ ID NO: 81409 - DNA, 957 bp, Artificial Sequence
  Description of Artificial Sequence: Synthetic coding sequence
atgggcgagaaggccgtgcccctgctgagaagaagaagagtgaagagaagctgccccagctgcggcagcgagctgggcgtggaggagaagagaggcaagggcaaccccatcagcatccagctgttcccccccgagctggtggagcacatcatcagcttcctgcccgtgagagacctggtggccctgggccagacctgcagatacttccacgaggtgtgcgacggcgagggcgtgtggagaagaatctgcagaagactgagccccagactgcaggaccaggacaccaagggcctgtacttccaggccttcggcggcagaagaagatgcctgagcaagagcgtggcccccctgctggcccacggctacagaagattcctgcccaccaaggaccacgtgttcatcctggactacgtgggcaccctgttcttcctgaagaacgccctggtgagcaccctgggccagatgcagtggaagagagcctgcagatacgtggtgctgtgcagaggcgccaaggacttcgccagcgaccccagatgcgacaccgtgtacagaaagtacctgtacgtgctggccaccagagagccccaggaggtggtgggcaccaccagcagcagagcctgcgactgcgtggaggtgtacctgcagagcagcggccagagagtgttcaagatgaccttccaccacagcatgaccttcaagcagatcgtgctggtgggccaggagacccagagagccctgctgctgctgaccgaggagggcaagatctacagcctggtggtgaacgagacccagctggaccagcccagaagctacaccgtgcagctggccctgagaaaggtgagccactacctgccccacctgagagtggcctgcatgaccagcaaccagagcagcaccctgtacgtgaccgaccccatcctgtgcagctggctgcagcccccctggcccggcggctag

SEQ ID NO: 81410 - DNA, 1857 bp, Artificial Sequence
  Description of Artificial Sequence: Synthetic coding sequence
atggtgtgggagagccagcaggagagaggcggccagggccccagaagacaggagggcagaagcagagagggcgccatcagaatggtgagaggcagccagagaagaaagctgcagaagttcaccagactgtgcggcagagaggagggcctgagagtgaagagaagctgccccagctgcggcagcgagctgggcgtggaggagaagagaggcaagggcaaccccatcagcatccagctgttcccccccgagctggtggagcacatcatcagcttcctgcccgtgagagacctggtggccctgggccagacctgcagatacttccacgaggtgtgcgacggcgagggcgtgtggagaagaatctgcagaagactgagccccagactgcaggaccagggcagcggcgtgagaccctggaagagagccgccatcctgaactacaccaagggcctgtacttccaggccttcggcggcagaagaagatgcctgagcaagagcgtggcccccctgctggcccacggctacagaagattcctgcccaccaaggaccacgtgttcatcctggactacgtgggcaccctgttcttcctgaagaacgccctggtgagcaccctgggccagatgcagtggaagagagcctgcagatacgtggtgctgtgcagaggcgccaaggacttcgccagcgaccccagatgcgacaccgtgtacagaaagtacctgtacgtgctggccaccagagagccccaggaggtggtgggcaccaccagcagcagagcctgcgactgcgtggaggtgtacctgcagagcagcggccagagagtgttcaagatgaccttccaccacagcatgaccttcaagcagatcgtgctggtgggccaggagacccagagagccctgctgctgctgaccgaggagggcaagatctacagcctggtggtgaacgagacccagctggaccagcccagaagctacaccgtgcagctggccctgagaaaggtgagccactacctgccccacctgagagtggcctgcatgaccagcaaccagagcagcaccctgtacgtgaccgaccagggcggcgtgtacttcgaggtgcacacccccggcgtgtacagagacctgttcggcaccctgcaggccttcgaccccctggaccagcagatgcccctggccctgagcctgcccgccaagatcctgttctgcgccctgggctacaaccacctgggcctggtggacgagttcggcagaatcttcatgcagggcaacaacagatacggccagctgggcaccggcgacaagatggacagaggcgagcccacccaggtgtgctacctgcagagacccatcaccctgtggtgcggcctgaaccacagcctggtgctgagccagagcagcgagttcagcaaggagctgctgggctgcggctgcggcgccggcggcagactgcccggctggcccaagggcagcgccagcttcgtgaagctgcaggtgaaggtgcccctgtgcgcctgcgccctgtgcgccaccagagagtgcctgtacatcctgagcagccacgacatcgagcagcacgccccctacagacacctgcccgccagcagagtggtgggcacccccgagcccagcctgggcgccagagccccccaggaccccggcggcatggcccaggcctgcgaggagtacctgagccagatccacagctgccagaccctgcaggacagaaccgagaagatgaaggagatcgtgggctggatgcccctgatggccgcccagaaggacttcttctgggaggccctggacatgctgcagagagccgagggcggcggcggcggcgtgggcccccccgcccccgagacctag

SEQ ID NO: 81411 - DNA, 957 bp, Artificial Sequence; identical to SEQ ID NO: 81409
  Description of Artificial Sequence: Synthetic coding sequence

SEQ ID NO: 81412 - DNA, 1707 bp, Artificial Sequence
  Description of Artificial Sequence: Synthetic coding sequence
atggtgaagagaagctgccccagctgcggcagcgagctgggcgtggaggagaagagaggcaagggcaaccccatcagcatccagctgttcccccccgagctggtggagcacatcatcagcttcctgcccgtgagagacctggtggccctgggccagacctgcagatacttccacgaggtgtgcgacggcgagggcgtgtggagaagaatctgcagaagactgagccccagactgcaggaccagggcagcggcgtgagaccctggaagagagccgccatcctgaactacaccaagggcctgtacttccaggccttcggcggcagaagaagatgcctgagcaagagcgtggcccccctgctggcccacggctacagaagattcctgcccaccaaggaccacgtgttcatcctggactacgtgggcaccctgttcttcctgaagaacgccctggtgagcaccctgggccagatgcagtggaagagagcctgcagatacgtggtgctgtgcagaggcgccaaggacttcgccagcgaccccagatgcgacaccgtgtacagaaagtacctgtacgtgctggccaccagagagccccaggaggtggtgggcaccaccagcagcagagcctgcgactgcgtggaggtgtacctgcagagcagcggccagagagtgttcaagatgaccttccaccacagcatgaccttcaagcagatcgtgctggtgggccaggagacccagagagccctgctgctgctgaccgaggagggcaagatctacagcctggtggtgaacgagacccagctggaccagcccagaagctacaccgtgcagctggccctgagaaaggtgagccactacctgccccacctgagagtggcctgcatgaccagcaaccagagcagcaccctgtacgtgaccgaccagggcggcgtgtacttcgaggtgcacacccccggcgtgtacagagacctgttcggcaccctgcaggccttcgaccccctggaccagcagatgcccctggccctgagcctgcccgccaagatcctgttctgcgccctgggctacaaccacctgggcctggtggacgagttcggcagaatcttcatgcagggcaacaacagatacggccagctgggcaccggcgacaagatggacagaggcgagcccacccaggtgtgctacctgcagagacccatcaccctgtggtgcggcctgaaccacagcctggtgctgagccagagcagcgagttcagcaaggagctgctgggctgcggctgcggcgccggcggcagactgcccggctggcccaagggcagcgccagcttcgtgaagctgcaggtgaaggtgcccctgtgcgcctgcgccctgtgcgccaccagagagtgcctgtacatcctgagcagccacgacatcgagcagcacgccccctacagacacctgcccgccagcagagtggtgggcacccccgagcccagcctgggcgccagagccccccaggaccccggcggcatggcccaggcctgcgaggagtacctgagccagatccacagctgccagaccctgcaggacagaaccgagaagatgaaggagatcgtgggctggatgcccctgatggccgcccagaaggacttcttctgggaggccctggacatgctgcagagagccgagggcggcggcggcggcgtgggcccccccgcccccgagacctag

SEQ ID NO: 81413 - DNA, 1104 bp, Artificial Sequence
  Description of Artificial Sequence: Synthetic coding sequence
atgcccttcctgggccaggactggagaagccccggctggagctggatcaagaccgaggacggctggaagagatgcgagagctgcagccagaagctggagagagagaacaacagatgcaacatcagccacagcatcatcctgaacagcgaggacggcgagatcttcaacaacgaggagcacgagtacgccagcaagaagagaaagaaggaccacttcagaaacgacaccaacacccagagcttctacagagagaagtggatctacgtgcacaaggagagcaccaaggagagacacggctactgcaccctgggcgaggccttcaacagactggacttcagcagcgccatccaggacatcagaagattcaactacgtggtgaagctgctgcagctgatcgccaagagccagctgaccagcctgagcggcgtggcccagaagaactacttcaacatcctggacaagatcgtgcagaaggtgctggacgaccaccacaaccccagactgatcaaggacctgctgcaggacctgagcagcaccctgtgcatcctgatcagaggcgtgggcaagagcgtgctggtgggcaacatcaacatctggatctgcagactggagaccatcctggcctggcagcagcagctgcaggacctgcagatgaccaagcaggtgaacaacggcctgaccctgagcgacctgcccctgcacatgctgaacaacatcctgtacagattcagcgacggctgggacatcatcaccctgggccaggtgacccccaccctgtacatgctgagcgaggacagacagctgtggaagaagctgtgccagtaccacttcgccgagaagcagttctgcagacacctgatcctgagcgagaagggccacatcgagtggaagctgatgtacttcgccctgcagaagcactaccccgccaaggagcagtacggcgacaccctgcacttctgcagacactgcagcatcctgttctggaaggactaccacctggccctgctgttcaaggacagcggccacccctgcaccgccgccgaccccgacagctgcttcacccccgtgagcccccagcacttcatcgacctgttcaagttctag

SEQ ID NO: 81414 - DNA, 1077 bp, Artificial Sequence
  Description of Artificial Sequence: Synthetic coding sequence
atgcccttcctgggccaggactggagaagccccggctggagctggatcaagaccgaggacggctggaagagatgcgagagctgcagccagaagctggagagagagaacaacagatgcaacatcagccacagcatcatcctgaacagcgaggacggcgagatcttcaacaacgaggagcacgagtacgccagcaagaagagaaagaaggaccacttcagaaacgacaccaacacccagagcttctacagagagaagtggatctacgtgcacaaggagagcaccaaggagagacacggctactgcaccctgggcgaggccttcaacagactggacttcagcagcgccatccaggacatcagaagattcaactacgtggtgaagctgctgcagctgatcgccaagagccagctgaccagcctgagcggcgtggcccagaagaactacttcaacatcctggacaagatcgtgcagaaggtgctggacgaccaccacaaccccagactgatcaaggacctgctgcaggacctgagcagcaccctgtgcatcctgatcagaggcgtgggcaagagcgtgctggtgggcaacatcaacatctggatctgcagactggagaccatcctggcctggcagcagcagctgcaggacctgcagatgaccaagcaggtgaacaacggcctgaccctgagcgacctgcccctgcacatgctgaacaacatcctgtacagattcagcgacggctgggacatcatcaccctgggccaggtgacccccaccctgtacatgctgagcgaggacagacagctgtggaagaagctgtgccagtaccacttcgccgagaagcagttctgcagacacctgatcctgagcgagaagggccacatcgagtggaagctgatgtacttcgccctgcagaagcactaccccgccaaggagcagtacggcgacaccctgcacttctgcagacactgcagcatcctgttctggaaggacagcggccacccctgcaccgccgccgaccccgacagctgcttcacccccgtgagcccccagcacttcatcgacctgttcaagttctag

SEQ ID NO: 81415 - DNA, 876 bp, Artificial Sequence
  Description of Artificial Sequence: Synthetic coding sequence
atggagaagtacagcatcatgaagagcatgaacatgcacagaaagaagggcaagagaaccatcctggagatgacccagatcctgaagagacacggctactgcaccctgggcgaggccttcaacagactggacttcagcagcgccatccaggacatcagaagattcaactacgtggtgaagctgctgcagctgatcgccaagagccagctgaccagcctgagcggcgtggcccagaagaactacttcaacatcctggacaagatcgtgcagaaggtgctggacgaccaccacaaccccagactgatcaaggacctgctgcaggacctgagcagcaccctgtgcatcctgatcagaggcgtgggcaagagcgtgctggtgggcaacatcaacatctggatctgcagactggagaccatcctggcctggcagcagcagctgcaggacctgcagatgaccaagcaggtgaacaacggcctgaccctgagcgacctgcccctgcacatgctgaacaacatcctgtacagattcagcgacggctgggacatcatcaccctgggccaggtgacccccaccctgtacatgctgagcgaggacagacagctgtggaagaagctgtgccagtaccacttcgccgagaagcagttctgcagacacctgatcctgagcgagaagggccacatcgagtggaagctgatgtacttcgccctgcagaagcactaccccgccaaggagcagtacggcgacaccctgcacttctgcagacactgcagcatcctgttctggaaggacagcggccacccctgcaccgccgccgaccccgacagctgcttcacccccgtgagcccccagcacttcatcgacctgttcaagttctag

SEQ ID NO: 81416 - DNA, 876 bp, Artificial Sequence; identical to SEQ ID NO: 81415
  Description of Artificial Sequence: Synthetic coding sequence

SEQ ID NO: 81417 - DNA, 993 bp, Artificial Sequence
  Description of Artificial Sequence: Synthetic coding sequence
atgcccttcctgggccaggactggagaagccccggctggagctggatcaagaccgaggacggctggaagagatgcgagagctgcagccagaagctggagagagagaacaacagatgcaacatcagccacagcatcatcctgaacagcgaggacggcgagatcttcaacaacgaggagcacgagtacgccagcaagaagagaaagaaggaccacttcagaaacgacaccaacacccagagcttctacagagagaagtggatctacgtgcacaaggagagcaccaaggagagacacggctactgcaccctgggcgaggccttcaacagactggacttcagcagcgccatccaggacatcagaagattcaactacgtggtgaagctgctgcagctgatcgccaagagccagctgaccagcctgagcggcgtggcccagaagaactacttcaacatcctggacaagatcgtgcagaaggtgctggacgaccaccacaaccccagactgatcaaggacctgctgcaggacctgagcagcaccctgtgcatcctgatcagaggcgtgggcaagagcgtgctggtgggcaacatcaacatctggatctgcagactggagaccatcctggcctggcagcagcagctgcaggacctgcagatgaccaagcaggtgaacaacggcctgaccctgagcgacctgcccctgctgagcgaggacagacagctgtggaagaagctgtgccagtaccacttcgccgagaagcagttctgcagacacctgatcctgagcgagaagggccacatcgagtggaagctgatgtacttcgccctgcagaagcactaccccgccaaggagcagtacggcgacaccctgcacttctgcagacactgcagcatcctgttctggaaggacagcggccacccctgcaccgccgccgaccccgacagctgcttcacccccgtgagcccccagcacttcatcgacctgttcaagttctag

SEQ ID NO: 81418 - DNA, 378 bp, Artificial Sequence
  Description of Artificial Sequence: Synthetic coding sequence
atgcccttcctgggccaggactggagaagccccggctggagctggatcaagaccgaggacggctggaagagatgcgagagctgcagccagaagctggagagagagaacaacagatgcaacatcagccacagcatcatcctgaacagcgaggacggcgagatcttcaacaacgaggagcacgagtacgccagcaagaagagaaagaaggaccacttcagaaacgacaccaacacccagagcttctacagagagaagtggatctacgtgcacaaggagagcaccaaggagagacacggctactgcaccctgggcgaggccttcaacagactggacttcagcagcgccatccaggacatcagaagattcaactacgtgtag

SEQ ID NO: 81419 - DNA, 852 bp, Artificial Sequence
  Description of Artificial Sequence: Synthetic coding sequence
atgggcgccagcgtgagcagaggcagagccgccagagtgcccgcccccgagcccgagcccgaggaggccctggacctgagccagctgccccccgagctgctgctggtggtgctgagccacgtgccccccagaaccctgctgggcagatgcagacaggtgtgcagaggctggagagccctggtggacggccaggccctgtggctgctgatcctggccagagaccacggcgccaccggcagagccctgctgcacctggccagaagctgccagagccccgccagaaacgccagaccctgccccctgggcagattctgcgccagaagacccatcggcagaaacctgatcagaaacccctgcggccaggagggcctgagaaagtggatggtgcagcacggcggcgacggctgggtggtggaggagaacagaaccaccgtgcccggcgcccccagccagacctgcttcgtgaccagcttcagctggtgctgcaagaagcaggtgctggacctggaggaggagggcctgtggcccgagctgctggacagcggcagaatcgagatctgcgtgagcgactggtggggcgccagacacgacagcggctgcatgtacagactgctggtgcagctgctggacgccaaccagaccgtgctggacaagttcagcgccgtgcccgaccccatcccccagtggaacaacaacgcctgcctgcacgtgacccacgtgttcagcaacatcaagatgggcgtgagattcgtgagcttcgagcacagaggccaggacacccagttctgggccggccactacggcgccagagtgaccaacagcagcgtgatcgtgagagtgagactgagctag

SEQ ID NO: 81420 - DNA, 852 bp, Artificial Sequence; identical to SEQ ID NO: 81419
  Description of Artificial Sequence: Synthetic coding sequence

SEQ ID NO: 81421 - DNA, 1107 bp, Artificial Sequence
  Description of Artificial Sequence: Synthetic coding sequence
atggccgccgccgccgaggagagaatggccgaggagggcggcggcggccagggcgacggcggcagcagcctggccagcggcagcacccagagacagccccccccccccgccccccagcacccccagcccggcagccaggccctgcccgcccccgccctggcccccgaccagctgccccagaacaacaccctggtggccctgcccatcgtggccatcgagaacatcctgagcttcatgagctacgacgagatcagccagctgagactggtgtgcaagagaatggacctggtgtgccagagaatgctgaaccagggcttcctgaaggtggagagataccacaacctgtgccagaagcaggtgaaggcccagctgcccagaagagagagcgagagaagaaaccacagcctggccagacacgccgacatcctggccgccgtggagaccagactgagcctgctgaacatgaccttcatgaagtacgtggacagcaacctgtgctgcttcatccccggcaaggtgatcgacgagatctacagagtgctgagatacgtgaacagcaccagagccccccagagagcccacgaggtgctgcaggagctgagagacatcagcagcatggccatggagtacttcgacgagaagatcgtgcccatcctgaagagaaagctgcccggcagcgacgtgagcggcagactgatgggcagcccccccgtgcccggccccagcgccgccctgaccaccatgcagctgttcagcaagcagaaccccagcagacaggaggtgaccaagctgcagcagcaggtgaagaccaacggcgccggcgtgaccgtgctgagaagagagatcagcgagctgagaaccaaggtgcaggagcagcagaagcagctgcaggaccaggaccagaagctgctggagcagacccagatcatcggcgagcagaacgccagactggccgagctggagagaaagctgagagaggtgatggagagcgccgtgggcaacagcagcggcagcggccagaacgaggagagccccagaaagagaaagaaggccaccgaggccatcgacagcctgagaaagagcaagagactgagaaacagaaagtag

SEQ ID NO: 81422 - DNA, 540 bp, Artificial Sequence
  Description of Artificial Sequence: Synthetic coding sequence
atggccgccgccgccgaggagagaatggccgaggagggcggcggcggccagggcgacggcggcagcagcctggccagcggcagcacccagagacagccccccccccccgccccccagcacccccagcccggcagccaggccctgcccgcccccgccctggcccccgaccagctgccccagaacaacaccctggtggccctgcccatcgtggccatcgagaacatcctgagcttcatgagctacgacgagatcagccagctgagactggtgtgcaagagaatggacctggtgtgccagagaatgctgaaccagggcttcctgaaggtggagagataccacaacctgtgccagaagcaggtgaaggcccagctgcccagaagagagagcgagagaagaaaccacagcctggccagacacgccgacatcctggccgccgtggagaccagactgagcctgctgaacatgaccttcatgaagtacgtggacagcaacctgtgctgcttcatccccggcaagttccaggacagactgcagccctag

SEQ ID NO: 81423 - DNA, 1416 bp, Artificial Sequence
  Description of Artificial Sequence: Synthetic coding sequence
atggccgccatggagaccgagaccgcccccctgaccctggagagcctgcccaccgaccccctgctgctgatcctgagcttcctggactacagagacctgatcaactgctgctacgtgagcagaagactgagccagctgagcagccacgaccccctgtggagaagacactgcaagaagtactggctgatcagcgaggaggagaagacccagaagaaccagtgctggaagagcctgttcatcgacacctacagcgacgtgggcagatacatcgaccactacgccgccatcaagaaggcctgggacgacctgaagaagtacctggagcccagatgccccagaatggtgctgagcctgaaggagggcgccagagaggaggacctggacgccgtggaggcccagatcggctgcaagctgcccgacgactacagatgcagctacagaatccacaacggccagaagctggtggtgcccggcctgctgggcagcatggccctgagcaaccactacagaagcgaggacctgctggacgtggacaccgccgccggcggcttccagcagagacagggcctgaagtactgcctgcccctgaccttctgcatccacaccggcctgagccagtacatcgccgtggaggccgccgagggcagaaacaagaacgaggtgttctaccagtgccccgaccagatggccagaaaccccgccgccatcgacatgttcatcatcggcgccaccttcaccgactggttcaccagctacgtgaagaacgtggtgagcggcggcttccccatcatcagagaccagatcttcagatacgtgcacgaccccgagtgcgtggccaccaccggcgacatcaccgtgagcgtgagcaccagcttcctgcccgagctgagcagcgtgcaccccccccactacttcttcacctacagaatcagaatcgagatgagcaaggacgccctgcccgagaaggcctgccagctggacagcagatactggagaatcaccaacgccaagggcgacgtggaggaggtgcagggccccggcgtggtgggcgagttccccatcatcagccccggcagagtgtacgagtacaccagctgcaccaccttcagcaccaccagcggctacatggagggctactacaccttccacttcctgtacttcaaggacaagatcttcaacgtggccatccccagattccacatggcctgccccaccttcagagtgagcatcgccagactggagatgggccccgacgagtacgaggagatggaggaggaggaggaggaggaggaggaggaggacgaggacgacgacagcgccgacatggacgagagcgacgaggacgacgaggaggagagaagaagaagagtgttcgacgtgcccatcagaagaagaagatgcagcagactgttctag

SEQ ID NO: 81424 - DNA, 519 bp, Artificial Sequence
  Description of Artificial Sequence: Synthetic coding sequence
atggagaccgagaccgcccccctgaccctggagagcctgcccaccgaccccctgctgctgatcctgagcttcctggactacagagacctgatcaactgctgctacgtgagcagaagactgagccagctgagcagccacgaccccctgtggagaagacactgcaagaagtactggctgatcagcgaggaggagaagacccagaagaaccagtgctggaagagcctgttcatcgacacctacagcgacgtgggcagatacatcgaccactacgccgccatcaagaaggccggcatgatcagcagaaacatctggagccccggcgtgctgggctggttcgtgagcatcaacagaggctgcagcagaggcagacccagatgctgcggcagcgccgactggtgcaagctgcccgacgactacagatgcagctacagaatccacaacggccagaagctggtggtgcccggcagctactgggaggcctggcactgcctgatcaccatcgtgctgaagatctgctag

SEQ ID NO: 81425 - DNA, 1248 bp, Artificial Sequence
  Description of Artificial Sequence: Synthetic coding sequence
atggccgccatggagaccgagaccgcccccctgaccctggagagcctgcccaccgaccccctgctgctgatcctgagcttcctggactacagagacctgatcaactgctgctacgtgagcagaagactgagccagctgagcagccacgaccccctgtggagaagacactgcaagaagtactggctgatcagcgaggaggagaagacccagaagaaccagtgctggaagagcctgttcatcgacacctacagcgacgtgggcagatacatcgaccactacgccgccatcaagaaggcctgggacgacctgaagaagtacctggagcccagatgccccagaatggtgctgagcctgaaggagggcgccagagaggaggacctggacgccgtggaggcccagatcggctgcaagctgcccgacgactacagatgcagctacagaatccacaacggccagaagctggtggtgcccggcctgctgggcagcatggccctgagcaaccactacagaagcgaggacctgctggacgtggacaccgccgccggcggcttccagcagagacagggcctgaagtactgcctgcccctgaccttctgcatccacaccggcctgagccagtacatcgccgtggaggccgccgagggcagaaacaagaacgaggtgttctaccagtgccccgaccagatggccagaaaccccgccgccatcgacatgttcatcatcggcgccaccttcaccgactggttcaccagctacgtgaagaacgtggtgagcggcggcttccccatcatcagagaccagatcttcagatacgtgcacgaccccgagtgcgtggccaccaccggcgacatcaccgtgagcgtgagcaccagcttcctgcccgagctgagcagcgtgcaccccccccactacttcttcacctacagaatcagaatcgagatgagcaaggacgccctgcccgagaaggcctgccagctggacagcagatactggagaatcaccaacgccaagggcgacgtggaggaggtgcagggccccggcgtggtgggcgagttccccatcatcagccccggcagagtgtacgagtacaccagctgcaccaccttcagcaccaccagcggctacatggagggctactacaccttccacttcctgtacttcaaggacaagatcttcaacgtggccatccccagattccacatggcctgccccaccttcagagtgagcatcgccagactggtgagctag

SEQ ID NO: 81426 - DNA, 2238 bp, Artificial Sequence
  Description of Artificial Sequence: Synthetic coding sequence
atggaggaggagctgcagcacagccactgcgtgaactgcgtgagcagaagatgcatgaccagacccgagcccggcatcagctgcgacctgatcggctgccccctggtgtgcggcgccgtgttccacagctgcaaggccgacgagcacagactgctgtgccccttcgagagagtgccctgcctgaacagcgacttcggctgccccttcaccatggccagaaacaaggtggccgagcacctggagatgtgccccgccagcgtggtgtgctgcaccatggagtggaacagatggcccgtgagctacgccgacagaaagagctacgagaacctgagcagagacgtggacgaggtggcccagctggacatggccctggccctgcaggaccagagaatgctgctggagagcctgaaggtggccaccatgatgagcaaggccaccgacaaggtgagcaagcccagagagcagatcagcgtgaagagcagcgtgcccgagatcccccacgccaacggcctggtgagcgtggacgaggagagctacggcgccctgtaccaggccaccgtggagaccaccagaagcctggccgccgccctggacatcctgaacaccgccaccagagacatcggcatgctgaacaccagcgtgcccaacgacatggacgagcagcagaacgccagagagagcctggaggaccagaacctgaaggaccaggaccacctgtacgaggaggagatcggcgccgtgggcggcatcgactacaacgacaccaaccagaacgcccagagcgagcagaacggcagcagcgacctgctgtgcgacctgaacaccagcagctacgacaccagcgccctgtgcaacggcttccccctggagaacatctgcacccaggtgatcgaccagaaccagaacctgcacggcgacagcaagcagagcaacctgaccaacggcgactgcgtggccagcagcgacggcaccagcaagcccagcagcagcctggccgtggccgcccagctgagagagatcatccccagcagcgccctgcccaacggcaccgtgcagcacatcctgatgcccgacgacgagggcgagggcgagctgtgctggaagaaggtggacctgggcgacgtgaagaacgtggacgtgctgagcttcagccacgcccccagcttcaacttcctgagcaacagctgctggagcaagcccaaggaggacaaggccgtggacaccagcgacctggaggtggccgaggaccccatgggcctgcagggcatcgacctgatcaccgccgccctgctgttctgcctgggcgacagccccggcggcagaggcatcagcgacagcagaatggccgacatctaccacatcgacgtgggcacccagaccttcagcctgcccagcgccatcctggccaccagcaccatggtgggcgagatcgccagcgccagcgcctgcgaccacgccaacccccagctgagcaaccccagccccttccagaccctgggcctggacctggtgctggagtgcgtggccagataccagcccaagcagagaagcatgttcaccttcgtgtgcggccagctgttcagaagaaaggagttcagcagccacttcaagaacgtgcacggcgacatccacgccggcctgaacggctggatggagcagagatgccccctggcctactacggctgcacctacagccagagaagattctgccccagcatccagggcgccaagatcatccacgacagacacctgagaagcttcggcgtgcagccctgcgtgagcaccgtgctggtggagcccgccagaaactgcgtgctgggcctgcacaacgaccacctgagcagcctgcccttcgaggtgctgcagcacatcgccggcttcctggacggcttcagcctgtgccagctgagctgcgtgagcaagctgatgagagacgtgtgcggcagcctgctgcagagcagaggcatggtgatcctgcagtggggcaagagaaagtaccccgagggcaacagcagctggcagatcaaggagaaggtgtggagattcagcaccgccttctgcagcgtgaacgagtggaagttcgccgacatcctgagcatggccgaccacctgaagaagtgcagctacaacgtggtggagaagagagaggaggccatccccctgccctgcatgtgcgtgaccagagagctgaccaaggagggcagaagcctgagaagcgtgctgaagcccgtgctgtag

SEQ ID NO: 81427 - DNA, 1620 bp, Artificial Sequence
  Description of Artificial Sequence: Synthetic coding sequence
atggccgtgtgcgccagactgtgcggcgtgggccccagcagaggctgcagaagaagacagcagagaagaggccccgccgagaccgccgccgccgacagcgagcccgacaccgaccccgaggaggagagaatcgaggccagcgccggcgtgggcggcggcctgtgcgccggccccagcccccccccccccagatgcagcctgctggagctgccccccgagctgctggtggagatcttcgccagcctgcccggcaccgacctgcccagcctggcccaggtgtgcaccaagttcagaagaatcctgcacaccgacaccatctggagaagaagatgcagagaggagtacggcgtgtgcgagaacctgagaaagctggagatcaccggcgtgagctgcagagacgtgtacgccaagctgctgcacagatacagacacatcctgggcctgtggcagcccgacatcggcccctacggcggcctgctgaacgtggtggtggacggcctgttcatcatcggctggatgtacctgcccccccacgacccccacgtggacgaccccatgagattcaagcccctgttcagaatccacctgatggagagaaaggccgccaccgtggagtgcatgtacggccacaagggcccccaccacggccacatccagatcgtgaagaaggacgagttcagcaccaagtgcaaccagaccgaccaccacagaatgagcggcggcagacaggaggagttcagaacctggctgagagaggagtggggcagaaccctggaggacatcttccacgagcacatgcaggagctgatcctgatgaagttcatctacaccagccagtacgacaactgcctgacctacagaagaatctacctgccccccagcagacccgacgacctgatcaagcccggcctgttcaagggcacctacggcagccacggcctggagatcgtgatgctgagcttccacggcagaagagccagaggcaccaagatcaccggcgaccccaacatccccgccggccagcagaccgtggagatcgacctgagacacagaatccagctgcccgacctggagaaccagagaaacttcaacgagctgagcagaatcgtgctggaggtgagagagagagtgagacaggagcagcaggagggcggccacgaggccggcgagggcagaggcagacagggccccagagagagccagcccagccccgcccagcccagagccgaggcccccagcaagggccccgacggcacccccggcgaggacggcggcgagcccggcgacgccgtggccgccgccgagcagcccgcccagtgcggccagggccagcccttcgtgctgcccgtgggcgtgagcagcagaaacgaggactaccccagaacctgcagaatgtgcttctacggcaccggcctgatcgccggccacggcttcaccagccccgagagaacccccggcgtgttcatcctgttcgacgaggacagattcggcttcgtgtggctggagctgaagagcttcagcctgtacagcagagtgcaggccaccttcagaaacgccgacgcccccagcccccaggccttcgacgagatgctgaagaacatccagagcctgaccagctag

SEQ ID NO: 81428 - DNA, 1068 bp, Artificial Sequence
  Description of Artificial Sequence: Synthetic coding sequence
atgcccttcctgggccaggactggagaagccccggccagaactgggtgaagaccgccgacggctggaagagattcctggacgagaagagcggcagcttcgtgagcgacctgagcagctactgcaacaaggaggtgtacaacaaggagaacctgttcaacagcctgaactacgacgtggccgccaagaagagaaagaaggacatgctgaacagcaagaccaagacccagtacttccaccaggagaagtggatctacgtgcacaagggcagcaccaaggagagacacggctactgcaccctgggcgaggccttcaacagactggacttcagcaccgccatcctggacagcagaagattcaactacgtggtgagactgctggagctgatcgccaagagccagctgaccagcctgagcggcatcgcccagaagaacttcatgaacatcctggagaaggtggtgctgaaggtgctggaggaccagcagaacatcagactgatcagagagctgctgcagaccctgtacaccagcctgtgcaccctggtgcagagagtgggcaagagcgtgctggtgggcaacatcaacatgtgggtgtacagaatggagaccatcctgcactggcagcagcagctgaacaacatccagatcaccagacccgccttcaagggcctgaccttcaccgacctgcccctgtgcctgcagctgaacatcatgcagagactgagcgacggcagagacctggtgagcctgggccaggccgcccccgacctgcacgtgctgagcgaggacagactgctgtggaagaagctgtgccagtaccacttcagcgagagacagatcagaaagagactgatcctgagcgacaagggccagctggactggaagaagatgtacttcaagctggtgagatgctaccccagaaaggagcagtacggcgacaccctgcagctgtgcaagcactgccacatcctgagctggaagggcaccgaccacccctgcaccgccaacaaccccgagagctgcagcgtgagcctgagcccccaggacttcatcaacctgttcaagttctag

SEQ ID NO: 81429 - DNA, 789 bp, Artificial Sequence
  Description of Artificial Sequence: Synthetic coding sequence
atgcccttcctgggccaggactggagaagccccggccagaactgggtgaagaccgccgacggctggaagagattcctggacgagaagagcggcagcttcgtgagcgacctgagcagctactgcaacaaggaggtgtacaacaaggagaacctgttcaacagcctgaactacgacgtggccgccaagaagagaaagaaggacatgctgaacagcaagaccaagacccagtacttccaccaggagaagtggatctacgtgcacaagggcagcaccaaggagagacacggctactgcaccctgggcgaggccttcaacagactggacttcagcaccgccatcctggacagcagaagattcaactacgtggtgagacccgccttcaagggcctgaccttcaccgacctgcccctgtgcctgcagctgaacatcatgcagagactgagcgacggcagagacctggtgagcctgggccaggccgcccccgacctgcacgtgctgagcgaggacagactgctgtggaagaagctgtgccagtaccacttcagcgagagacagatcagaaagagactgatcctgagcgacaagggccagctggactggaagaagatgtacttcaagctggtgagatgctaccccagaaaggagcagtacggcgacaccctgcagctgtgcaagcactgccacatcctgagctggaagggcaccgaccacccctgcaccgccaacaaccccgagagctgcagcgtgagcctgagcccccaggacttcatcaacctgttcaagttctag

SEQ ID NO: 81430 - DNA, 1668 bp, Artificial Sequence
  Description of Artificial Sequence: Synthetic coding sequence
atgctgctgttcctgagcgtgccccagcccagaccccccggcgccagaaccagagccggcgccgccagagtggccagatggagaagactgagactgcagcagctgagaagactgagaggcctgctgagagtgctgagaggcagacccggcgccggcagcagaagaagaggcagaatggccctgtgcggccaggccgccggcgccgccagcctgcccagcgagctgatcgtgcacatcttcagcttcctgcccgcccccgacagactgagagccagcgccagctgcagccactggagagagtgcctgttctaccccgccctgtggccccagctgagaatctgcctgagagtgagccccgccgagcagcccagactggagttcctgatgagaaagtgcggctggttcgtgagagagctgagagtggagttcgccgccgagaactacctgagcggcggcggccccggcgacggcggcggcgccgacaccggcaccggcggcgaggaggtggaggccctgcagctgagcgccagatggctggaggtgctgagaacctacctggagctggtgctgtgcgtgctggtgagcatcagaaacaacagaaacctgcagaagttcagcctgttcggcgacatcagcgtgctgcagcagcagggcagcctgagcaacacctacctgagcaaggtggaccccgacggcaagaagatcaagcagatccagcagctgttcgaggagatcctgagcaacagcagacagctgaagtggctgagctgcggcttcatgctggagatcgtgacccccaccagcctgagcagcctgagcaacgccgtggccaacaccatggagcacctgagcctgctggacaacaacatccccggcaacagcaccctgatcaccgccgtggagctggagagattcgtgaacctgcacagcctggccctggacttctgcgacttcaccgccgagatggccagagtgctgaccgacagcaaccacgtgcccctgcagagactgagcctgctggtgcacaacgtgagcgtgatgcacaagagcctggacaacatgcccaacgacgagcactggaaggccctgagcagaaagagcaccagcttcagagtgtacatcatggccttcgacatcaagagcgaggacatgctgaagatcctgaagcccagcatccccctggagagaatccacttcgacagctacatcacctgcgtgagcggcgccatcgtggacctgatcagcagacagtacgacaagttcctgacccacttcatcctgatgaacgacgtgatcgacaccagcggcttccccgacctgagcgacaacagaaacgaggaccccctggtgctgctggcctggagatgcaccaagctgagcctgctggccatccacggctacaccgtgtgggcccacaacctgatcgccatcgccagactgagaggcagcgacctgaaggtgctggaggtgaccgaggagagcatcgacttcgaccagggcgagctggccgaccaggacgtggaccccgtgcacaacctgatcgagcaggtgagcctgggcctgggccagccctggcacgccgtgatggacatcgagagcctgagcgtgttcaccgagcccaacagacacttctacagagagatgcagagcttcagcgaggacatctag

SEQ ID NO: 81431 - DNA, 9 bp, Artificial Sequence
  Description of Artificial Sequence: Synthetic coding sequence
atgagatag

SEQ ID NO: 81432 - DNA, 2136 bp, Artificial Sequence
  Description of Artificial Sequence: Synthetic coding sequence
atgcacctgaagccctactggaagctgcagaagaaggagcacccccccgaggtgagcagagagacccagagaacccccatgaaccaccagaaggccgtgaacgacgagacctgcaaggccagccacatcaccagcagcgtgttccccagcgccagcctgggcaaggccagcagcagaaagcccttcggcatcctgagccccaacgtgctgtgcagcatgagcggcaagagccccgtggagagcagcctgaacgtgaagaccaagaagaacgcccccagcgccaccatccaccagggcgaggaggagggccccctggacatctgggccgtggtgaagcccggcaacaccaaggagaagatcgccttcttcgccagccaccagtgcagcaacagaatcggcagcatgaagatcaagagcagctgggacatcgacggcagagccaccaagagaagaaagaagagcggcgacctgaagaaggccaaggtgcaggtggagagaatgagagaggtgaacagcagatgctaccagcccgagcccttcgcctgcggcatcgagcactgcagcgtgcactacgtgagcgacagcggcgacggcgtgtacgccggcagacccctgagcgtgatccagatggtggccttcctggagcagagagccagcgccctgctggccagctgcagcaagaactgcaccaacagccccgccatcgtgagattcagcggccagagcagaggcgtgcccgccgtgagcgagagctacagcgcccccggcgcctgcgaggagcccaccgagagaggcaacctggaggtgggcgagccccagagcgagcccgtgagagtgctggacatggtggccaagctggagagcgagtgcctgaagagacagggccagagagagcccggcagcctgagcagaaacaacagcttcagaagaaacgtgggcagagtgctgctggccaacagcacccaggccgacgagggcaagaccaagaagggcgtgctggaggcccccgacacccaggtgaaccccgtgggcagcgtgagcgtggactgcggccccagcagagccgacagatgcagccccaaggaggaccaggcctgggacggcgccagccaggactgcccccccctgcccgccggcgtgagcttccacatcgacagcgccgagctggagcccggcagccagaccgccgtgaagaacagcaacagatacgacgtggagatgaccgacgagctggtgggcctgcccttcagcagccacacctacagccaggccagcgagctgcccaccgacgccgtggactgcatgagcagagagctggtgagcctgaccagcagaaaccccgaccagagaaaggagagcctgtgcatcagcatcaccgtgagcaaggtggacaaggaccagcccagcatcctgaacagctgcgaggaccccgtgcccggcatgctgttcttcctgccccccggccagcacctgagcgactacagccagctgaacgagagcaccaccaaggagagcagcgaggccagccagctggaggacgccgccggcggcgacagcgccagcgaggagaagagcggcagcgccgagcccttcgtgctgcccgccagcagcgtggagagcaccctgcccgtgctggaggccagcagctggaagaagcaggtgagccacgacttcctggagaccagattcaagatccagcagctgctggagccccagcagtacatggccttcctgccccaccacatcatggtgaagatcttcagactgctgcccaccaagagcctggtggccctgaagtgcacctgctgctacttcaagttcatcatcgagtactacaacatcagacccgccgacagcagatgggtgagagaccccagatacagagaggacccctgcaagcagtgcaagaagaagtacgtgaagggcgacgtgagcctgtgcagatggcaccccaagccctactgccaggccctgccctacggccccggctactggatgtgctgccacagaagccagaagggcttccccggctgcaagctgggcctgcacgacaaccactgggtgcccgcctgccacagcttcaacagagccatccacaagaaggccaagggcaccgaggccgaggaggagtactag

SEQ ID NO: 81433 - DNA, 2136 bp, Artificial Sequence; identical to SEQ ID NO: 81432
  Description of Artificial Sequence: Synthetic coding sequence

SEQ ID NO: 81434 - DNA, 567 bp, Artificial Sequence
  Description of Artificial Sequence: Synthetic coding sequence
atggccagctggctgcccgagaccctgttcgagaccgtgggccagggccccccccccagcaaggactactaccagctgctggtgaccagaagccaggtgatcttcagatggtggaagatcagcctgagaagcgagtacagaagcaccaagcccggcgaggccaaggagacccacgaggacttcctggagaacagccacctgcagggccagaccgccctgatcttcggcgccagaatcctggactacgtgatcaacctgtgcaagggcaagttcgacttcctggagagactgagcgacgacctgctgctgaccatcatcagctacctggacctggaggacatcgccagactgtgccagaccagccacagattcgccaagctgtgcatgagcgacaagctgtgggagcagatcgtgcagagcacctgcgacaccatcacccccgacgtgagagccctggccgaggacaccggctggagacagctgttcttcaccaacaagctgcagctgcagagacagctgagaaagagaaagcagaagtacggcaacctgagagagaagcagccctag

SEQ ID NO: 81435 - DNA, 2832 bp, Artificial Sequence
  Description of Artificial Sequence: Synthetic coding sequence
atgggccccagaaagaagagcgtgaagacctgcatcatgaacaacgagatccccgaggagatgaccgccgacgagaccaaggactacatgaaccagctgagccacgaggtgctgtgccacatcttcagatacctgcccctgcaggacatcatgtgcatggagtgcctgagcagaaagctgaaggaggccgtgaccctgtacctgagagtggtgagagtggtggacctgtgcgccggcagatggtgggagtacatgcccagcggcttcaccgacgccagcttcctgaccctgctgaagaagatgcccgacgtggagcagctgtacggcctgcaccccagatacctggagagaagaagagtgagaggccacgaggccttcagcatccccggcgtgctggaggccctgcaggcctgccccaacctggtgggcgtggagaccagccacctggagctggtggagagcatctggacctacatgccccacgtgcacatcctgggcaagttcagaaacagaaacggcgccttccccatcccccccgagaacaagctgaagatccccatcggcgccaagatccagaccctgcacctggtgggcgtgaacgtgcccgagatcccctgcatccccatgctgagacacctgtacatgaagtgggtgagactgaccaagccccagcccttcaaggacttcctgtgcatcagcctgagaaccttcgtgatgagaaactgcgccggccccaccaacagcctgaagtacgtgcccctggtgaccggcctggccagcgccagaaacctggagcacctggagatggtgagagtgcccttcctgggcggcctgatccagcacgtggtggaggacagctggagaagcggcggcttcagaaacctgcacaccatcgtgctgggcgcctgcaagaacgccctggaggtggacctgggctacctgatcatcaccgccgccagaagactgcacgaggtgagaatccagcccagcctgaccaaggacggcgtgttcagcgccctgaagatggccgagctggagttcccccagttcgagaccctgcacctgggctacgtggacgagttcctgctgcagagcagaatggccaacgccgacctggtgaagtacggcctggccgacgtggtggagaaccccggcatcatcaccgacatcggcatgaaggccgtgaacgaggtgttcagctgcatcaagtacctggccatctacaactgcccccacctgcacaacccctacaactggatcagcgaccacagcagatggaccagactggtggacatcaacctggtgagatgccacgccctgaagctggacagcttcggccagttcatcgagctgctgcccagcctggagttcatcagcctggaccagatgttcagagagccccccaagggctgcgccagagtgggcctgagcgccggcaccggcatcggcgtgagcagcgccctggtgagcaaccagaacagcaacaacgacgacaacaacgcccagaacaacaacgccaacatccacgacaacaaccaccaccaccccgacgacagcgacgaggagaacgacttcagacaggacctgcagcccggcgagcagcagttcgccgccgacgccctgaacgagatggaggacatcgtgcaggaggacggcgaggtggtggccgagagcggcaacaacacccccgcccacagccaggccatcatccccgtggacgtggacgaggagcaggccggccccagcggcctgcagagagtggtgaagcccaccagcatcaccgtgcacgacagcgagagcgacgacgaggaggacagcctggagctgcaggaggtgtggatccccaagaacggcaccagaagatacagcgagagagaggagaagaccggcgagagcgtgcagagcagagagctgagcgaggtggccaagaccaagcccagacacgccatgaagagaaagagaaccgccgacaagagcaccagcaccagcgaccccgtgatcgaggacgaccacgtgcaggtgctggtgctgaagagcaagaacctggtgggcgtgaccatgaccaactgcggcatcaccgacctggtgctgaaggactgccccaagatgatgttcatccacgccaccagatgcagagtgctgaagcacctgaaggtggagaacgcccccatcgtgaacagattcgactacgcccagtgcaagaagctgaacatggaccaggtgctggaccagatcctgagaatgccccccgagagaaacagaatcatctacctgagacccatgcagcaggtggacaccctgaccctggagcagaagctgttcagcggcccctacccctaccacatctgcatcatccacgagttcagcaacccccccaacgtgagaaacaaggtgagaatcagaagctggatggacaccatcgccaacatcaaccaggagctgatcaagtacgagttcttccccgaggccaccagaagcgaggaggacctgaagaagtaccccaagtacccctggggcagagagatctacaccctggagggcgtggtggacggcgccccctacagcatgatcagcgacttcccctggctgagaagcctgagagccgccgagcccaacagcttcgccagatacgacttcgaggacgacgaggagagcaccatctacgcccccagaagaaagggccagctgagcgccgacatctgcatggagaccatcggcgaggagatcagcgagatgagacagatgaagaagggcgtgttccagagagtggtggccatcttcatccactactgcgacgtgaacggcgagcccgtggaggacgactacatctag

SEQ ID NO: 81436 - DNA, 3567 bp, Artificial Sequence
  Description of Artificial Sequence: Synthetic coding sequence
atgggccccagaaagaagagcgtgaagacctgcatcatgaacaacgagatccccgaggagatgaccgccgacgagaccaaggactacatgaaccagctgagccacgaggtgctgtgccacatcttcagatacctgcccctgcaggacatcatgtgcatggagtgcctgagcagaaagctgaaggaggccgtgaccctgtacctgagagtggtgagagtggtggacctgtgcgccggcagatggtgggagtacatgcccagcggcttcaccgacgccagcttcctgaccctgctgaagaagatgcccgacgtggagcagctgtacggcctgcaccccagatacctggagagaagaagagtgagaggccacgaggccttcagcatccccggcgtgctggaggccctgcaggcctgccccaacctggtgggcgtggagaccagccacctggagctggtggagagcatctggacctacatgccccacgtgcacatcctgggcaagttcagaaacagaaacggcgccttccccatcccccccgagaacaagctgaagatccccatcggcgccaagatccagaccctgcacctggtgggcgtgaacgtgcccgagatcccctgcatccccatgctgagacacctgtacatgaagtgggtgagactgaccaagccccagcccttcaaggacttcctgtgcatcagcctgagaaccttcgtgatgagaaactgcgccggccccaccaacagcctgaagtacgtgcccctggtgaccggcctggccagcgccagaaacctggagcacctggagatggtgagagtgcccttcctgggcggcctgatccagcacgtggtggaggacagctggagaagcggcggcttcagaaacctgcacaccatcgtgctgggcgcctgcaagaacgccctggaggtggacctgggctacctgatcatcaccgccgccagaagactgcacgaggtgagaatccagcccagcctgaccaaggacggcgtgttcagcgccctgaagatggccgagctggagttcccccagttcgagaccctgcacctgggctacgtggacgagttcctgctgcagagcagaatggccaacgccgacctggtgaagtacggcctggccgacgtggtggagaaccccggcatcatcaccgacatcggcatgaaggccgtgaacgaggtgttcagctgcatcaagtacctggccatctacaactgcccccacctgcacaacccctacaactggatcagcgaccacagcagatggaccagactggtggacatcaacctggtgagatgccacgccctgaagctggacagcttcggccagttcatcgagctgctgcccagcctggagttcatcagcctggaccagatgttcagagagccccccaagggctgcgccagagtgggcctgagcgccggcaccggcatcggcgtgagcagcgccctggtgagcaaccagaacagcaacaacgacgacaacaacgcccagaacaacaacgccaacatccacgacaacaaccaccaccaccccgacgacagcgacgaggagaacgacttcagacaggacctgcagcccggcgagcagcagttcgccgccgacgccctgaacgagatggaggacatcgtgcaggaggacggcgaggtggtggccgagagcggcaacaacacccccgcccacagccaggccatcatccccgtggacgtggacgaggagcaggccggccccagcggcctgcagagagtggtgaagcccaccagcatcaccgtgcacgacagcgagagcgacgacgaggaggacagcctggagctgcaggaggtgtggatccccaagaacggcaccagaagatacagcgagagagaggagaagaccggcgagagcgtgcagagcagagagctgagcgtgagcggcaagggcaagacccccctgagaaagagatacaacagccaccagatgggccagagcaagcagttccccctggaggagagcagctgcgagaagggctgccaggtgaccagcgagcagatcaaggccgacatgaaggccgccagagacatccccgagaagaagaagaacaaggacgtgtaccccagctgcagcagcaccaccgccagcaccgtgggcaacagcagcagccacaacaccgccagccagagccccgacttcgtgagaaccgtgaacagcggcggcagcagcgagcccagccccaccgaggtggacgtgagcagacagtgcgcctgcagccccggcggcagcgaggacagcgaggccatggaggagggcgacgccgagagcagcgtgtgccccagatgctgctgccacagaccccaggagagccagagaagaaccagcagatgcagcgacgaggagagacccagcaccagcagagcctgcgtggtgaacggccccgacggcaccagaagcgccttcagcttcagaaccctgccccagggcggcagcagcggccccgcccacgacgagagaaccaacggcagcggcagcggcgccaccggcgaggacagaagaggcagcagccagcccgagagctgcgacgtgcagagcaacgaggactaccccagaagacccctgaccagagccagaagcagactgagccacgtgctgctggtgagcgagagcgaggtggccaagaccaagcccagacacgccatgaagagaaagagaaccgccgacaagagcaccagcaccagcgaccccgtgatcgaggacgaccacgtgcaggtgctggtgctgaagagcaagaacctggtgggcgtgaccatgaccaactgcggcatcaccgacctggtgctgaaggactgccccaagatgatgttcatccacgccaccagatgcagagtgctgaagcacctgaaggtggagaacgcccccatcgtgaacagattcgactacgcccagtgcaagaagctgaacatggaccaggtgctggaccagatcctgagaatgccccccgagagaaacagaatcatctacctgagacccatgcagcaggtggacaccctgaccctggagcagaagctgttcagcggcccctacccctaccacatctgcatcatccacgagttcagcaacccccccaacgtgagaaacaaggtgagaatcagaagctggatggacaccatcgccaacatcaaccaggagctgatcaagtacgagttcttccccgaggccaccagaagcgaggaggacctgaagaagtaccccaagtacccctggggcagagagatctacaccctggagggcgtggtggacggcgccccctacagcatgatcagcgacttcccctggctgagaagcctgagagccgccgagcccaacagcttcgccagatacgacttcgaggacgacgaggagagcaccatctacgcccccagaagaaagggccagctgagcgccgacatctgcatggagaccatcggcgaggagatcagcgagatgagacagatgaagaagggcgtgttccagagagtggtggccatcttcatccactactgcgacgtgaacggcgagcccgtggaggacgactacatctag

SEQ ID NO: 81437 - DNA, 3342 bp, Artificial Sequence
  Description of Artificial Sequence: Synthetic coding sequence
atgggccccagaaagaagagcgtgaagacctgcatcatgaacaacgagatccccgaggagatgaccgccgacgagaccaaggactacatgaaccagctgagccacgaggtgctgtgccacatcttcagatacctgcccctgcaggacatcatgtgcatggagtgcctgagcagaaagctgaaggaggccgtgaccctgtacctgagagtggtgagagtggtggacctgtgcgccggcagatggtgggagtacatgcccagcggcttcaccgacgccagcttcctgaccctgctgaagaagatgcccgacgtggagcagctgtacggcctgcaccccagatacctggagagaagaagagtgagaggccacgaggccttcagcatccccggcgtgctggaggccctgcaggcctgccccaacctggtgggcgtggagaccagccacctggagctggtggagagcatctggacctacatgccccacgtgcacatcctgggcaagttcagaaacagaaacggcgccttccccatcccccccgagaacaagctgaagatccccatcggcgccaagatccagaccctgcacctggtgggcgtgaacgtgcccgagatcccctgcatccccatgctgagacacctgtacatgaagtgggtgagactgaccaagccccagcccttcaaggacttcctgtgcatcagcctgagaaccttcgtgatgagaaactgcgccggccccaccaacagcctgaagtacgtgcccctggtgaccggcctggccagcgccagaaacctggagcacctggagatggtgagagtgcccttcctgggcggcctgatccagcacgtggtggaggacagctggagaagcggcggcttcagaaacctgcacaccatcgtgctgggcgcctgcaagaacgccctggaggtggacctgggctacctgatcatcaccgccgccagaagactgcacgaggtgagaatccagcccagcctgaccaaggacggcgtgttcagcgccctgaagatggccgagctggagttcccccagttcgagaccctgcacctgggctacgtggacgagttcctgctgcagagcagaatggccaacgccgacctggtgaagtacggcctggccgacgtggtggagaaccccggcatcatcaccgacatcggcatgaaggccgtgaacgaggtgttcagctgcatcaagtacctggccatctacaactgcccccacctgcacaacccctacaactggatcagcgaccacagcagatggaccagactggtggacatcaacctggtgagatgccacgccctgaagctggacagcttcggccagttcatcgagctgctgcccagcctggagttcatcagcctggaccagatgttcagagagccccccaagggctgcgccagagtgggcctgagcgccggcaccggcatcggcgtgagcagcgccctggtgagcaaccagaacagcaacaacgacgacaacaacgcccagaacaacaacgccaacatccacgacaacaaccaccaccaccccgacgacagcgacgaggagaacgacttcagacaggacctgcagcccggcgagcagcagttcgccgccgacgccctgaacgagatggaggacatcgtgcaggaggacggcgaggtggtggccgagagcggcaacaacacccccgcccacagccaggccatcatccccgtggacgtggacgaggagcaggccggccccagcggcctgcagagagtggtgaagcccaccagcatcaccgtgcacgacagcgagagcgacgacgaggaggacagcctggagctgcaggaggtgtggatccccaagaacggcaccagaagatacagcgagagagaggagaagaccggcgagagcgtgcagagcagagagctgagcgtgagcggcaagggcaagacccccctgagaaagagatacaacagccaccagatgggccagagcaagcagttccccctggaggagagcagctgcgagaagggctgccaggtgaccagcgagcagatcaaggccgacatgaaggccgccagagacatccccgagaagaagaagaacaaggacgtgtaccccagctgcagcagcaccaccgccagcaccgtgggcaacagcagcagccacaacaccgccagccagagccccgacttcgtgagaaccgtgaacagcggcggcagcagcgagcccagccccaccgaggtggacgtgagcagacagtgcgcctgcagccccggcggcagcgaggacagcgaggccatggaggagggcgacgccgagagcagcgtgtgccccagatgctgctgccacagaccccaggagagccagagaagaaccagcagatgcagcgacgaggagagacccagcaccagcagagcctgcgtggtgaacggccccgacgaggtggccaagaccaagcccagacacgccatgaagagaaagagaaccgccgacaagagcaccagcaccagcgaccccgtgatcgaggacgaccacgtgcaggtgctggtgctgaagagcaagaacctggtgggcgtgaccatgaccaactgcggcatcaccgacctggtgctgaaggactgccccaagatgatgttcatccacgccaccagatgcagagtgctgaagcacctgaaggtggagaacgcccccatcgtgaacagattcgactacgcccagtgcaagaagctgaacatggaccaggtgctggaccagatcctgagaatgccccccgagagaaacagaatcatctacctgagacccatgcagcaggtggacaccctgaccctggagcagaagctgttcagcggcccctacccctaccacatctgcatcatccacgagttcagcaacccccccaacgtgagaaacaaggtgagaatcagaagctggatggacaccatcgccaacatcaaccaggagctgatcaagtacgagttcttccccgaggccaccagaagcgaggaggacctgaagaagtaccccaagtacccctggggcagagagatctacaccctggagggcgtggtggacggcgccccctacagcatgatcagcgacttcccctggctgagaagcctgagagccgccgagcccaacagcttcgccagatacgacttcgaggacgacgaggagagcaccatctacgcccccagaagaaagggccagctgagcgccgacatctgcatggagaccatcggcgaggagatcagcgagatgagacagatgaagaagggcgtgttccagagagtggtggccatcttcatccactactgcgacgtgaacggcgagcccgtggaggacgactacatctag

SEQ ID NO: 81438 - DNA, 2832 bp, Artificial Sequence; identical to SEQ ID NO: 81435
  Description of Artificial Sequence: Synthetic coding sequence

SEQ ID NO: 81439 - DNA, 1329 bp, Artificial Sequence
  Description of Artificial Sequence: Synthetic coding sequence
atggacgaggagagcgagctgatccagccccaggaccagagctgctgggccttcctgcccgacctgtgcctgtgcagagtgttctggtggctgggcgacagagacagaagcagagccgccctggtgtgcagaaagtggaaccagatgatgtacagcgccgagctgtggagatacagaaccatcaccttcagcggcagacccagcagagtgcacgccagcgaggtggagagcgccgtgtggtacgtgaagaagttcggcagatacctggagcacctggaggtgaagttcatgaacccctacaacgccgtgctgaccaagaagttccaggtgaccatgagaggcctgctgagctgcctgagcaagagcaacaacagactgaagagcctgagcatccagtacctggagctggacagactggtgtggagaaacagcatcagaagcagcttcatcagcagcctgagcttcttcctgaagaagatgggcaagagactggactacctgaacctgaagggcgccagactgaccgtggagcagggctgccagatcctggacagcctgagctacatgagaaacgagaacgtgatcagcgagctgaacatcgaggactacttcagccaccacctggccgtgtacaacagcccccagttcaagaagaccatgagcaccttccacaacctggtgagcctgaacctgaactacaactgcatcagcgacgagctgctggagaacctgtgcgagaacgccagcaccctgagaaccatcaacatcaagtgccacgtgcacgacccccacggccaggtgatctggggcatgagctgggccaagctggccagacaggccaccaacctgaaggtgaacttcttcttcgagagaatcatgaagtacgagagactggccagaatcctgctgcaggagatccccatcagaagcatcagcctgagaagctgctacttcagcgaccccgactgcagcatgagacccaccctgatcgacctgctgcccaccttcagacacaccctgcagaagctgacctgcgagttcaacaacaaccacgagagcctggacgaggagctgcacctgctgatcatcagctgcagaaagctgttctacttcaagatctgggccttcctggacgtgagcttcgtggagagaatcctgaagagccagaaggagagacagtgcgccctgagagtgttcaaggccagaatctacaccaacagatacgagaccaacgaggaggacaagaccctgcaggagatctacagaaagtacagaaagctgatcgagagcgagctgagctacttcgtgatcgtgtacagcgtgatgtag

SEQ ID NO: 81440 - DNA, 1164 bp, Artificial Sequence
  Description of Artificial Sequence: Synthetic coding sequence
atggccggcagcgagcccagaagcggcaccaacagcccccccccccccttcagcgactggggcagactggaggccgccatcctgagcggctggaagaccttctggcagagcgtgagcaaggagagagtggccagaaccaccagcagagaggaggtggacgaggccgccagcaccctgaccagactgcccatcgacgtgcagctgtacatcctgagcttcctgagcccccacgacctgtgccagctgggcagcaccaaccactactggaacgagaccgtgagagaccccatcctgtggagatacttcctgctgagagacctgcccagctggagcagcgtggactggaagagcctgcccgacctggagatcctgaagaagcccatcagcgaggtgaccgacggcgccttcttcgactacatggccgtgtacagaatgtgctgcccctacaccagaagagccagcaagagcagcagacccatgtacggcgccgtgaccagcttcctgcacagcctgatcatccagaacgagcccagattcgccatgttcggccccggcctggaggagctgaacaccagcctggtgctgagcctgatgagcagcgaggagctgtgccccaccgccggcctgccccagagacagatcgacggcatcggcagcggcgtgaacttccagctgaacaaccagcacaagttcaacatcctgatcctgtacagcaccaccagaaaggagagagacagagccagagaggagcacaccagcgccgtgaacaagatgttcagcagacacaacgagggcgacgaccagcagggcagcagatacagcgtgatcccccagatccagaaggtgtgcgaggtggtggacggcttcatctacgtggccaacgccgaggcccacaagagacacgagtggcaggacgagttcagccacatcatggccatgaccgaccccgccttcggcagcagcggcagacccctgctggtgctgagctgcatcagccagggcgacgtgaagagaatgccctgcttctacctggcccacgagctgcacctgaacctgctgaaccacccctggctggtgcaggacaccgaggccgagaccctgaccggcttcctgaacggcatcgagtggatcctggaggaggtggagagcaagagagccagatag

SEQ ID NO: 81441 - DNA, 924 bp, Artificial Sequence
  Description of Artificial Sequence: Synthetic coding sequence
atggccggcagcgagcccagaagcggcaccaacagcccccccccccccttcagcgactggggcagactggaggccgccatcctgagcggctggaagaccttctggcagagcgtgagcaaggagagagtggccagaaccaccagcagagaggaggtggacgaggccgccagcaccctgaccagactgcccatcgacgtgcagctgtacatcctgagcttcctgagcccccacgacctgtgccagctgggcagcaccaaccactactggaacgagaccgtgagagaccccatcctgtggagatacttcctgctgagagacctgcccagctggagcagcgtggactggaagagcctgcccgacctggagatcctgaagaagcccatcagcgaggtgaccgacggcgccttcttcgactacatggccgtgtacagaatgtgctgcccctacaccagaagagccagcaagagcagcagacccatgtacggcgccgtgaccagcttcctgcacagcctgatcatccagaacgagcccagattcgccatgttcggccccggcctggaggagctgaacaccagcctggtgctgagcctgatgagcagcgaggagctgtgccccaccgccggcctgccccagagacagatcgacggcatcggcagcggcgtgaacttccagctgaacaaccagcacaagttcaacatcctgatcctgtacagcaccaccagaaaggagagagacagagccagagaggagcacaccagcgccgtgaacaagatgttcagcagacacaacgagggcgacgaccagcagggcagcagatacagcgtgatcccccagatccagaaggtgtgcgaggtggtggacggcttcatctacgtggccaacgccgaggcccacaagagcaagtacagctacgtgcacttctag

SEQ ID NO: 81442 - DNA, 2130 bp, Artificial Sequence
  Description of Artificial Sequence: Synthetic coding sequence
atgggcaaggccagaagaagcccccccggccaccacagacactgcgagggctgcttcaacagacactgccacatccccgtggagcccaacaccagctgcctggtgatcagctgccacctgctgtgcggcgccaccttccacatgtgcaaggaggccgagcaccagctgctgtgccccctggagcaggtgccctgcctgaacagcgagtacggctgccccctgagcatgagcagacacaagctggccaagcacctgcaggtgtgccccgccagcgtggtgtgctgcagcatggagtggaacagatggcccaacgtggacagcgagaccaccctgcacgagaacatcatgaaggagacccccagcgaggagtgcctggacaccgccctggccctgcaggaccagaaggtgctgttcagaagcctgaagatggtggagctgttccccgagaccagagaggccaccgaggaggagcccaccatgaacggcgagaccagcgtggaggagatgggcggcgccgtgggcggcgtggacatcggcctggtgccccacggcctgagcgccaccaacggcgagatggccgagctgagccaggaggagagagaggtgctggccaagaccaaggagggcatggacctggtgaagttcggccagtgggagaacatcttcagcaaggagcacgccgccagcgccctgaccaacagcagcgccagctgcgagagcaagaacaagaacgacagcgagaaggagcagatcagcagcggccacaacatggtggagggcgagggcgcccccaagaagaaggagccccaggagaaccagaagcagcaggacgtgagaaccgccatggagaccaccggcctggccccctggcaggacggcgtgctggagagactgaagaccgccgtggacgccaaggactacaacatgtacctggtgcacaacggcagaatgctgatccacttcggccagatgcccgcctgcacccccaaggagagagacttcgtgtacggcaagctggaggcccaggaggtgaagaccgtgtacaccttcaaggtgcccgtgagctactgcggcaagagagccagactgggcgacgccatgctgagctgcaagcccagcgagcacaaggccgtggacaccagcgacctgggcatcaccgtggaggacctgcccaagagcgacctgatcaagaccaccctgcagtgcgccctggagagagagctgaagggccacgtgatcagcgagagcagaagcatcgacggcctgttcatggacttcgccacccagacctacaacttcgagcccgagcagttcagcagcggcaccgtgctggccgacctgaccgccgccacccccggcggcctgcacgtggagctgcacagcgagtgcgtgaccagaagacacaacaagagcagcagcgccttcaccttcacctgcaacaagttcttcagaagagacgagttccccctgcacttcaagaacgtgcacaccgacatccagagctgcctgaacggctggttccagcacagatgccccctggcctacctgggctgcaccttcgtgcagaaccacttcagaccccccggccagaaggccaaggtgatctacagccaggagctgaagaccttcgccatcaagcccgaggtggcccccgagctgagcgagggcagaaagaacaaccacctgctgggccacggcggcaagagccagaacagcctgaccagcctgcccctggagatcctgaagtacatcgccggcttcctggacagcgtgagcctggcccagctgagccaggtgagcgtgctgatgagaaacatctgcgccaccctgctgcaggagagaggcatggtgctgctgcagtggaagaagaagagatacagccacggcggcaccagctggagagtgcacagagagatctggcagttcagcagcctgttcagcaagatcaagagctgggagttcaacgaggtgaccagcatgagcgagcacctgaagagctgccccttcaacatcgtggagcacaagaccgaccccatcctgctgaccagcatgtgccagcccagagagcaggccagagagagcctggtgagcaccttcagaatcagacccagaggcagatacgtgagctag

SEQ ID NO: 81443 - DNA, 2811 bp, Artificial Sequence
  Description of Artificial Sequence: Synthetic coding sequence
atgaccaccggcctgagcgaccagcaggtggtgtgcgacctggaccacagagccgtggaggccctgctgcaggccgtgagaaagagaatggccggcgccagccccgccgtgccccacgagagagccagactgaccggcggcgccgccgccgtggagcccgcctgcagaggcggcggcggcgccatggccagcctggacctgccctacagatgccccagatgcggcgagcacaagagattcagaagcctgagcagcctgagagcccacctggagtacagccacacctacgagaccctgtacatcctgagcaagaccaacagcatctgcgacggcgccgccgccgccgccgccgccgccgccgccgccagcggcttccccctggcccccgagcccgccgccctgctggccgtgcccggcgccagaagagaggtgttcgagagcaccagcttccagggcaaggagcaggccgccggccccagccccgccgccccccacctgctgcaccaccaccaccaccacgcccccctggcccacttccccggcgacctggtgcccgccagcctgccctgcgaggagctggccgagcccggcctggtgcccgccgccgccgccagatacgccctgagagagatcgagatccccctgggcgagctgttcgccagaaagagcgtggccagcagcgcctgcagcacccccccccccggccccggccccggcccctgccccggccccgccagcgccagccccgccagccccagccccgccgacgtggcctacgaggagggcctggccagactgaagatcagagccctggagaagctggaggtggacagaagactggagagactgagcgaggaggtggagcagaagatcgccggccaggtgggcagactgcaggccgagctggagagaaaggccgccgagctggagaccgccagacaggagagcgccagactgggcagagagaaggaggagctggaggagagagccagcgagctgagcagacaggtggacgtgagcgtggagctgctggccagcctgaagcaggacctggtgcacaaggagcaggagctgagcagaaagcagcaggaggtggtgcagatcgaccagttcctgaaggagaccgccgccagagaggccagcgccaagctgagactgcagcagttcatcgaggagctgctggagagagccgacagagccgagagacagctgcaggtgatcagcagcagctgcggcagcacccccagcgccagcctgggcagaggcggcggcggcggcggcgccggccccaacgccagaggccccggcagaatgagagagcaccacgtgggccccgccgtgcccaacacctacgccgtgagcagacacggcagcagccccagcaccggcgccagcagcagagtgcccgccgccagccagagcagcggctgctacgacagcgacagcctggagctgcccagacccgaggagggcgcccccgaggacagcggccccggcggcctgggcaccagagcccaggccgccaacggcggcagcgagagaagccagccccccagaagcagcggcctgagaagacaggccatccagaactggcagagaagacccagaagacacagcaccgagggcgaggagggcgacgtgagcgacgtgggcagcagaaccaccgagagcgaggccgagggccccctggacgcccccagacccggccccgccatggccggccccctgagcagctgcagactgagcgccagacccgagggcggcagcggcagaggcagaagagccgagagagtgagccccagcagaagcaacgaggtgatcagccccgagatcctgaagatgagagccgccctgttctgcatcttcacctacctggacaccagaaccctgctgcacgccgccgaggtgtgcagagactggagattcgtggccagacaccccgccgtgtggaccagagtgctgctggagaacgccagagtgtgcagcaagttcctggccatgctggcccagtggtgcacccaggcccacagcctgaccctgcagaacctgaagcccagacagagaggcaagaaggagagcaaggaggagtacgccagaagcaccagaggctgcctggaggccggcctggagagcctgctgaaggccgccggcggcaacctgctgatcctgagaatcagccactgccccaacatcctgaccgacagaagcctgtggctggccagctgctactgcagagccctgcaggccgtgacctacagaagcgccaccgaccccgtgggccacgaggtgatctgggccctgggcgccggctgcagagagatcgtgagcctgcaggtggcccccctgcacccctgccagcagcccaccagattcagcaacagatgcctgcagatgatcggcagatgctggccccacctgagagccctgggcgtgggcggcgccggctgcggcgtgcagggcctggccagcctggccagaaactgcatgagactgcaggtgctggagctggaccacgtgagcgagatcacccaggaggtggccgccgaggtgtgcagagagggcctgaagggcctggagatgctggtgctgaccgccacccccgtgacccccaaggccctgctgcacttcaacagcatctgcagaaacctgaagagcatcgtggtgcagatcggcatcgccgactacttcaaggagcccagcagccccgaggcccagaagctgttcgaggacatggtgaccaagctgcaggccctgagaagaagacccggcttcagcaagatcctgcacatcaaggtggagggcggctgctag

SEQ ID NO: 81444 - DNA, 2628 bp, Artificial Sequence
  Description of Artificial Sequence: Synthetic coding sequence
atggccagcctggacctgccctacagatgccccagatgcggcgagcacaagagattcagaagcctgagcagcctgagagcccacctggagtacagccacacctacgagaccctgtacatcctgagcaagaccaacagcatctgcgacggcgccgccgccgccgccgccgccgccgccgccgccagcggcttccccctggcccccgagcccgccgccctgctggccgtgcccggcgccagaagagaggtgttcgagagcaccagcttccagggcaaggagcaggccgccggccccagccccgccgccccccacctgctgcaccaccaccaccaccacgcccccctggcccacttccccggcgacctggtgcccgccagcctgccctgcgaggagctggccgagcccggcctggtgcccgccgccgccgccagatacgccctgagagagatcgagatccccctgggcgagctgttcgccagaaagagcgtggccagcagcgcctgcagcacccccccccccggccccggccccggcccctgccccggccccgccagcgccagccccgccagccccagccccgccgacgtggcctacgaggagggcctggccagactgaagatcagagccctggagaagctggaggtggacagaagactggagagactgagcgaggaggtggagcagaagatcgccggccaggtgggcagactgcaggccgagctggagagaaaggccgccgagctggagaccgccagacaggagagcgccagactgggcagagagaaggaggagctggaggagagagccagcgagctgagcagacaggtggacgtgagcgtggagctgctggccagcctgaagcaggacctggtgcacaaggagcaggagctgagcagaaagcagcaggaggtggtgcagatcgaccagttcctgaaggagaccgccgccagagaggccagcgccaagctgagactgcagcagttcatcgaggagctgctggagagagccgacagagccgagagacagctgcaggtgatcagcagcagctgcggcagcacccccagcgccagcctgggcagaggcggcggcggcggcggcgccggccccaacgccagaggccccggcagaatgagagagcaccacgtgggccccgccgtgcccaacacctacgccgtgagcagacacggcagcagccccagcaccggcgccagcagcagagtgcccgccgccagccagagcagcggctgctacgacagcgacagcctggagctgcccagacccgaggagggcgcccccgaggacagcggccccggcggcctgggcaccagagcccaggccgccaacggcggcagcgagagaagccagccccccagaagcagcggcctgagaagacaggccatccagaactggcagagaagacccagaagacacagcaccgagggcgaggagggcgacgtgagcgacgtgggcagcagaaccaccgagagcgaggccgagggccccctggacgcccccagacccggccccgccatggccggccccctgagcagctgcagactgagcgccagacccgagggcggcagcggcagaggcagaagagccgagagagtgagccccagcagaagcaacgaggtgatcagccccgagatcctgaagatgagagccgccctgttctgcatcttcacctacctggacaccagaaccctgctgcacgccgccgaggtgtgcagagactggagattcgtggccagacaccccgccgtgtggaccagagtgctgctggagaacgccagagtgtgcagcaagttcctggccatgctggcccagtggtgcacccaggcccacagcctgaccctgcagaacctgaagcccagacagagaggcaagaaggagagcaaggaggagtacgccagaagcaccagaggctgcctggaggccggcctggagagcctgctgaaggccgccggcggcaacctgctgatcctgagaatcagccactgccccaacatcctgaccgacagaagcctgtggctggccagctgctactgcagagccctgcaggccgtgacctacagaagcgccaccgaccccgtgggccacgaggtgatctgggccctgggcgccggctgcagagagatcgtgagcctgcaggtggcccccctgcacccctgccagcagcccaccagattcagcaacagatgcctgcagatgatcggcagatgctggccccacctgagagccctgggcgtgggcggcgccggctgcggcgtgcagggcctggccagcctggccagaaactgcatgagactgcaggtgctggagctggaccacgtgagcgagatcacccaggaggtggccgccgaggtgtgcagagagggcctgaagggcctggagatgctggtgctgaccgccacccccgtgacccccaaggccctgctgcacttcaacagcatctgcagaaacctgaagagcatcgtggtgcagatcggcatcgccgactacttcaaggagcccagcagccccgaggcccagaagctgttcgaggacatggtgaccaagctgcaggccctgagaagaagacccggcttcagcaagatcctgcacatcaaggtggagggcggctgctag

SEQ ID NO: 81445 - DNA, 2154 bp, Artificial Sequence
  Description of Artificial Sequence: Synthetic coding sequence
atggccagcagcagcgacagcgaggacgacagcttcatggccgtggaccaggaggagaccgtgctggagggcaccatggaccaggacgaggagccccaccccgtgctggaggccgaggagaccagacacaacagaagcatgagcgagctgcccgaggaggtgctggagtacatcctgagcttcctgagcccctaccaggagcacaagaccgccgccctggtgtgcaagcagtggtacagactgatcaagggcgtggcccaccagtgctaccacggcttcatgaaggccgtgcaggagggcaacatccagtgggagagcagaacctacccctaccccggcacccccatcacccagagattcagccacagcgcctgctactacgacgccaaccagagcatgtacgtgttcggcggctgcacccagagcagctgcaacgccgccttcaacgacctgtggagactggacctgaacagcaaggagtggatcagacccctggccagcggcagctaccccagccccaaggccggcgccaccctggtggtgtacaaggacctgctggtgctgttcggcggctggaccagacccagcccctaccccctgcaccagcccgagagattcttcgacgagatccacacctacagccccagcaagaactggtggaactgcatcgtgaccacccacggccccccccccatggccggccacagcagctgcgtgatcgacgacaagatgatcgtgttcggcggcagcctgggcagcagacagatgagcaacgacgtgtgggtgctggacctggagcagtgggcctggagcaagcccaacatcagcggccccagcccccaccccagaggcggccagagccagatcgtgatcgacgacgccaccatcctgatcctgggcggctgcggcggccccaacgccctgttcaaggacgcctggctgctgcacatgcacagcggcccctgggcctggcagcccctgaaggtggagaacgaggagcacggcgcccccgagctgtggtgccaccccgcctgcagagtgggccagtgcgtggtggtgttcagccaggcccccagcggcagagcccccctgagccccagcctgaacagcagacccagccccatcagcgccaccccccccgccctggtgcccgagaccagagagtacagaagccagagccccgtgagaagcatggacgaggccccctgcgtgaacggcagatggggcaccctgagacccagagcccagagacagacccccagcggcagcagagagggcagcctgagccccgccagaggcgacggcagccccatcctgaacggcggcagcctgagccccggcaccgccgccgtgggcggcagcagcctggacagccccgtgcaggccatcagccccagcacccccagcgcccccgagggctacgacctgaagatcggcctgagcctggcccccagaagaggcagcctgcccgaccagaaggacctgagactgggcagcatcgacctgaactgggacctgaagcccgccagcagcagcaaccccatggacggcatggacaacagaaccgtgggcggcagcatgagacacccccccgagcagaccaacggcgtgcacacccccccccacgtggccagcgccctggccggcgccgtgagccccggcgccctgagaagaagcctggaggccatcaaggccatgagcagcaagggccccagcgccagcgccgccctgagcccccccctgggcagcagccccggcagccccggcagccagagcctgagcagcggcgagaccgtgcccatccccagacccggccccgcccagggcgacggccacagcctgccccccatcgccagaagactgggccaccaccccccccagagcctgaacgtgggcaagcccctgtaccagagcatgaactgcaagcccatgcagatgtacgtgctggacatcaaggacaccaaggagaagggcagagtgaagtggaaggtgttcaacagcagcagcgtggtgggcccccccgagaccagcctgcacaccgtggtgcagggcagaggcgagctgatcatcttcggcggcctgatggacaagaagcagaacgtgaagtactaccccaagaccaacgccctgtacttcgtgagagccaagagatag

SEQ ID NO: 81446 - DNA, 900 bp, Artificial Sequence
  Description of Artificial Sequence: Synthetic coding sequence
atgagcagccccccccagatcgtgatcgacgacgccaccatcctgatcctgggcggctgcggcggccccaacgccctgttcaaggacgcctggctgctgcacatgcacagcggcccctgggcctggcagcccctgaaggtggagaacgaggagcacggcgcccccgagctgtggtgccaccccgcctgcagagtgggccagtgcgtggtggtgttcagccaggcccccagcggcagagcccccctgagccccagcctgaacagcagacccagccccatcagcgccaccccccccgccctggtgcccgagaccagagagtacagaagccagagccccgtgagaagcatggacgaggccccctgcgtgaacggcagatggggcaccctgagacccagagcccagagacagacccccagcggcagcagagagggcagcctgagccccgccagaggcgacggcagccccatcctgaacggcggcagcctgagccccggcaccgccgccgtgggcggcagcagcctggacagccccgtgcaggccatcagccccagcacccccagcgcccccgagggctacgacctgaagatcggcctgagcctggcccccagaagaggcagcctgcccgaccagaaggacctgagactgggcagcatcgacctgaactgggacctgaagcccgccagcagcagcaaccccatggacggcatggacaacagaaccgtgggcggcagcatgagacacccccccgagcagaccaacggcgtgcacacccccccccacgtggccagcgccctggccggcgccgtgagccccggcgccctgagaagaagcctggaggccatcaaggccatgagcagcaagggccccagcgccagcgccgccctgagcccccccctgtag

SEQ ID NO: 81447 - DNA, 900 bp, Artificial Sequence; identical to SEQ ID NO: 81446
  Description of Artificial Sequence: Synthetic coding sequence

SEQ ID NO: 81448 - DNA, 2127 bp, Artificial Sequence
  Description of Artificial Sequence: Synthetic coding sequence
atgagcttcaaggacaaggacgagagaatcagctgcctggaggcctacgtgaccctgaccagcaagagcagcagattcaccgacgagaccgagatcctgaagatgagccagagacacagcggccaggccggcaccgaggccggcaacggcgccgacagcccccccatcgtgaacagcaagtacagcaccttcagagacttctgcagcaccagcagcttccaggacagcggctacaacgagctgaagagctgcagcttcgacaacatcgacaaggagtacctgggcaagaaggagaagggccccaccctgctgtacgagcaccccgagaccagcggcctgggcctgacccaccccctggagagccccacccagaagaagaagtgcatcctgcccagaaaggagaaggacaagacccccgagctgtgcgagacccccaagatcagcggcaagaagtgcctgcccagaagaagactgaacgtgagcttcgccctgctgaagggcgacttcgagagccagaacagcagcctggagagcagcatcagccaggtgatcaacctggagaagaacatccccagcagcgccagcggcttcagcagagccaacaacttcagccccctggtgaccagcaccctgaagaccgaggaggtgaccagctgcagccagaagctgagactgaacttcagccagcagaagaccagcaccatcgacgacagcaaggacgactgcagcctgttcgaggtggagtgcatcagccccatccagggcaacaacttcaaggacagcatcacccacgacttcagcgacagcagcctgtgcatcaacgacgagaacgcctgccccgagctgctgggcagcagcgtgagcggcaccacctgcggcaccgacgaggacatcttcgtgacccccatcagcaacctggtggccaacatcagattcaacgccagccagatcctgagccccagccccgaggtgagaggcagcatcagcacccccgaggacagcggcttcaacagcctgagcctggagaagagcgaggacagcctgagcgaccaggagggcagcttccaggagctgctgcagaagcacaagggcacccccaaggtgggcgacaccatcagaaagaccagacacctgggcagaagcagaagactgagcaccctgagagagcagagcagccagagcgagaccgaggaggagaagcagatcgtgcaccccgacagcgagaagagagccgccgccgccagcgccatcagcgagggccagctgagcagcgacgagagcggcgacctgaccttcagcctgaagaacctgagcaagacccccgccctgcagctggtgcacgagctgttcatgaagagcaagagaaagagactgcaggagaacagcggccacgagttcctggagcagggcgacggcgagaagatcgccgtgctgcagtgcatcctggccggcctgatcggcaagaagatgggcatcgagaagctggacatcctgaccgagctgaagtacagaaacctgaagcacatcctggccatggtgctggagagcctgaccgccgagagcctgtgcagcgtgtggaaggtgagcagaaactggagagagatcgtggtgcaggacaagaacgccaacagaagaagaaagttctacatcacccagctgaagaccgacagcgagggcgccgtgctgaacgtggaggacgccgccaccagactgcagctgctgaacagaagcgccctgagaagcgtgcaggcccaggccagaatccccggcagccagagagagcagggcagcaccctgagcccctggggcgaggtgctgacccccctggccagcagcagcgtgacccacctgagcagcaagcaggaggagtacgtgaaggtggccaagaccctgttcaccgacgaggccctgaagccctgccccagatgccagagccccgccaagtaccagccctacaagaagagaggcctgtgcagcagaaccgcctgcggcttcgacttctgcgtgctgtgcctgtgcgcctaccacggcagcgaggagtgcagcagaggcgccgccaagcccagaaacagaaaggacgccctgcccggcagcgcccagagcaagagaaacctgaagagactgtag

SEQ ID NO: 81449 - DNA, 675 bp, Artificial Sequence
  Description of Artificial Sequence: Synthetic coding sequence
atggccgtgggcaacatcaacgagctgcccgagaacatcctgctggagctgttcacccacgtgcccgccagacagctgctgctgaactgcagactggtgtgcagcctgtggagagacctgatcgacctggtgaccctgtggaagagaaagtgcctgagagagggcttcatcaccgaggactgggaccagcccgtggccgactggaagatcttctacttcctgagaagcctgcacagaaacctgctgcacaacccctgcgccgaggagggcttcgagttctggagcctggacgtgaacggcggcgacgagtggaaggtggaggacctgagcagagaccagagaaaggagttccccaacgaccaggtgagaagccaggccagactgagagtgcaggtgcccgccgtgagaagcgcccccgtggtgagagccagagccagcggcgacctgcccgccagacccggcgaccaccccgccgaggagagatgccaggtggagggcggcctgccccacatcctgcagctgcccgccagaagacccctgcacctggtgagcgccagaagaagaggccacagcctgctgggcagactggtgagacccgagggccaccagcagcagcaccaccacagagcccccgccgccctgaccccccccgagccccccagcgccgagccctag

SEQ ID NO: 81450 - DNA, 768 bp, Artificial Sequence
  Description of Artificial Sequence: Synthetic coding sequence
atggccgtgggcaacatcaacgagctgcccgagaacatcctgctggagctgttcacccacgtgcccgccagacagctgctgctgaactgcagactggtgtgcagcctgtggagagacctgatcgacctggtgaccctgtggaagagaaagtgcctgagagagggcttcatcaccgaggactgggaccagcccgtggccgactggaagatcttctacttcctgagaagcctgcacagaaacctgctgcacaacccctgcgccgaggagggcttcgagttctggagcctggacgtgaacggcggcgacgagtggaaggtggaggacctgagcagagaccagagaaaggagttccccaacgaccaggtgaagaagtacttcgtgaccagctactacacctgcctgaagagccaggtggtggacctgaaggccgagggctactgggaggagctgatggacaccaccagacccgacatcgaggtgaaggactggttcgccgccagacccgactgcggcagcaagtaccagctgtgcgtgcagctgctgagcagcgcccacgcccccctgggcaccttccagcccgaccccgccaccatccagcagaagagcgacgccaagtggagagaggtgagccacaccttcagcaactacccccccggcgtgagatacatctggttccagcacggcggcgtggacacccactactgggccggctggtacggccccagagtgaccaacagcagcatcaccatcggcccccccctgccctag

SEQ ID NO: 81451 - DNA, 675 bp, Artificial Sequence; identical to SEQ ID NO: 81449
  Description of Artificial Sequence: Synthetic coding sequence

SEQ ID NO: 81452 - DNA, 675 bp, Artificial Sequence; identical to SEQ ID NO: 81449
  Description of Artificial Sequence: Synthetic coding sequence

SEQ ID NO: 81453 - DNA, 771 bp, Artificial Sequence
  Description of Artificial Sequence: Synthetic coding sequence
atggccgtgggcaacatcaacgagctgcccgagaacatcctgctggagctgttcacccacgtgcccgccagacagctgctgctgaactgcagactggtgtgcagcctgtggagagacctgatcgacctggtgaccctgtggaagagaaagtgcctgagagagggcttcatcaccgaggactgggaccagcccgtggccgactggaagatcttctacttcctgagaagcctgcacagaaacctgctgcacaacccctgcgccgaggagggcttcgagttctggagcctggacgtgaacggcggcgacgagtggaaggtggaggacctgagcagagaccagagaaaggagttccccaacgaccagcacctgccccaggtgcccggcggcggcccccagggcagaagagtgctgggcggcgccgacggctaccacaccgccggccacagaggccagggcctggtgagaagccaggccagactgagagtgcaggtgcccgccgtgagaagcgcccccgtggtgagagccagagccagcggcgacctgcccgccagacccggcgaccaccccgccgaggagagatgccaggtggagggcggcctgccccacatcctgcagctgcccgccagaagacccctgcacctggtgagcgccagaagaagaggccacagcctgctgggcagactggtgagacccgagggccaccagcagcagcaccaccacagagcccccgccgccctgaccccccccgagccccccagcgccgagccctag

SEQ ID NO: 81454 - DNA, 768 bp, Artificial Sequence; identical to SEQ ID NO: 81450
  Description of Artificial Sequence: Synthetic coding sequence

SEQ ID NO: 81455 - DNA, 498 bp, Artificial Sequence
  Description of Artificial Sequence: Synthetic coding sequence
atggccgtgggcaacatcaacgagctgcccgagaacatcctgctggagctgttcacccacgtgcccgccagacagctgctgctgaactgcagactggtgtgcagcctgtggagagacctgatcgacctggtgaccctgtggaagagaaagtgcctgagagagggcttcatcaccgaggactgggaccagcccgtggccgactggaagatcttctacttcctgagaagcctgcacagaaacctgctgcacaacccctgcgccgaggagggcttcgagttctggagcctggacgtgaacggcggcgacgagtggaaggtggaggacctgagcagagaccagagaaaggagttccccaacgaccaggtgagaagccaggccagactgagagtgcaggtgcccgccgtgagaagcgcccccgtggtgagagccagagccagcggcgacctgcccgccagacccggcgaccaccccgccgaggagagatgccaggtggagtag

SEQ ID NO: 81456 - DNA, 861 bp, Artificial Sequence
  Description of Artificial Sequence: Synthetic coding sequence
atggccgcccccgcccccggcgccggcgccgccagcggcggcgccggctgcagcggcggcggcgccggcgccggcgccggcagcggcagcggcgccgccggcgccggcggcagactgcccagcagagtgctggagctggtgttcagctacctggagctgagcgagctgagaagctgcgccctggtgtgcaagcactggtacagatgcctgcacggcgacgagaacagcgaggtgtggagaagcctgtgcgccagaagcctggccgaggaggccctgagaaccgacatcctgtgcaacctgcccagctacaaggccaagatcagagccttccagcacgccttcagcaccaacgactgcagcagaaacgtgtacatcaagaagaacggcttcaccctgcacagaaaccccatcgcccagagcaccgacggcgccagaaccaagatcggcttcagcgagggcagacacgcctgggaggtgtggtgggagggccccctgggcaccgtggccgtgatcggcatcgccaccaagagagcccccatgcagtgccagggctacgtggccctgctgggcagcgacgaccagagctggggctggaacctggtggacaacaacctgctgcacaacggcgaggtgaacggcagcttcccccagtgcaacaacgcccccaagtaccagatcggcgagagaatcagagtgatcctggacatggaggacaagaccctggccttcgagagaggctacgagttcctgggcgtggccttcagaggcctgcccaaggtgtgcctgtaccccgccgtgagcgccgtgtacggcaacaccgaggtgaccctggtgtacctgggcaagcccctggacggctag

SEQ ID NO: 81457 - DNA, 1812 bp, Artificial Sequence
  Description of Artificial Sequence: Synthetic coding sequence
atggacagaggcagcctgctgcccttccagctgtggtgccccagacccttcggcacctacagccagaaccagcccagaccccccagcgccgccctgaagcccagcgcctgccccgagcccggcggcggcgccgagcccgaccacggccccgcccacagcgagaacaccccccccgccctggccaccgaggtgcccgccagccagcccgcccccctgctgagcgccgccgccgccggcgacgagggcagagtgctgctggacacctggtacgtgatcaagcccggcaacaccaaggagaaggtggccttcttcgtggcccaccagtgcggcggcggcagcagagccagcagcatgaaggtgaagggccactggggcagcgacagcagcaaggccaagagaagaagaagatgcctggaccccaccaaggccccccccgaccccggcggcagagagggcccccccgccgccgaggagggccccgccagcgccggcgaggacgtggacctgctgagcgtggccgagatggtggccctggtggagcagagagccgccctggccctgcagagctaccccagacccaccacccccgcccccgtggtgttcgtgagcgccgagcagggcggccccgccaagggcgtgggcagcgagagaagaagcggcggcggcgactgcagcagagtggccgaggccgtggcccacttcgaggcccagagagacagcccccccaccaagggcctgagaaaggaggagagacccggccccggccccggcgaggtgagaatcgccttcagaatcagcaacggcagagagcccagagcccccgacagcggcctgcccagcggcggcggcggcagacccggctgcgcctaccccggcagccccggccccggcgccagagccaaggacaagatcacctgcgacctgtaccagctgatcagccccagcagagacgccctgcccagcaacgtggagttcctgctggccagagccgacgaggccagcgagggcgacagccccgcccccgccagacccgaggacaccccccccgcccccccccccccccccgccagagactgcggcgccagcggcttccacgtggacgtggtggtgaccggcgtggtggacgagtgcatcttcttcggcaaggacggcaccaagaacgtgaaggaggagaccgtgtgcctgaccgtgagccccgaggagccccccccccccggccagctgttcttcctgcagaacagaggccccgacggcccccccgagcccccccccgccgacagccccgccaccgcccccggccccgacgacgccgagggcaccgccgacaccagcctgtgcagactgtacagacacgtgagccacgacttcctggagatcagattcaagatccagagactgctggagcccagacagtacatgctgctgctgcccgagcacgtgctggtgaagatcttcagcttcctgcccaccagagccctggccgccctgaagtgcacctgccaccacttcaagggcatcatcgaggccttcggcgtgagagccaccgacagcagatggagcagagaccccctgtacagagacgacccctgcaagcagtgcagaaagagatacgagaagggcgacgtgagcctgtgcagatggcaccccaagccctaccaccacgacctgccctacggcagaagctactggatgtgctgcagaagagccgacagagagacccccggctgcagactgggcctgcacgacaacaactgggtgctgccctgcaacggccccggcggcggcagagccggcagagaggagggcagatag

SEQ ID NO: 81458 - DNA, 609 bp, Artificial Sequence
  Description of Artificial Sequence: Synthetic coding sequence
atgacctgcctgaccgacgtgcccaccggctgcgccgccgtggagcccaccgccagactgcccgccgccgcctgggccagcaccatcaccaccggctgctgccccgccatgggccaggccggcgccggccccgccggcagaagaggcggcgaggccggcggcggcgagggcagagcccaccacgcccaccccagccccctgcccagagagcccagagtgagaaccggcccccccgcccacagccccacccccggcagcatcgaccccagccccgagctgagctggggcagcgccggcgtgacccaggagagccccctgctggaccccgtggacttcctgctgttcagaaccagagccgtggaccccctgagaagagtgttcttcttcttctaccagcacctgaccttcttcagcatccagccccagccccccccctgccacgccttccaccccaaggacccccccgccggcagcagaagacagctgatcctggtgcccctgaagggcccccccatcctggcccccatcctgagcctgacccccatcctgagcagatggagctgctacttccccagaagcagaatcgcccagggctggcacctgagctag

SEQ ID NO: 81459 - DNA, 1359 bp, Artificial Sequence
  Description of Artificial Sequence: Synthetic coding sequence
atggccagcagaatcaacaccaacttcaccctgatccccaaccagaagctgagaagaagcaacagacagaccagctgctacagcaagaccctgggcagcggcttccagcccatcagcaccttcggcaacttcaaggccctgcccctggagatcttccagatcatcctgaagtacctgagcgtgaaggacatcagcatgctgagcatggtgagcaagaccgtgagccagcacatcatcaactacatcagcaccagcagcggcagcaagagactgctgctgcaggacttccacaacctggagctgcccgacagaagacaggacagcgccatcctggagcactacagaagcctgggcctgctgttcaagagatgcaccctgctgctgcccaccaaggagagactgaagtacatccacaagatcctgaccgaggtgagctgcttcaagttcaacggctgcgccgcccccatgcagtgcctgggcctgacctgctacggcatgttcctgcagaccctgaccgccggctgggacgagctggagtgccacagagtgtacaacttcctgtgcgagctgaccaacctgtgcagaaagatccagatggccgtgtgcagcaagcccggcagcgcccagaagctggagctgagaatcagactgttctgcagaaacgtgctgctggaccactggacccacagaagcgacagcgccttctggctgaccagaatcctgaagccctggcccatggtgaaccaggccagactgctgtacatcatcttcggccccatcagcccccaggacggccaggtggtgtggcaggagatgatcgaggagcccaccgacgagttcagcctgaagggcctggccgacgccatcaagctgctgtacgacgccagcaccaaggagtggaccgccgacgacgtgatcagcctggtggacgagctgagcgtggtgcccagagagtggctgctggagaacaacgccagactgctgatgctgagcggcaacaacatctgcttcagcttcatggccagcaaggccgtgaacggcagaaccatcgagctggccagactggtggtgttcctggccctggtgtgcgagaaggagctgtactgcatggactggaccgtgaagatgatgcagaaggtgtgcaaggtgttcagcacccccgtggagagaaagaacttcctgcagaacgtggccaacgccttcgcctgcgtgatcatggagatgctgcagagcatcatgagcggcgacagagacgaggacgacagaagcttcctgaacctgttccacctggtgcacgcccaggccaacttccacaaggaggtgctgtacctgaccatgaacacccccctgagcacctag

SEQ ID NO: 81460 - DNA, 2133 bp, Artificial Sequence
  Description of Artificial Sequence: Synthetic coding sequence
atgggcggcaagcagagagacgaggacgacgaggcctacggcaagcccgtgaagtacgaccccagcttcagaggccccatcaagaacagaagctgcaccgacgtgatctgctgcgtgctgttcctgctgttcatcctgggctacatcgtggtgggcatcgtggcctggctgtacggcgaccccagacaggtgctgtaccccagaaacagcaccggcgcctactgcggcatgggcgagaacaaggacaagccctacctgctgtacttcaacatcttcagctgcatcctgagcagcaacatcatcagcgtggccgagaacggcctgcagtgccccaccccccaggtgtgcgtgagcagctgccccgaggacccctggaccgtgggcaagaacgagttcagccagaccgtgggcgaggtgttctacaccaagaacagaaacttctgcctgcccggcgtgccctggaacatgaccgtgatcaccagcctgcagcaggagctgtgccccagcttcctgctgcccagcgcccccgccctgggcagatgcttcccctggaccaacgtgaccccccccgccctgcccggcatcaccaacgacaccaccatccagcagggcatcagcggcctgatcgacagcctgaacgccagagacatcagcgtgaagatcttcgaggacttcgcccagagctggtactggatcctggtggccctgggcgtggccctggtgctgagcctgctgttcatcctgctgctgagactggtggccggccccctggtgctggtgctgatcctgggcgtgctgggcgtgctggcctacggcatctactactgctgggaggagtacagagtgctgagagacaagggcgccagcatcagccagctgggcttcaccaccaacctgagcgcctaccagagcgtgcaggagacctggctggccgccctgatcgtgctggccgtgctggaggccatcctgctgctgatgctgatcttcctgagacagagaatcagaatcgccatcgccctgctgaaggaggccagcaaggccgtgggccagatgatgagcaccatgttctaccccctggtgaccttcgtgctgctgctgatctgcatcgcctactgggccatgaccgccctgtacctggccaccagcggccagccccagtacgtgctgtgggccagcaacatcagcagccccggctgcgagaaggtgcccatcaacaccagctgcaaccccaccgcccacctggtgaacagcagctgccccggcctgatgtgcgtgttccagggctacagcagcaagggcctgatccagagaagcgtgttcaacctgcagatctacggcgtgctgggcctgttctggaccctgaactgggtgctggccctgggccagtgcgtgctggccggcgccttcgccagcttctactgggccttccacaagccccaggacatccccaccttccccctgatcagcgccttcatcagaaccctgagataccacaccggcagcctggccttcggcgccctgatcctgaccctggtgcagatcgccagagtgatcctggagtacatcgaccacaagctgagaggcgtgcagaaccccgtggccagatgcatcatgtgctgcttcaagtgctgcctgtggtgcctggagaagttcatcaagttcctgaacagaaacgcctacatcatgatcgccatctacggcaagaacttctgcgtgagcgccaagaacgccttcatgctgctgatgagaaacatcgtgagagtggtggtgctggacaaggtgaccgacctgctgctgttcttcggcaagctgctggtggtgggcggcgtgggcgtgctgagcttcttcttcttcagcggcagaatccccggcctgggcaaggacttcaagagcccccacctgaactactactggctgcccatcatgaccagcatcctgggcgcctacgtgatcgccagcggcttcttcagcgtgttcggcatgtgcgtggacaccctgttcctgtgcttcctggaggacctggagagaaacaacggcagcctggacagaccctactacatgagcaagagcctgctgaagatcctgggcaagaagaacgaggccccccccgacaacaagaagagaaagaagtag

SEQ ID NO: 81461 - DNA, 1206 bp, Artificial Sequence
  Description of Artificial Sequence: Synthetic coding sequence
atgaagtgcgacttcaactgcaaccacgtgcacagcggcctgaagctggtgaagcccgacgacatcggcagactggtgagctacacccccgcctacctggagggcagctgcaaggactgcatcaaggactacgagagactgagctgcatcggcagccccatcgtgagccccagaatcgtgcagctggagaccgagagcaagagactgcacaacaaggagaaccagcacgtgcagcagaccctgaacagcaccaacgagatcgaggccctggagaccagcagactgtacgaggacagcggctacagcagcttcagcctgcagagcggcctgagcgagcacgaggagggcagcctgctggaggagaacttcggcgacagcctgcagagctgcctgctgcagatccagagccccgaccagtaccccaacaagaacctgctgcccgtgctgcacttcgagaaggtggtgtgcagcaccctgaagaagaacgccaagagaaaccccaaggtggacagagagatgctgaaggagatcatcgccagaggcaacttcagactgcagaacatcatcggcagaaagatgggcctggagtgcgtggacatcctgagcgagctgttcagaagaggcctgagacacgtgctggccaccatcctggcccagctgagcgacatggacctgatcaacgtgagcaaggtgagcaccacctggaagaagatcctggaggacgacaagggcgccttccagctgtacagcaaggccatccagagagtgaccgagaacaacaacaagttcagcccccacgccagcaccagagagtacgtgatgttcagaacccccctggccagcgtgcagaagagcgccgcccagaccagcctgaagaaggacgcccagaccaagctgagcaaccagggcgaccagaagggcagcacctacagcagacacaacgagttcagcgaggtggccaagaccctgaagaagaacgagagcctgaaggcctgcatcagatgcaacagccccgccaagtacgactgctacctgcagagagccacctgcaagagagagggctgcggcttcgactactgcaccaagtgcctgtgcaactaccacaccaccaaggactgcagcgacggcaagctgctgaaggccagctgcaagatcggccccctgcccggcaccaagaagagcaagaagaacctgagaagactgtag

SEQ ID NO: 81462 - DNA, 882 bp, Artificial Sequence
  Description of Artificial Sequence: Synthetic coding sequence
atggacgccccccacagcaaggccgccctggacagcatcaacgagctgcccgagaacatcctgctggagctgttcacccacgtgcccgccagacagctgctgctgaactgcagactggtgtgcagcctgtggagagacctgatcgacctgatgaccctgtggaagagaaagtgcctgagagagggcttcatcaccaaggactgggaccagcccgtggccgactggaagatcttctacttcctgagaagcctgcacagaaacctgctgagaaacccctgcgccgaggaggacatgttcgcctggcagatcgacttcaacggcggcgacagatggaaggtggagagcctgcccggcgcccacggcaccgacttccccgaccccaaggtgaagaagtacttcgtgaccagctacgagatgtgcctgaagagccagctggtggacctggtggccgagggctactgggaggagctgctggacaccttcagacccgacatcgtggtgaaggactggttcgccgccagagccgactgcggctgcacctaccagctgaaggtgcagctggccagcgccgactacttcgtgctggccagcttcgagcccccccccgtgaccatccagcagtggaacaacgccacctggaccgaggtgagctacaccttcagcgactaccccagaggcgtgagatacatcctgttccagcacggcggcagagacacccagtactgggccggctggtacggccccagagtgaccaacagcagcatcgtggtgagccccaagatgaccagaaaccaggccagcagcgaggcccagcccggccagaagcacggccaggaggaggccgcccagagcccctacagagccgtggtgcagatcttctag

SEQ ID NO: 81463 - DNA, 750 bp, Artificial Sequence
  Description of Artificial Sequence: Synthetic coding sequence
tgaaacgagctgcccgagaacatcctgctggagctgttcacccacgtgcccgccagacagctgctgctgaactgcagactggtgtgcagcctgtggagagacctgatcgacctgatgaccctgtggaagagaaagtgcctgagagagggcttcatcaccaaggactgggaccagcccgtggccgactggaagatcttctacttcctgagaagcctgcacagaaacctgctgagaaacccctgcgccgaggaggacatgttcgcctggcagatcgacttcaacggcggcgacagatggaaggtggagagcctgcccggcgcccacggcaccgacttccccgaccccaaggtgaagaagtacttcgtgaccagctacgagttcgccgccagagccgactgcggctgcacctaccagctgaaggtgcagctggccagcgccgactacttcgtgctggccagcttcgagcccccccccgtgaccatccagcagtggaacaacgccacctggaccgaggtgagctacaccttcagcgactaccccagaggcgtgagatacatcctgttccagcacggcggcagagacacccagtactgggccggctggtacggccccagagtgaccaacagcagcatcgtggtgagccccaagatgaccagaaaccaggccagcagcgaggcccagcccggccagaagcacggccaggaggaggccgcccagagcccctacagagccgtggtgcagatcttctag

SEQ ID NO: 81464 - DNA, 1569 bp, Artificial Sequence
  Description of Artificial Sequence: Synthetic coding sequence
atgagactgagagtgagactgctgaagagaacctggcccctggaggtgcccgagaccgagcccaccctgggccacctgagaagccacctgagacagagcctgctgtgcacctggggctacagcagcaacaccagattcaccatcaccctgaactacaaggaccccctgaccggcgacgaggagaccctggccagctacggcatcgtgagcggcgacctgatctgcctgatcctgcaggacgacatccccgcccccaacatccccagcagcaccgacagcgagcacagcagcctgcagaacaacgagcagcccagcctggccaccagcagcaaccagaccagcatgcaggacgagcagcccagcgacagcttccagggccaggccgcccagagcggcgtgtggaacgacgacagcatgctgggccccagccagaacttcgaggccgagagcatccaggacaacgcccacatggccgagggcaccggcttctaccccagcgagcccatgctgtgcagcgagagcgtggagggccaggtgccccacagcctggagaccctgtaccagagcgccgactgcagcgacgccaacgacgccctgatcgtgctgatccacctgctgatgctggagagcggctacatcccccagggcaccgaggccaaggccctgagcatgcccgagaagtggaagctgagcggcgtgtacaagctgcagtacatgcaccccctgtgcgagggcagcagcgccaccctgacctgcgtgcccctgggcaacctgatcgtggtgaacgccaccctgaagatcaacaacgagatcagaagcgtgaagagactgcagctgctgcccgagagcttcatctgcaaggagaagctgggcgagaacgtggccaacatctacaaggacctgcagaagctgagcagactgttcaaggaccagctggtgtaccccctgctggccttcaccagacaggccctgaacctgcccgacgtgttcggcctggtggtgctgcccctggagctgaagctgagaatcttcagactgctggacgtgagaagcgtgctgagcctgagcgccgtgtgcagagacctgttcaccgccagcaacgaccccctgctgtggagattcctgtacctgagagacttcagagacaacaccgtgagagtgcaggacaccgactggaaggagctgtacagaaagagacacatccagagaaaggagagccccaagggcagattcgtgatgctgctgcccagcagcacccacaccatccccttctaccccaaccccctgcaccccagacccttccccagcagcagactgccccccggcatcatcggcggcgagtacgaccagagacccaccctgccctacgtgggcgaccccatcagcagcctgatccccggccccggcgagacccccagccagttcccccccctgagacccagattcgaccccgtgggccccctgcccggccccaaccccatcctgcccggcagaggcggccccaacgacagattccccttcagacccagcagaggcagacccaccgacggcagactgagcttcatgtag

SEQ ID NO: 81465 - DNA, 1332 bp, Artificial Sequence
  Description of Artificial Sequence: Synthetic coding sequence
atggccagaccccccggcggcagcggccccctgctggacagcgagcacagcagcctgcagaacaacgagcagcccagcctggccaccagcagcaaccagaccagcatgcaggacgagcagcccagcgacagcttccagggccaggccgcccagagcggcgtgtggaacgacgacagcatgctgggccccagccagaacttcgaggccgagagcatccaggacaacgcccacatggccgagggcaccggcttctaccccagcgagcccatgctgtgcagcgagagcgtggagggccaggtgccccacagcctggagaccctgtaccagagcgccgactgcagcgacgccaacgacgccctgatcgtgctgatccacctgctgatgctggagagcggctacatcccccagggcaccgaggccaaggccctgagcatgcccgagaagtggaagctgagcggcgtgtacaagctgcagtacatgcaccccctgtgcgagggcagcagcgccaccctgacctgcgtgcccctgggcaacctgatcgtggtgaacgccaccctgaagatcaacaacgagatcagaagcgtgaagagactgcagctgctgcccgagagcttcatctgcaaggagaagctgggcgagaacgtggccaacatctacaaggacctgcagaagctgagcagactgttcaaggaccagctggtgtaccccctgctggccttcaccagacaggccctgaacctgcccgacgtgttcggcctggtggtgctgcccctggagctgaagctgagaatcttcagactgctggacgtgagaagcgtgctgagcctgagcgccgtgtgcagagacctgttcaccgccagcaacgaccccctgctgtggagattcctgtacctgagagacttcagagacaacaccgtgagagtgcaggacaccgactggaaggagctgtacagaaagagacacatccagagaaaggagagccccaagggcagattcgtgatgctgctgcccagcagcacccacaccatccccttctaccccaaccccctgcaccccagacccttccccagcagcagactgccccccggcatcatcggcggcgagtacgaccagagacccaccctgccctacgtgggcgaccccatcagcagcctgatccccggccccggcgagacccccagccagttcccccccctgagacccagattcgaccccgtgggccccctgcccggccccaaccccatcctgcccggcagaggcggccccaacgacagattccccttcagacccagcagaggcagacccaccgacggcagactgagcttcatgtag

SEQ ID NO: 81466 - DNA, 1227 bp, Artificial Sequence
  Description of Artificial Sequence: Synthetic coding sequence
atgcaggacgagcagcccagcgacagcttccagggccaggccgcccagagcggcgtgtggaacgacgacagcatgctgggccccagccagaacttcgaggccgagagcatccaggacaacgcccacatggccgagggcaccggcttctaccccagcgagcccatgctgtgcagcgagagcgtggagggccaggtgccccacagcctggagaccctgtaccagagcgccgactgcagcgacgccaacgacgccctgatcgtgctgatccacctgctgatgctggagagcggctacatcccccagggcaccgaggccaaggccctgagcatgcccgagaagtggaagctgagcggcgtgtacaagctgcagtacatgcaccccctgtgcgagggcagcagcgccaccctgacctgcgtgcccctgggcaacctgatcgtggtgaacgccaccctgaagatcaacaacgagatcagaagcgtgaagagactgcagctgctgcccgagagcttcatctgcaaggagaagctgggcgagaacgtggccaacatctacaaggacctgcagaagctgagcagactgttcaaggaccagctggtgtaccccctgctggccttcaccagacaggccctgaacctgcccgacgtgttcggcctggtggtgctgcccctggagctgaagctgagaatcttcagactgctggacgtgagaagcgtgctgagcctgagcgccgtgtgcagagacctgttcaccgccagcaacgaccccctgctgtggagattcctgtacctgagagacttcagagacaacaccgtgagagtgcaggacaccgactggaaggagctgtacagaaagagacacatccagagaaaggagagccccaagggcagattcgtgatgctgctgcccagcagcacccacaccatccccttctaccccaaccccctgcaccccagacccttccccagcagcagactgccccccggcatcatcggcggcgagtacgaccagagacccaccctgccctacgtgggcgaccccatcagcagcctgatccccggccccggcgagacccccagccagttcccccccctgagacccagattcgaccccgtgggccccctgcccggccccaaccccatcctgcccggcagaggcggccccaacgacagattccccttcagacccagcagaggcagacccaccgacggcagactgagcttcatgtag

SEQ ID NO: 81467 - DNA, 699 bp, Artificial Sequence
  Description of Artificial Sequence: Synthetic coding sequence
atgcagctgaccttcgcctggctgcacgtgttcggcagaaccctgagaatgatgaacttcagcggcaagggctgcgccaacccctggggccactgcagcatctacaacaagaacccccccctgggcttcagcttcagaaagctgtacatgcagctggacgagggcagcctgaccttcaacgccaaccccgacgagggcgtgaactacttcatgagcaagggcatcctggacgacagccccaaggagatcgccaagttcatcttctgcaccagaaccctgaactggaagaagctgagaatctacctggacgagagaagagacgtgctggacgacctggtgaccctgcacaacttcagaaaccagttcctgcccaacgccctgagagagttcttcagacacatccacgcccccgaggagagaggcgagtacctggagaccctgatcaccaagttcagccacagattctgcgcctgcaaccccgacctgatgagagagctgggcctgagccccgacgccgtgtacgtgctgtgctacagcctgatcctgctgagcatcgacctgaccagcccccacgtgaagaacaagatgagcaagagagagttcatcagaaacaccagaagagccgcccagaacatcagcgaggacttcgtgggccacctgtacgacaacatctacctgatcggccacgtggccgcctag

SEQ ID NO: 81468 - DNA, 960 bp, Artificial Sequence
  Description of Artificial Sequence: Synthetic coding sequence
atgggccagggcctgtggagagtggtgagaaaccagcagctgcagcaggagggctacagcgagcagggctacctgaccagagagcagagcagaagaatggccgccagcaacatcagcaacaccaaccacagaaagcaggtgcagggcggcatcgacatctaccacctgctgaaggccagaaagagcaaggagcaggagggcttcatcaacctggagatgctgccccccgagctgagcttcaccatcctgagctacctgaacgccaccgacctgtgcctggccagctgcgtgtggcaggacctggccaacgacgagctgctgtggcagggcctgtgcaagagcacctggggccactgcagcatctacaacaagaacccccccctgggcttcagcttcagaaagctgtacatgcagctggacgagggcagcctgaccttcaacgccaaccccgacgagggcgtgaactacttcatgagcaagggcatcctggacgacagccccaaggagatcgccaagttcatcttctgcaccagaaccctgaactggaagaagctgagaatctacctggacgagagaagagacgtgctggacgacctggtgaccctgcacaacttcagaaaccagttcctgcccaacgccctgagagagttcttcagacacatccacgcccccgaggagagaggcgagtacctggagaccctgatcaccaagttcagccacagattctgcgcctgcaaccccgacctgatgagagagctgggcctgagccccgacgccgtgtacgtgctgtgctacagcctgatcctgctgagcatcgacctgaccagcccccacgtgaagaacaagatgagcaagagagagttcatcagaaacaccagaagagccgcccagaacatcagcgaggacttcgtgggccacctgtacgacaacatctacctgatcggccacgtggccgcctag

SEQ ID NO: 81469 - DNA, 555 bp, Artificial Sequence
  Description of Artificial Sequence: Synthetic coding sequence
atgggccagggcctgtggagagtggtgagaaaccagcagctgcagcaggagggctacagcgagcagggctacctgaccagagagcagagcagaagaatggccgccagcaacatcagcaacaccaaccacagaaagcaggtgcagggcggcatcgacatctaccacctgctgaaggccagaaagagcaaggagcaggagggcttcatcaacctggagatgctgccccccgagctgagcttcaccatcctgagctacctgaacgccaccgacctgtgcctggccagctgcgtgtggcaggacctggccaacgacgagctgctgtggcagggcctgtgcaagagcacctggggccactgcagcatctacaacaagaacccccccctgggcttcagcttcagaaagctgtacatgcagctggacgagggcagcctgaccttcaacgccaaccccgacgagggcgtgaactacttcatgagcaagggcatcctggacgacagccccaaggagatcgccaagttcatcttctgcaccagaaccctgaactggaagaagtag

SEQ ID NO: 81470 - DNA, 1344 bp, Artificial Sequence
  Description of Artificial Sequence: Synthetic coding sequence
atgcccgacatcatctgggtgttccccccccaggccgaggccgaggaggactgccacagcgacaccgtgagagccgacgacgacgaggagaacgagagccccgccgagaccgacctgcaggcccagctgcagatgttcagagcccagtggatgttcgagctggcccccggcgtgagcagcagcaacctggagaacagaccctgcagagccgccagaggcagcctgcagaagaccagcgccgacaccaagggcaagcaggagcaggccaaggaggagaaggccagagagctgttcctgaaggccgtggaggaggagcagaacggcgccctgtacgaggccatcaagttctacagaagagccatgcagctggtgcccgacatcgagttcaagatcacctacaccagaagccccgacggcgacggcgtgggcaacagctacatcgaggacaacgacgacgacagcaagatggccgacctgctgagctacttccagcagcagctgaccttccaggagagcgtgctgaagctgtgccagcccgagctggagagcagccagatccacatcagcgtgctgcccatggaggtgctgatgtacatcttcagatgggtggtgagcagcgacctggacctgagaagcctggagcagctgagcctggtgtgcagaggcttctacatctgcgccagagaccccgagatctggagactggcctgcctgaaggtgtggggcagaagctgcatcaagctggtgccctacaccagctggagagagatgttcctggagagacccagagtgagattcgacggcgtgtacatcagcaagaccacctacatcagacagggcgagcagagcctggacggcttctacagagcctggcaccaggtggagtactacagatacatcagattcttccccgacggccacgtgatgatgctgaccacccccgaggagccccagagcatcgtgcccagactgagaaccagaaacaccagaaccgacgccatcctgctgggccactacagactgagccaggacaccgacaaccagaccaaggtgttcgccgtgatcaccaagaagaaggaggagaagcccctggactacaagtacagatacttcagaagagtgcccgtgcaggaggccgaccagagcttccacgtgggcctgcagctgtgcagcagcggccaccagagattcaacaagctgatctggatccaccacagctgccacatcacctacaagagcaccggcgagaccgccgtgagcgccttcgagatcgacaagatgtacacccccctgttcttcgccagagtgagaagctacaccgccttcagcgagagacccctgtag

SEQ ID NO: 81471 - DNA, 1314 bp, Artificial Sequence
  Description of Artificial Sequence: Synthetic coding sequence
atggccgaggccgaggaggactgccacagcgacaccgtgagagccgacgacgacgaggagaacgagagccccgccgagaccgacctgcaggcccagctgcagatgttcagagcccagtggatgttcgagctggcccccggcgtgagcagcagcaacctggagaacagaccctgcagagccgccagaggcagcctgcagaagaccagcgccgacaccaagggcaagcaggagcaggccaaggaggagaaggccagagagctgttcctgaaggccgtggaggaggagcagaacggcgccctgtacgaggccatcaagttctacagaagagccatgcagctggtgcccgacatcgagttcaagatcacctacaccagaagccccgacggcgacggcgtgggcaacagctacatcgaggacaacgacgacgacagcaagatggccgacctgctgagctacttccagcagcagctgaccttccaggagagcgtgctgaagctgtgccagcccgagctggagagcagccagatccacatcagcgtgctgcccatggaggtgctgatgtacatcttcagatgggtggtgagcagcgacctggacctgagaagcctggagcagctgagcctggtgtgcagaggcttctacatctgcgccagagaccccgagatctggagactggcctgcctgaaggtgtggggcagaagctgcatcaagctggtgccctacaccagctggagagagatgttcctggagagacccagagtgagattcgacggcgtgtacatcagcaagaccacctacatcagacagggcgagcagagcctggacggcttctacagagcctggcaccaggtggagtactacagatacatcagattcttccccgacggccacgtgatgatgctgaccacccccgaggagccccagagcatcgtgcccagactgagaaccagaaacaccagaaccgacgccatcctgctgggccactacagactgagccaggacaccgacaaccagaccaaggtgttcgccgtgatcaccaagaagaaggaggagaagcccctggactacaagtacagatacttcagaagagtgcccgtgcaggaggccgaccagagcttccacgtgggcctgcagctgtgcagcagcggccaccagagattcaacaagctgatctggatccaccacagctgccacatcacctacaagagcaccggcgagaccgccgtgagcgccttcgagatcgacaagatgtacacccccctgttcttcgccagagtgagaagctacaccgccttcagcgagagacccctgtag

SEQ ID NO: 81472 - DNA, 1212 bp, Artificial Sequence
  Description of Artificial Sequence: Synthetic coding sequence
atgttcagagcccagtggatgttcgagctggcccccggcgtgagcagcagcaacctggagaacagaccctgcagagccgccagaggcagcctgcagaagaccagcgccgacaccaagggcaagcaggagcaggccaaggaggagaaggccagagagctgttcctgaaggccgtggaggaggagcagaacggcgccctgtacgaggccatcaagttctacagaagagccatgcagctggtgcccgacatcgagttcaagatcacctacaccagaagccccgacggcgacggcgtgggcaacagctacatcgaggacaacgacgacgacagcaagatggccgacctgctgagctacttccagcagcagctgaccttccaggagagcgtgctgaagctgtgccagcccgagctggagagcagccagatccacatcagcgtgctgcccatggaggtgctgatgtacatcttcagatgggtggtgagcagcgacctggacctgagaagcctggagcagctgagcctggtgtgcagaggcttctacatctgcgccagagaccccgagatctggagactggcctgcctgaaggtgtggggcagaagctgcatcaagctggtgccctacaccagctggagagagatgttcctggagagacccagagtgagattcgacggcgtgtacatcagcaagaccacctacatcagacagggcgagcagagcctggacggcttctacagagcctggcaccaggtggagtactacagatacatcagattcttccccgacggccacgtgatgatgctgaccacccccgaggagccccagagcatcgtgcccagactgagaaccagaaacaccagaaccgacgccatcctgctgggccactacagactgagccaggacaccgacaaccagaccaaggtgttcgccgtgatcaccaagaagaaggaggagaagcccctggactacaagtacagatacttcagaagagtgcccgtgcaggaggccgaccagagcttccacgtgggcctgcagctgtgcagcagcggccaccagagattcaacaagctgatctggatccaccacagctgccacatcacctacaagagcaccggcgagaccgccgtgagcgccttcgagatcgacaagatgtacacccccctgttcttcgccagagtgagaagctacaccgccttcagcgagagacccctgtag

SEQ ID NO: 81473 - DNA, 147 bp, Artificial Sequence
  Description of Artificial Sequence: Synthetic coding sequence
atgttcagagcccagtggatgttcgagctggcccccggcgtgagcagcagcaacctggagaacagaccctgcagagccgccagaggcagcctgcagaagaccagcgccgacaccaagggcaagcaggagcaggccaaggaggagtag

SEQ ID NO: 81474 - DNA, 357 bp, Artificial Sequence
  Description of Artificial Sequence: Synthetic coding sequence
atgttcagagcccagtggatgttcgagctggcccccggcgtgagcagcagcaacctggagaacagaccctgcagagccgccagaggcagcctgcagaagaccagcgccgacaccaagggcaagcaggagcaggccaaggaggagaaggccagagagctgttcctgaaggccgtggaggaggagcagaacggcgccctgtacgaggccatcaagttctacagaagagccatgcagctggtgcccgacatcgagttcaagatcacctacaccagaagccccgacggcgacggcgtgggcaacagctacatcgaggacaacgacgacgacagcaagatggccgacctgctgagctactag

SEQ ID NO: 81475 - DNA, 438 bp, Artificial Sequence
  Description of Artificial Sequence: Synthetic coding sequence
atgttcagagcccagtggatgttcgagctggcccccggcgtgagcagcagcaacctggagaacagaccctgcagagccgccagaggcagcctgcagaagaccagcgccgacaccaagggcaagcaggagcaggccaaggaggagaaggccagagagctgttcctgaaggccgtggaggaggagcagaacggcgccctgtacgaggccatcaagttctacagaagagccatgcagctggtgcccgacatcgagttcaagatcacctacaccagaagccccgacggcgacggcgtgggcaacagctacatcgaggacaacgacgacgacagcaagatggccgacctgctgagctacttccagcagcagctgaccttccaggagagcgtgctgaagctgtgccagcccgagctggagagcagccagatccacatcagctag

SEQ ID NO: 81476 - DNA, 3132 bp, Artificial Sequence
  Description of Artificial Sequence: Synthetic coding sequence
atgagaagattcaagagaaagcacctgaccgccatcgactgccagcacctggccagaagccacctggccgtgacccagcccttcggccagagatggaccaacagagaccccaaccacggcctgtaccccaagcccagaaccaagagaggcagcagaggccagggcagccagagatgcatccccgagttcttcctggccggcaagcagccctgcaccaacgacatggccaagagcaacagcgtgggccaggacagctgccaggacagcgagggcgacatgatcttccccgccgagagcagctgcgccctgccccaggagggcagcgccggccccggcagccccggcagcgccccccccagcagaaagagaagctggagcagcgaggaggagagcaaccaggccaccggcaccagcagatgggacggcgtgagcaagaaggcccccagacaccacctgagcgtgccctgcaccagacccagagaggccagacaggaggccgaggacagcaccagcagactgagcgccgagagcggcgagaccgaccaggacgccggcgacgtgggccccgaccccatccccgacagctactacggcctgctgggcaccctgccctgccaggaggccctgagccacatctgcagcctgcccagcgaggtgctgagacacgtgttcgccttcctgcccgtggaggacctgtactggaacctgagcctggtgtgccacctgtggagagagatcatcagcgaccccctgttcatcccctggaagaagctgtaccacagatacctgatgaacgaggagcaggccgtgagcaaggtggacggcatcctgagcaactgcggcatcgagaaggagagcgacctgtgcgtgctgaacctgatcagatacaccgccaccaccaagtgcagccccagcgtggaccccgagagagtgctgtggagcctgagagaccaccccctgctgcccgaggccgaggcctgcgtgagacagcacctgcccgacctgtacgccgccgccggcggcgtgaacatctgggccctggtggccgccgtggtgctgctgagcagcagcgtgaacgacatccagagactgctgttctgcctgagaagacccagcagcaccgtgaccatgcccgacgtgaccgagaccctgtactgcatcgccgtgctgctgtacgccatgagagagaagggcatcaacatcagcaacagaatccactacaacatcttctactgcctgtacctgcaggagaacagctgcacccaggccaccaaggtgaaggaggagcccagcgtgtggcccggcaagaagaccatccagctgacccacgagcagcagctgatcctgaaccacaagatggagcccctgcaggtggtgaagatcatggccttcgccggcaccggcaagaccagcaccctggtgaagtacgccgagaagtggagccagagcagattcctgtacgtgaccttcaacaagagcatcgccaagcaggccgagagagtgttccccagcaacgtgatctgcaagaccttccacagcatggcctacggccacatcggcagaaagtaccagagcaagaagaagctgaacctgttcaagctgacccccttcatggtgaacagcgtgctggccgagggcaagggcggcttcatcagagccaagctggtgtgcaagaccctggagaacttcttcgccagcgccgacgaggagctgaccatcgaccacgtgcccatctggtgcaagaacagccagggccagagagtgatggtggagcagagcgagaagctgaacggcgtgctggaggccagcagactgtgggacaacatgagaaagctgggcgagtgcaccgaggaggcccaccagatgacccacgacggctacctgaagctgtggcagctgagcaagcccagcctggccagcttcgacgccatcttcgtggacgaggcccaggactgcacccccgccatcatgaacatcgtgctgagccagccctgcggcaagatcttcgtgggcgacccccaccagcagatctacaccttcagaggcgccgtgaacgccctgttcaccgtgccccacacccacgtgttctacctgacccagagcttcagattcggcgtggagatcgcctacgtgggcgccaccatcctggacgtgtgcaagagagtgagaaagaagaccctggtgggcggcaaccaccagagcggcatcagaggcgacgccaagggccaggtggccctgctgagcagaaccaacgccaacgtgttcgacgaggccgtgagagtgaccgagggcgagttccccagcagaatccacctgatcggcggcatcaagagcttcggcctggacagaatcatcgacatctggatcctgctgcagcccgaggaggagagaagaaagcagaacctggtgatcaaggacaagttcatcagaagatgggtgcacaaggagggcttcagcggcttcaagagatacgtgaccgccgccgaggacaaggagctggaggccaagatcgccgtggtggagaagtacaacatcagaatccccgagctggtgcagagaatcgagaagtgccacatcgaggacctggacttcgccgagtacatcctgggcaccgtgcacaaggccaagggcctggagttcgacaccgtgcacgtgctggacgacttcgtgaaggtgccctgcgccagacacaacctgccccagctgccccacttcagagtggagagcttcagcgaggacgagtggaacctgctgtacgtggccgtgaccagagccaagaagagactgatcatgaccaagagcctggagaacatcctgaccctggccggcgagtacttcctgcaggccgagctgaccagcaacgtgctgaagaccggcgtggtgagatgctgcgtgggccagtgcaacaacgccatccccgtggacaccgtgctgaccatgaagaagctgcccatcacctacagcaacagaaaggagaacaagggcggctacctgtgccacagctgcgccgagcagagaatcggccccctggccttcctgaccgccagccccgagcaggtgagagccatggagagaaccgtggagaacatcgtgctgcccagacacgaggccctgctgttcctggtgttctag

SEQ ID NO: 81477 - DNA, 1215 bp, Artificial Sequence
  Description of Artificial Sequence: Synthetic coding sequence
atgaacgaggagcaggccgtgagcaaggtggacggcatcctgagcaactgcggcatcgagaaggagagcgacctgtgcgtgctgaacctgatcagatacaccgccaccaccaagtgcagccccagcgtggaccccgagagagtgctgtggagcctgagagaccaccccctgctgcccgaggccgaggcctgcgtgagacagcacctgcccgacctgtacgccgccgccggcggcgtgaacatctgggccctggtggccgccgtggtgctgctgagcagcagcgtgaacgacatccagagactgctgttctgcctgagaagacccagcagcaccgtgaccatgcccgacgtgaccgagaccctgtactgcatcgccgtgctgctgtacgccatgagagagaagggcatcaacatcagcaacagaatccactacaacatcttctactgcctgtacctgcaggagaacagctgcacccaggccaccaaggtgaaggaggagcccagcgtgtggcccggcaagaagaccatccagctgacccacgagcagcagctgatcctgaaccacaagatggagcccctgcaggtggtgaagatcatggccttcgccggcaccggcaagaccagcaccctggtgaagtacgccgagaagtggagccagagcagattcctgtacgtgaccttcaacaagagcatcgccaagcaggccgagagagtgttccccagcaacgtgatctgcaagaccttccacagcatggcctacggccacatcggcagaaagtaccagagcaagaagaagctgaacctgttcaagctgacccccttcatggtgaacagcgtgctggccgagggcaagggcggcttcatcagagccaagctggtgtgcaagaccctggagaacttcttcgccagcgccgacgaggagctgaccatcgaccacgtgcccatctggtgcaagaacagccagggccagagagtgatggtggagcagagcgagaagctgaacggcgtgctggaggccagcagactgtgggacaacatgagaaagctgggcgagtgcaccgaggaggcccaccagatgacccacgacggctacctgaagctgtggcagctgagcaagcccagcctggccagcttcgacgccatcttcgtggacgaggcccaggccggcgccagacacggcgcccactgcggcgagcacagaaccgcccccgcctag

SEQ ID NO: 81478 - DNA, 3285 bp, Artificial Sequence
  Description of Artificial Sequence: Synthetic coding sequence
atgagctacgaggtgaccagcggctgccactggacctgccaggtgcccgagagctgcgacaacggcctgcactgcgccggccccctgggccacctgcacagaagatgccagagaaccagcgcccacctgctggtgttcaccgagcacgccgagatgagaagattcaagagaaagcacctgaccgccatcgactgccagcacctggccagaagccacctggccgtgacccagcccttcggccagagatggaccaacagagaccccaaccacggcctgtaccccaagcccagaaccaagagaggcagcagaggccagggcagccagagatgcatccccgagttcttcctggccggcaagcagccctgcaccaacgacatggccaagagcaacagcgtgggccaggacagctgccaggacagcgagggcgacatgatcttccccgccgagagcagctgcgccctgccccaggagggcagcgccggccccggcagccccggcagcgccccccccagcagaaagagaagctggagcagcgaggaggagagcaaccaggccaccggcaccagcagatgggacggcgtgagcaagaaggcccccagacaccacctgagcgtgccctgcaccagacccagagaggccagacaggaggccgaggacagcaccagcagactgagcgccgagagcggcgagaccgaccaggacgccggcgacgtgggccccgaccccatccccgacagctactacggcctgctgggcaccctgccctgccaggaggccctgagccacatctgcagcctgcccagcgaggtgctgagacacgtgttcgccttcctgcccgtggaggacctgtactggaacctgagcctggtgtgccacctgtggagagagatcatcagcgaccccctgttcatcccctggaagaagctgtaccacagatacctgatgaacgaggagcaggccgtgagcaaggtggacggcatcctgagcaactgcggcatcgagaaggagagcgacctgtgcgtgctgaacctgatcagatacaccgccaccaccaagtgcagccccagcgtggaccccgagagagtgctgtggagcctgagagaccaccccctgctgcccgaggccgaggcctgcgtgagacagcacctgcccgacctgtacgccgccgccggcggcgtgaacatctgggccctggtggccgccgtggtgctgctgagcagcagcgtgaacgacatccagagactgctgttctgcctgagaagacccagcagcaccgtgaccatgcccgacgtgaccgagaccctgtactgcatcgccgtgctgctgtacgccatgagagagaagggcatcaacatcagcaacagaatccactacaacatcttctactgcctgtacctgcaggagaacagctgcacccaggccaccaaggtgaaggaggagcccagcgtgtggcccggcaagaagaccatccagctgacccacgagcagcagctgatcctgaaccacaagatggagcccctgcaggtggtgaagatcatggccttcgccggcaccggcaagaccagcaccctggtgaagtacgccgagaagtggagccagagcagattcctgtacgtgaccttcaacaagagcatcgccaagcaggccgagagagtgttccccagcaacgtgatctgcaagaccttccacagcatggcctacggccacatcggcagaaagtaccagagcaagaagaagctgaacctgttcaagctgacccccttcatggtgaacagcgtgctggccgagggcaagggcggcttcatcagagccaagctggtgtgcaagaccctggagaacttcttcgccagcgccgacgaggagctgaccatcgaccacgtgcccatctggtgcaagaacagccagggccagagagtgatggtggagcagagcgagaagctgaacggcgtgctggaggccagcagactgtgggacaacatgagaaagctgggcgagtgcaccgaggaggcccaccagatgacccacgacggctacctgaagctgtggcagctgagcaagcccagcctggccagcttcgacgccatcttcgtggacgaggcccaggactgcacccccgccatcatgaacatcgtgctgagccagccctgcggcaagatcttcgtgggcgacccccaccagcagatctacaccttcagaggcgccgtgaacgccctgttcaccgtgccccacacccacgtgttctacctgacccagagcttcagattcggcgtggagatcgcctacgtgggcgccaccatcctggacgtgtgcaagagagtgagaaagaagaccctggtgggcggcaaccaccagagcggcatcagaggcgacgccaagggccaggtggccctgctgagcagaaccaacgccaacgtgttcgacgaggccgtgagagtgaccgagggcgagttccccagcagaatccacctgatcggcggcatcaagagcttcggcctggacagaatcatcgacatctggatcctgctgcagcccgaggaggagagaagaaagcagaacctggtgatcaaggacaagttcatcagaagatgggtgcacaaggagggcttcagcggcttcaagagatacgtgaccgccgccgaggacaaggagctggaggccaagatcgccgtggtggagaagtacaacatcagaatccccgagctggtgcagagaatcgagaagtgccacatcgaggacctggacttcgccgagtacatcctgggcaccgtgcacaaggccaagggcctggagttcgacaccgtgcacgtgctggacgacttcgtgaaggtgccctgcgccagacacaacctgccccagctgccccacttcagagtggagagcttcagcgaggacgagtggaacctgctgtacgtggccgtgaccagagccaagaagagactgatcatgaccaagagcctggagaacatcctgaccctggccggcgagtacttcctgcaggccgagctgaccagcaacgtgctgaagaccggcgtggtgagatgctgcgtgggccagtgcaacaacgccatccccgtggacaccgtgctgaccatgaagaagctgcccatcacctacagcaacagaaaggagaacaagggcggctacctgtgccacagctgcgccgagcagagaatcggccccctggccttcctgaccgccagccccgagcaggtgagagccatggagagaaccgtggagaacatcgtgctgcccagacacgaggccctgctgttcctggtgttctag

SEQ ID NO: 81479 - DNA, 1644 bp, Artificial Sequence
  Description of Artificial Sequence: Synthetic coding sequence
atggcctacggccacatcggcagaaagtaccagagcaagaagaagctgaacctgttcaagctgacccccttcatggtgaacagcgtgctggccgagggcaagggcggcttcatcagagccaagctggtgtgcaagaccctggagaacttcttcgccagcgccgacgaggagctgaccatcgaccacgtgcccatctggtgcaagaacagccagggccagagagtgatggtggagcagagcgagaagctgaacggcgtgctggaggccagcagactgtgggacaacatgagaaagctgggcgagtgcaccgaggaggcccaccagatgacccacgacggctacctgaagctgtggcagctgagcaagcccagcctggccagcttcgacgccatcttcgtggacgaggcccaggactgcacccccgccatcatgaacatcgtgctgagccagccctgcggcaagatcttcgtgggcgacccccaccagcagatctacaccttcagaggcgccgtgaacgccctgttcaccgtgccccacacccacgtgttctacctgacccagagcttcagattcggcgtggagatcgcctacgtgggcgccaccatcctggacgtgtgcaagagagtgagaaagaagaccctggtgggcggcaaccaccagagcggcatcagaggcgacgccaagggccaggtggccctgctgagcagaaccaacgccaacgtgttcgacgaggccgtgagagtgaccgagggcgagttccccagcagaatccacctgatcggcggcatcaagagcttcggcctggacagaatcatcgacatctggatcctgctgcagcccgaggaggagagaagaaagcagaacctggtgatcaaggacaagttcatcagaagatgggtgcacaaggagggcttcagcggcttcaagagatacgtgaccgccgccgaggacaaggagctggaggccaagatcgccgtggtggagaagtacaacatcagaatccccgagctggtgcagagaatcgagaagtgccacatcgaggacctggacttcgccgagatggagagccaccacgtgggccaggccggcctggagctgcccaccagcgagtacatcctgggcaccgtgcacaaggccaagggcctggagttcgacaccgtgcacgtgctggacgacttcgtgaaggtgccctgcgccagacacaacctgccccagctgccccacttcagagtggagagcttcagcgaggacgagtggaacctgctgtacgtggccgtgaccagagccaagaagagactgatcatgaccaagagcctggagaacatcctgaccctggccggcgagtacttcctgcaggccgagctgaccagcaacgtgctgaagaccggcgtggtgagatgctgcgtgggccagtgcaacaacgccatccccgtggacaccgtgctgaccatgaagaagctgcccatcacctacagcaacagaaaggagaacaagggcggctacctgtgccacagctgcgccgagcagagaatcggccccctggccttcctgaccgccagccccgagcaggtgagagccatggagagaaccgtggagaacatcgtgctgcccagacacgaggccctgctgttcctggtgttctag

SEQ ID NO: 81480 - DNA, 1215 bp, Artificial Sequence; identical to SEQ ID NO: 81477
  Description of Artificial Sequence: Synthetic coding sequence

SEQ ID NO: 81481 - DNA, 576 bp, Artificial Sequence
  Description of Artificial Sequence: Synthetic coding sequence
atggaccccaagcagaccaccctgctgtgcctggtgctgtgcctgggccagagaatccaggcccaggagggcgacttccccatgcccttcatcagcgccaagagcagccccgtgatccccctggacggcagcgtgaagatccagtgccaggccatcagagaggcctacctgacccagctgatgatcatcaagaacagcacctacagagagatcggcagaagactgaagttctggaacgagaccgaccccgagttcgtgatcgaccacatggacgccaacaaggccggcagataccagtgccagtacagaatcggccactacagattcagatacagcgacaccctggagctggtggtgaccgacagcatccaccaggactacaccacccagaacctgatcagaatggccgtggccggcctggtgctggtggccctgctggccatcctggtggagaactggcacagccacaccgccctgaacaaggaggccagcgccgacgtggccgagcccagctggagccagcagatgtgccagcccggcctgaccttcgccagaacccccagcgtgtgcaagtag

SEQ ID NO: 81482 - DNA, 537 bp, Artificial Sequence
  Description of Artificial Sequence: Synthetic coding sequence
atggaccccaagcagaccaccctgctgtgcctgggcctgtacggcaagcccttcctgagcgccgacagaggcctggtgctgatgcccggcgagaacatcagcctgacctgcagcagcgcccacatccccttcgacagattcagcctggccaaggagggcgagctgagcctgccccagcaccagagcggcgagcaccccgccaacttcagcctgggccccgtggacctgaacgtgagcggcatctacagatgctacggctggtacaacagaagcccctacctgtggagcttccccagcaacgccctggagctggtggtgaccgacagcatccaccaggactacaccacccagaacctgatcagaatggccgtggccggcctggtgctggtggccctgctggccatcctggtggagaactggcacagccacaccgccctgaacaaggaggccagcgccgacgtggccgagcccagctggagccagcagatgtgccagcccggcctgaccttcgccagaacccccagcgtgtgcaagtag

SEQ ID NO: 81483 - DNA, 864 bp, Artificial Sequence
  Description of Artificial Sequence: Synthetic coding sequence
atggaccccaagcagaccaccctgctgtgcctggtgctgtgcctgggccagagaatccaggcccaggagggcgacttccccatgcccttcatcagcgccaagagcagccccgtgatccccctggacggcagcgtgaagatccagtgccaggccatcagagaggcctacctgacccagctgatgatcatcaagaacagcacctacagagagatcggcagaagactgaagttctggaacgagaccgaccccgagttcgtgatcgaccacatggacgccaacaaggccggcagataccagtgccagtacagaatcggccactacagattcagatacagcgacaccctggagctggtggtgaccggcctgtacggcaagcccttcctgagcgccgacagaggcctggtgctgatgcccggcgagaacatcagcctgacctgcagcagcgcccacatccccttcgacagattcagcctggccaaggagggcgagctgagcctgccccagcaccagagcggcgagcaccccgccaacttcagcctgggccccgtggacctgaacgtgagcggcatctacagatgctacggctggtacaacagaagcccctacctgtggagcttccccagcaacgccctggagctggtggtgaccgacagcatccaccaggactacaccacccagaacctgatcagaatggccgtggccggcctggtgctggtggccctgctggccatcctggtggagaactggcacagccacaccgccctgaacaaggaggccagcgccgacgtggccgagcccagctggagccagcagatgtgccagcccggcctgaccttcgccagaacccccagcgtgtgcaagtag

SEQ ID NO: 81484 - DNA, 828 bp, Artificial Sequence
  Description of Artificial Sequence: Synthetic coding sequence
atggaccccaagcagaccaccctgctgtgcctgggcgacttccccatgcccttcatcagcgccaagagcagccccgtgatccccctggacggcagcgtgaagatccagtgccaggccatcagagaggcctacctgacccagctgatgatcatcaagaacagcacctacagagagatcggcagaagactgaagttctggaacgagaccgaccccgagttcgtgatcgaccacatggacgccaacaaggccggcagataccagtgccagtacagaatcggccactacagattcagatacagcgacaccctggagctggtggtgaccggcctgtacggcaagcccttcctgagcgccgacagaggcctggtgctgatgcccggcgagaacatcagcctgacctgcagcagcgcccacatccccttcgacagattcagcctggccaaggagggcgagctgagcctgccccagcaccagagcggcgagcaccccgccaacttcagcctgggccccgtggacctgaacgtgagcggcatctacagatgctacggctggtacaacagaagcccctacctgtggagcttccccagcaacgccctggagctggtggtgaccgacagcatccaccaggactacaccacccagaacctgatcagaatggccgtggccggcctggtgctggtggccctgctggccatcctggtggagaactggcacagccacaccgccctgaacaaggaggccagcgccgacgtggccgagcccagctggagccagcagatgtgccagcccggcctgaccttcgccagaacccccagcgtgtgcaagtag

SEQ ID NO: 81485 - DNA, 630 bp, Artificial Sequence
  Description of Artificial Sequence: Synthetic coding sequence
atggaccccaagcagaccaccctgctgtgcctgggcgacttccccatgcccttcatcagcgccaagagcagccccgtgatccccctggacggcagcgtgaagatccagtgccaggccatcagagaggcctacctgacccagctgatgatcatcaagaacagcacctacagagagatcggcagaagactgaagttctggaacgagaccgaccccgagttcgtgatcgaccacatggacgccaacaaggccggcagataccagtgccagtacagaatcggccactacagattcagatacagcgacaccctggagctggtggtgaccggcctgtacggcaagcccttcctgagcgccgacagaggcctggtgctgatgcccggcgagaacatcagcctgacctgcagcagcgcccacatccccttcgacagattcagcctggccaaggagggcgagctgagcctgccccagcaccagagcggcgagcaccccgccaacttcagcctgggccccgtggacctgaacgtgagcggcatctacagactgcacccccccagactgcacgacgccgagctggacccccacggcagaggcagaaccggccccagaggcagcctgggccacaccggctag

SEQ ID NO: 81486 - DNA, 762 bp, Artificial Sequence
  Description of Artificial Sequence: Synthetic coding sequence
atggaccccaagcagaccaccctgctgtgcctgggcgacttccccatgcccttcatcagcgccaagagcagccccgtgatccccctggacggcagcgtgaagatccagtgccaggccatcagagaggcctacctgacccagctgatgatcatcaagaacagcacctacagagagatcggcagaagactgaagttctggaacgagaccgaccccgagttcgtgatcgaccacatggacgccaacaaggccggcagataccagtgccagtacagaatcggccactacagattcagatacagcgacaccctggagctggtggtgaccggcctgtacggcaagcccttcctgagcgccgacagaggcctggtgctgatgcccggcgagaacatcagcctgacctgcagcagcgcccacatccccttcgacagattcagcctggccaaggagggcgagctgagcctgccccagcaccagagcggcgagcaccccgccaacttcagcctgggccccgtggacctgaacgtgagcggcatctacagatgctacgacagcatccaccaggactacaccacccagaacctgatcagaatggccgtggccggcctggtgctggtggccctgctggccatcctggtggagaactggcacagccacaccgccctgaacaaggaggccagcgccgacgtggccgagcccagctggagccagcagatgtgccagcccggcctgaccttcgccagaacccccagcgtgtgcaagtag

SEQ ID NO: 81487 - DNA, 798 bp, Artificial Sequence
  Description of Artificial Sequence: Synthetic coding sequence
atggaccccaagcagaccaccctgctgtgcctggtgctgtgcctgggccagagaatccaggcccaggagggcgacttccccatgcccttcatcagcgccaagagcagccccgtgatccccctggacggcagcgtgaagatccagtgccaggccatcagagaggcctacctgacccagctgatgatcatcaagaacagcacctacagagagatcggcagaagactgaagttctggaacgagaccgaccccgagttcgtgatcgaccacatggacgccaacaaggccggcagataccagtgccagtacagaatcggccactacagattcagatacagcgacaccctggagctggtggtgaccggcctgtacggcaagcccttcctgagcgccgacagaggcctggtgctgatgcccggcgagaacatcagcctgacctgcagcagcgcccacatccccttcgacagattcagcctggccaaggagggcgagctgagcctgccccagcaccagagcggcgagcaccccgccaacttcagcctgggccccgtggacctgaacgtgagcggcatctacagatgctacgacagcatccaccaggactacaccacccagaacctgatcagaatggccgtggccggcctggtgctggtggccctgctggccatcctggtggagaactggcacagccacaccgccctgaacaaggaggccagcgccgacgtggccgagcccagctggagccagcagatgtgccagcccggcctgaccttcgccagaacccccagcgtgtgcaagtag

SEQ ID NO: 81488 - DNA, 540 bp, Artificial Sequence
  Description of Artificial Sequence: Synthetic coding sequence
atggaccccaagcagaccaccctgctgtgcctgggcgacttccccatgcccttcatcagcgccaagagcagccccgtgatccccctggacggcagcgtgaagatccagtgccaggccatcagagaggcctacctgacccagctgatgatcatcaagaacagcacctacagagagatcggcagaagactgaagttctggaacgagaccgaccccgagttcgtgatcgaccacatggacgccaacaaggccggcagataccagtgccagtacagaatcggccactacagattcagatacagcgacaccctggagctggtggtgaccgacagcatccaccaggactacaccacccagaacctgatcagaatggccgtggccggcctggtgctggtggccctgctggccatcctggtggagaactggcacagccacaccgccctgaacaaggaggccagcgccgacgtggccgagcccagctggagccagcagatgtgccagcccggcctgaccttcgccagaacccccagcgtgtgcaagtag

SEQ ID NO: 81489 - DNA, 720 bp, Artificial Sequence
  Description of Artificial Sequence: Synthetic coding sequence
atggaccccaagcagaccaccctgctgtgcctggtgctgtgcctgggccagagaatccaggcccaggagggcgacttccccatgcccttcatcagcgccaagagcagccccgtgatccccctggacggcagcgtgaagatccagtgccaggccatcagagaggcctacctgacccagctgatgatcatcaagaacagcacctacagagagatcggcagaagactgaagttctggaacgagaccgaccccgagttcgtgatcgaccacatggacgccaacaaggccggcagataccagtgccagtacagaatcggccactacagattcagatacagcgacaccctggagctggtggtgaccggcctgtacggcaagcccttcctgagcgccgacagaggcctggtgctgatgcccggcgagaacatcagcctgacctgcagcagcgcccacatccccttcgacagattcagcctggccaaggagggcgagctgagcctgccccagcaccagagcggcgagcaccccgccaacttcagcctgggccccgtggacctgaacgtgagcggcatctacagatgctacggctggtacaacagaagcccctacctgtggagcttccccagcaacgccctggagctggtggtgaccggcagatacagacccgtgcagccctgcgtgtgggtgggctgccccggcccctgccacagagccggcatctag

SEQ ID NO: 81490 - DNA, 774 bp, Artificial Sequence
  Description of Artificial Sequence: Synthetic coding sequence
atggcccccgccatggagagccccaccctgctgtgcgtggccctgctgttcttcgcccccgacggcgtgctggccgtgccccagaagcccaaggtgagcctgaaccccccctggaacagaatcttcaagggcgagaacgtgaccctgacctgcaacggcaacaacttcttcgaggtgagcagcaccaagtggttccacaacggcagcctgagcgaggagaccaacagcagcctgaacatcgtgaacgccaagttcgaggacagcggcgagtacaagtgccagcaccagcaggtgaacgagagcgagcccgtgtacctggaggtgttcagcgactggctgctgctgcaggccagcgccgaggtggtgatggagggccagcccctgttcctgagatgccacggctggagaaactgggacgtgtacaaggtgatctactacaaggacggcgaggccctgaagtactggtacgagaaccacaacatcagcatcaccaacgccaccgtggaggacagcggcacctactactgcaccggcaaggtgtggcagctggactacgagagcgagcccctgaacatcaccgtgatcaaggcccccagagagaagtactggctgcagttcttcatccccctgctggtggtgatcctgttcgccgtggacaccggcctgttcatcagcacccagcagcaggtgaccttcctgctgaagatcaagagaaccagaaagggcttcagactgctgaacccccaccccaagcccaaccccaagaacaactag

SEQ ID NO: 81491 - DNA, 261 bp, Artificial Sequence
  Description of Artificial Sequence: Synthetic coding sequence
atgatccccgccgtggtgctgctgctgctgctgctggtggagcaggccgccgccctgggcgagccccagctgtgctacatcctggacgccatcctgttcctgtacggcatcgtgctgaccctgctgtactgcagactgaagatccaggtgagaaaggccgccatcaccagctacgagaagagcgacggcgtgtacaccggcctgagcaccagaaaccaggagacctacgagaccctgaagcacgagaagcccccccagtag

SEQ ID NO: 81492 - DNA, 339 bp, Artificial Sequence
  Description of Artificial Sequence: Synthetic coding sequence
atgatccccgccgtggtgctgctgctgctgctgctggtggagcaggccgccgccctgggcgagccccagctgtgctacatcctggacgccatcctgttcctgtacggcatcgtgctgaccctgctgtactgcagactgaagatccaggtgagaaaggccgccatcaccagctacgagaagagcgacggcgtgtacaccatggagagccccagcatcaccagactggagtgcagcggcatgatctgggcccactgcaacctgtgcctgctgggcagcagagacagcagagccagccccagcagagtggccaagaccaccggcaccaccatgcccagctag

SEQ ID NO: 81493 - DNA, 792 bp, Artificial Sequence
  Description of Artificial Sequence: Synthetic coding sequence
tgatgcagcttcggcgtgcagctgatgggcaagtgggtgccctgggtgagcgtgttccaggaggagaccgtgaccctgcactgcgaggtgctgcacctgcccggcagcagcagcacccagtggttcctgaacggcaccgccacccagaccagcacccccagctacagaatcaccagcgccagcgtgaacgacagcggcgagtacagatgccagagaggcctgagcggcagaagcgaccccatccagctggagatccacagaggctggctgctgctgcaggtgagcagcagagtgttcatggagggcgagcccctggccctgagatgccacgcctggaaggacaagctggtgtacaacgtgctgtactacagaaacggcaaggccttcaagttcttccactggaacagcaacctgaccatcctgaagaccaacatcagccacaacggcacctaccactgcagcggcatgggcaagcacagatacaccagcgccggcatcagccagtacaccgtgaagggcctgcagctgcccacccccgtgtggttccacgtgctgttctacctggccgtgggcatcatgttcctggtgaacaccgtgctgtgggtgaccatcagaaaggagctgaagagaaagaagaagtggaacctggagatcagcctggacagcggccacgagaagaaggtgatcagcagcctgcaggaggacagacacctggaggaggagctgaagtgccaggagcagaaggaggagcagctgcaggagggcgtgcacagaaaggagccccagggctag

SEQ ID NO: 81494 - DNA, 567 bp, Artificial Sequence
  Description of Artificial Sequence: Synthetic coding sequence
atgtggttcctgaccaccctgctgctgtggggctggctgctgctgcaggtgagcagcagagtgttcatggagggcgagcccctggccctgagatgccacgcctggaaggacaagctggtgtacaacgtgctgtactacagaaacggcaaggccttcaagttcttccactggaacagcaacctgaccatcctgaagaccaacatcagccacaacggcacctaccactgcagcggcatgggcaagcacagatacaccagcgccggcatcagccagtacaccgtgaagggcctgcagctgcccacccccgtgtggttccacgtgctgttctacctggccgtgggcatcatgttcctggtgaacaccgtgctgtgggtgaccatcagaaaggagctgaagagaaagaagaagtggaacctggagatcagcctggacagcggccacgagaagaaggtgatcagcagcctgcaggaggacagacacctggaggaggagctgaagtgccaggagcagaaggaggagcagctgcaggagggcgtgcacagaaaggagccccagggcgccacctag

SEQ ID NO: 81495 - DNA, 843 bp, Artificial Sequence
  Description of Artificial Sequence: Synthetic coding sequence
atgtggttcctgaccaccctgctgctgtgggtgcccgtggacggccaggtggacaccaccaaggccgtgatcaccctgcagcccccctgggtgagcgtgttccaggaggagaccgtgaccctgcactgcgaggtgctgcacctgcccggcagcagcagcacccagtggttcctgaacggcaccgccacccagaccagcacccccagctacagaatcaccagcgccagcgtgaacgacagcggcgagtacagatgccagagaggcctgagcggcagaagcgaccccatccagctggagatccacagaggctggctgctgctgcaggtgagcagcagagtgttcatggagggcgagcccctggccctgagatgccacgcctggaaggacaagctggtgtacaacgtgctgtactacagaaacggcaaggccttcaagttcttccactggaacagcaacctgaccatcctgaagaccaacatcagccacaacggcacctaccactgcagcggcatgggcaagcacagatacaccagcgccggcatcagccagtacaccgtgaagggcctgcagctgcccacccccgtgtggttccacgtgctgttctacctggccgtgggcatcatgttcctggtgaacaccgtgctgtgggtgaccatcagaaaggagctgaagagaaagaagaagtggaacctggagatcagcctggacagcggccacgagaagaaggtgatcagcagcctgcaggaggacagacacctggaggaggagctgaagtgccaggagcagaaggaggagcagctgcaggagggcgtgcacagaaaggagccccagggcgccacctag

SEQ ID NO: 81496 - DNA, 954 bp, Artificial Sequence
  Description of Artificial Sequence: Synthetic coding sequence
atgaccatggagacccagatgagccagaacgtgtgccccagaaacctgtggctgctgcagcccctgaccgtgctgctgctgctggccagcgccgacagccaggccgccgccccccccaaggccgtgctgaagctggagcccccctggatcaacgtgctgcaggaggacagcgtgaccctgacctgccagggcgccagaagccccgagagcgacagcatccagtggttccacaacggcaacctgatccccacccacacccagcccagctacagattcaaggccaacaacaacgacagcggcgagtacacctgccagaccggccagaccagcctgagcgaccccgtgcacctgaccgtgctgagcgagtggctggtgctgcagaccccccacctggagttccaggagggcgagaccatcatgctgagatgccacagctggaaggacaagcccctggtgaaggtgaccttcttccagaacggcaagagccagaagttcagccacctggaccccaccttcagcatcccccaggccaaccacagccacagcggcgactaccactgcaccggcaacatcggctacaccctgttcagcagcaagcccgtgaccatcaccgtgcaggtgcccagcatgggcagcagcagccccatgggcatcatcgtggccgtggtgatcgccaccgccgtggccgccatcgtggccgccgtggtggccctgatctactgcagaaagaagagaatcagcgccaacagcaccgaccccgtgaaggccgcccagttcgagccccccggcagacagatgatcgccatcagaaagagacagctggaggagaccaacaacgactacgagaccgccgacggcggctacatgaccctgaaccccagagcccccaccgacgacgacaagaacatctacctgaccctgccccccaacgaccacgtgaacagcaacaactag

SEQ ID NO: 81497 - DNA, 951 bp, Artificial Sequence
  Description of Artificial Sequence: Synthetic coding sequence
atgaccatggagacccagatgagccagaacgtgtgccccagaaacctgtggctgctgcagcccctgaccgtgctgctgctgctggccagcgccgacagccaggccgccccccccaaggccgtgctgaagctggagcccccctggatcaacgtgctgcaggaggacagcgtgaccctgacctgccagggcgccagaagccccgagagcgacagcatccagtggttccacaacggcaacctgatccccacccacacccagcccagctacagattcaaggccaacaacaacgacagcggcgagtacacctgccagaccggccagaccagcctgagcgaccccgtgcacctgaccgtgctgagcgagtggctggtgctgcagaccccccacctggagttccaggagggcgagaccatcatgctgagatgccacagctggaaggacaagcccctggtgaaggtgaccttcttccagaacggcaagagccagaagttcagccacctggaccccaccttcagcatcccccaggccaaccacagccacagcggcgactaccactgcaccggcaacatcggctacaccctgttcagcagcaagcccgtgaccatcaccgtgcaggtgcccagcatgggcagcagcagccccatgggcatcatcgtggccgtggtgatcgccaccgccgtggccgccatcgtggccgccgtggtggccctgatctactgcagaaagaagagaatcagcgccaacagcaccgaccccgtgaaggccgcccagttcgagccccccggcagacagatgatcgccatcagaaagagacagctggaggagaccaacaacgactacgagaccgccgacggcggctacatgaccctgaaccccagagcccccaccgacgacgacaagaacatctacctgaccctgccccccaacgaccacgtgaacagcaacaactag

SEQ ID NO: 81498 - DNA, 876 bp, Artificial Sequence
  Description of Artificial Sequence: Synthetic coding sequence
atgggcatcctgagcttcctgcccgtgctggccaccgagagcgactgggccgactgcaagagcccccagccctggggccacatgctgctgtggaccgccgtgctgttcctggcccccgtggccggcacccccgccgccccccccaaggccgtgctgaagctggagccccagtggatcaacgtgctgcaggaggacagcgtgaccctgacctgcagaggcacccacagccccgagagcgacagcatccagtggttccacaacggcaacctgatccccacccacacccagcccagctacagattcaaggccaacaacaacgacagcggcgagtacacctgccagaccggccagaccagcctgagcgaccccgtgcacctgaccgtgctgagcgagtggctggtgctgcagaccccccacctggagttccaggagggcgagaccatcgtgctgagatgccacagctggaaggacaagcccctggtgaaggtgaccttcttccagaacggcaagagcaagaagttcagcagaagcgaccccaacttcagcatcccccaggccaaccacagccacagcggcgactaccactgcaccggcaacatcggctacaccctgtacagcagcaagcccgtgaccatcaccgtgcaggcccccagcagcagccccatgggcatcatcgtggccgtggtgaccggcatcgccgtggccgccatcgtggccgccgtggtggccctgatctactgcagaaagaagagaatcagcgccaaccccaccaaccccgacgaggccgacaaggtgggcgccgagaacaccatcacctacagcctgctgatgcaccccgacgccctggaggagcccgacgaccagaacagaatctag

SEQ ID NO: 81499 - DNA, 933 bp, Artificial Sequence
  Description of Artificial Sequence: Synthetic coding sequence
atgggcatcctgagcttcctgcccgtgctggccaccgagagcgactgggccgactgcaagagcccccagccctggggccacatgctgctgtggaccgccgtgctgttcctggcccccgtggccggcacccccgccgccccccccaaggccgtgctgaagctggagccccagtggatcaacgtgctgcaggaggacagcgtgaccctgacctgcagaggcacccacagccccgagagcgacagcatccagtggttccacaacggcaacctgatccccacccacacccagcccagctacagattcaaggccaacaacaacgacagcggcgagtacacctgccagaccggccagaccagcctgagcgaccccgtgcacctgaccgtgctgagcgagtggctggtgctgcagaccccccacctggagttccaggagggcgagaccatcgtgctgagatgccacagctggaaggacaagcccctggtgaaggtgaccttcttccagaacggcaagagcaagaagttcagcagaagcgaccccaacttcagcatcccccaggccaaccacagccacagcggcgactaccactgcaccggcaacatcggctacaccctgtacagcagcaagcccgtgaccatcaccgtgcaggcccccagcagcagccccatgggcatcatcgtggccgtggtgaccggcatcgccgtggccgccatcgtggccgccgtggtggccctgatctactgcagaaagaagagaatcagcgccctgcccggctaccccgagtgcagagagatgggcgagaccctgcccgagaagcccgccaaccccaccaaccccgacgaggccgacaaggtgggcgccgagaacaccatcacctacagcctgctgatgcaccccgacgccctggaggagcccgacgaccagaacagaatctag

SEQ ID NO: 81500 - DNA, 912 bp, Artificial Sequence
  Description of Artificial Sequence: Synthetic coding sequence
atgggcatcctgagcttcctgcccgtgctggccaccgagagcgactgggccgactgcaagagcccccagccctggggccacatgctgctgtggaccgccgtgctgttcctggccgccccccccaaggccgtgctgaagctggagccccagtggatcaacgtgctgcaggaggacagcgtgaccctgacctgcagaggcacccacagccccgagagcgacagcatccagtggttccacaacggcaacctgatccccacccacacccagcccagctacagattcaaggccaacaacaacgacagcggcgagtacacctgccagaccggccagaccagcctgagcgaccccgtgcacctgaccgtgctgagcgagtggctggtgctgcagaccccccacctggagttccaggagggcgagaccatcgtgctgagatgccacagctggaaggacaagcccctggtgaaggtgaccttcttccagaacggcaagagcaagaagttcagcagaagcgaccccaacttcagcatcccccaggccaaccacagccacagcggcgactaccactgcaccggcaacatcggctacaccctgtacagcagcaagcccgtgaccatcaccgtgcaggcccccagcagcagccccatgggcatcatcgtggccgtggtgaccggcatcgccgtggccgccatcgtggccgccgtggtggccctgatctactgcagaaagaagagaatcagcgccctgcccggctaccccgagtgcagagagatgggcgagaccctgcccgagaagcccgccaaccccaccaaccccgacgaggccgacaaggtgggcgccgagaacaccatcacctacagcctgctgatgcaccccgacgccctggaggagcccgacgaccagaacagaatctag

SEQ ID NO: 81501 - DNA, 912 bp, Artificial Sequence; identical to SEQ ID NO: 81500
  Description of Artificial Sequence: Synthetic coding sequence

SEQ ID NO: 81502 - DNA, 933 bp, Artificial Sequence; identical to SEQ ID NO: 81499
  Description of Artificial Sequence: Synthetic coding sequence

SEQ ID NO: 81503 - DNA, 876 bp, Artificial Sequence; identical to SEQ ID NO: 81498
  Description of Artificial Sequence: Synthetic coding sequence

SEQ ID NO: 81504 - DNA, 705 bp, Artificial Sequence
  Description of Artificial Sequence: Synthetic coding sequence
atgggcatcctgagcttcctgcccgtgctggccaccgagagcgactgggccgactgcaagagcccccagccctggggccacatgctgctgtggaccgccgtgctgttcctggcccccgtggccggcacccccgccgccccccccaaggccgtgctgaagctggagccccagtggatcaacgtgctgcaggaggacagcgtgaccctgacctgcagaggcacccacagccccgagagcgacagcatccagtggttccacaacggcaacctgatccccacccacacccagcccagctacagattcaaggccaacaacaacgacagcggcgagtacacctgccagaccggccagaccagcctgagcgaccccgtgcacctgaccgtgctgagcgagtggctggtgctgcagaccccccacctggagttccaggagggcgagaccatcgtgctgagatgccacagctggaaggacaagcccctggtgaaggtgaccttcttccagaacggcaagagcaagaagttcagcagaagcgaccccaacttcagcatcccccaggccaaccacagccacagcggcgactaccactgcaccggcaacatcggctacaccctgtacagcagcaagcccgtgaccatcaccgtgcagggccccagactgagaaccgccgccaagcagagcagcctggtgggcgccgaggtgccctag

SEQ ID NO: 81505 - DNA, 771 bp, Artificial Sequence
  Description of Artificial Sequence: Synthetic coding sequence
atgggcatcctgagcttcctgcccgtgctggccaccgagagcgactgggccgactgcaagagcccccagccctggggccacatgctgctgtggaccgccgtgctgttcctgggcgagagcggcccccccgccgccccccccaaggccgtgctgaagctggagccccagtggatcaacgtgctgcaggaggacagcgtgaccctgacctgcagaggcacccacagccccgagagcgacagcatccagtggttccacaacggcaacctgatccccacccacacccagcccagctacagattcaaggccaacaacaacgacagcggcgagtacacctgccagaccggccagaccagcctgagcgaccccgtgcacctgaccgtgctgagcgagtggctggtgctgcagaccccccacctggagttccaggagggcgagaccatcgtgctgagatgccacagctggaaggacaagcccctggtgaaggtgaccttcttccagaacggcaagagcaagaagttcagcagaagcgaccccaacttcagcatcccccaggccaaccacagccacagcggcgactaccactgcaccggcaacatcggctacaccctgtacagcagcaagcccgtgaccatcaccgtgcaggcccccagcagcagccccatgggcatcatcgtggccgtggtgaccggcatcgccgtggccgccatcgtggccgccgtggtggccctgatctactgcagaaagaagagaatcagcgtgagcacctggtag

SEQ ID NO: 81506 - DNA, 765 bp, Artificial Sequence
  Description of Artificial Sequence: Synthetic coding sequence
atgtggcagctgctgctgcccaccgccctgctgctgctggtgagcgccggcatgagaaccgaggacctgcccaaggccgtggtgttcctggagccccagtggtacagagtgctggagaaggacagcgtgaccctgaagtgccagggcgcctacagccccgaggacaacagcacccagtggttccacaacgagagcctgatcagcagccaggccagcagctacttcatcgacgccgccaccgtggacgacagcggcgagtacagatgccagaccaacctgagcaccctgagcgaccccgtgcagctggaggtgcacatcggctggctgctgctgcaggcccccagatgggtgttcaaggaggaggaccccatccacctgagatgccacagctggaagaacaccgccctgcacaaggtgacctacctgcagaacggcaagggcagaaagtacttccaccacaacagcgacttctacatccccaaggccaccctgaaggacagcggcagctacttctgcagaggcctgttcggcagcaagaacgtgagcagcgagaccgtgaacatcaccatcacccagggcctggccgtgagcaccatcagcagcttcttcccccccggctaccaggtgagcttctgcctggtgatggtgctgctgttcgccgtggacaccggcctgtacttcagcgtgaagaccaacatcagaagcagcaccagagactggaaggaccacaagttcaagtggagaaaggacccccaggacaagtag

SEQ ID NO: 81507 - DNA, 873 bp, Artificial Sequence
  Description of Artificial Sequence: Synthetic coding sequence
atgggcggcggcgccggcgagagactgttcaccagcagctgcctggtgggcctggtgcccctgggcctgagaatcagcctggtgacctgccccctgcagtgcggcatcatgtggcagctgctgctgcccaccgccctgctgctgctggtgagcgccggcatgagaaccgaggacctgcccaaggccgtggtgttcctggagccccagtggtacagagtgctggagaaggacagcgtgaccctgaagtgccagggcgcctacagccccgaggacaacagcacccagtggttccacaacgagagcctgatcagcagccaggccagcagctacttcatcgacgccgccaccgtggacgacagcggcgagtacagatgccagaccaacctgagcaccctgagcgaccccgtgcagctggaggtgcacatcggctggctgctgctgcaggcccccagatgggtgttcaaggaggaggaccccatccacctgagatgccacagctggaagaacaccgccctgcacaaggtgacctacctgcagaacggcaagggcagaaagtacttccaccacaacagcgacttctacatccccaaggccaccctgaaggacagcggcagctacttctgcagaggcctgttcggcagcaagaacgtgagcagcgagaccgtgaacatcaccatcacccagggcctggccgtgagcaccatcagcagcttcttcccccccggctaccaggtgagcttctgcctggtgatggtgctgctgttcgccgtggacaccggcctgtacttcagcgtgaagaccaacatcagaagcagcaccagagactggaaggaccacaagttcaagtggagaaaggacccccaggacaagtag

SEQ ID NO: 81508 - DNA, 816 bp, Artificial Sequence
  Description of Artificial Sequence: Synthetic coding sequence
tgacccctgggcctgagaatcagcctggtgacctgccccctgcagtgcggcatcatgtggcagctgctgctgcccaccgccctgctgctgctggtgagcgccggcatgagaaccgacctgcccaaggccgtggtgttcctggagccccagtggtacagagtgctggagaaggacagcgtgaccctgaagtgccagggcgcctacagccccgaggacaacagcacccagtggttccacaacgagagcctgatcagcagccaggccagcagctacttcatcgacgccgccaccgtggacgacagcggcgagtacagatgccagaccaacctgagcaccctgagcgaccccgtgcagctggaggtgcacatcggctggctgctgctgcaggcccccagatgggtgttcaaggaggaggaccccatccacctgagatgccacagctggaagaacaccgccctgcacaaggtgacctacctgcagaacggcaagggcagaaagtacttccaccacaacagcgacttctacatccccaaggccaccctgaaggacagcggcagctacttctgcagaggcctgttcggcagcaagaacgtgagcagcgagaccgtgaacatcaccatcacccagggcctggccgtgagcaccatcagcagcttcttcccccccggctaccaggtgagcttctgcctggtgatggtgctgctgttcgccgtggacaccggcctgtacttcagcgtgaagaccaacatcagaagcagcaccagagactggaaggaccacaagttcaagtggagaaaggacccccaggacaagtag

SEQ ID NO: 81509 - DNA, 765 bp, Artificial Sequence; identical to SEQ ID NO: 81506
  Description of Artificial Sequence: Synthetic coding sequence

SEQ ID NO: 81510 - DNA, 318 bp, Artificial Sequence
  Description of Artificial Sequence: Synthetic coding sequence
atgtggcagctgctgctgcccaccgccctgctgctgctggtgagcgccggcatgagaaccgacctgcccaaggccgtggtgttcctggagccccagtggtacagagtgctggagaaggacagcgtgaccctgaagtgccagggcgcctacagccccgaggacaacagcacccagtggttccacaacgagagcctgatcagcagccaggccagcagctacttcatcgacgccgccaccgtggacgacagcggcgagtacagatgccagaccaacctgagcaccctgagcgaccccgtgcagctggaggtgcacatctag

SEQ ID NO: 81511 - DNA, 870 bp, Artificial Sequence
  Description of Artificial Sequence: Synthetic coding sequence
atgggcggcggcgccggcgagagactgttcaccagcagctgcctggtgggcctggtgcccctgggcctgagaatcagcctggtgacctgccccctgcagtgcggcatcatgtggcagctgctgctgcccaccgccctgctgctgctggtgagcgccggcatgagaaccgacctgcccaaggccgtggtgttcctggagccccagtggtacagagtgctggagaaggacagcgtgaccctgaagtgccagggcgcctacagccccgaggacaacagcacccagtggttccacaacgagagcctgatcagcagccaggccagcagctacttcatcgacgccgccaccgtggacgacagcggcgagtacagatgccagaccaacctgagcaccctgagcgaccccgtgcagctggaggtgcacatcggctggctgctgctgcaggcccccagatgggtgttcaaggaggaggaccccatccacctgagatgccacagctggaagaacaccgccctgcacaaggtgacctacctgcagaacggcaagggcagaaagtacttccaccacaacagcgacttctacatccccaaggccaccctgaaggacagcggcagctacttctgcagaggcctgttcggcagcaagaacgtgagcagcgagaccgtgaacatcaccatcacccagggcctggccgtgagcaccatcagcagcttcttcccccccggctaccaggtgagcttctgcctggtgatggtgctgctgttcgccgtggacaccggcctgtacttcagcgtgaagaccaacatcagaagcagcaccagagactggaaggaccacaagttcaagtggagaaaggacccccaggacaagtag

SEQ ID NO: 81512 - DNA, 765 bp, Artificial Sequence; identical to SEQ ID NO: 81506
  Description of Artificial Sequence: Synthetic coding sequence

SEQ ID NO: 81513 - DNA, 702 bp, Artificial Sequence
  Description of Artificial Sequence: Synthetic coding sequence
atgtggcagctgctgctgcccaccgccctgctgctgctggtgagcgccggcatgagaaccgaggacctgcccaaggccgtggtgttcctggagccccagtggtacagcgtgctggagaaggacagcgtgaccctgaagtgccagggcgcctacagccccgaggacaacagcacccagtggttccacaacgagaacctgatcagcagccaggccagcagctacttcatcgacgccgccaccgtgaacgacagcggcgagtacagatgccagaccaacctgagcaccctgagcgaccccgtgcagctggaggtgcacatcggctggctgctgctgcaggcccccagatgggtgttcaaggaggaggaccccatccacctgagatgccacagctggaagaacaccgccctgcacaaggtgacctacctgcagaacggcaaggacagaaagtacttccaccacaacagcgacttccacatccccaaggccaccctgaaggacagcggcagctacttctgcagaggcctggtgggcagcaagaacgtgagcagcgagaccgtgaacatcaccatcacccagggcctggccgtgagcaccatcagcagcttcagcccccccggctaccaggtgagcttctgcctggtgatggtgctgctgttcgccgtggacaccggcctgtacttcagcgtgaagaccaacatctag

SEQ ID NO: 81514 - DNA, 702 bp, Artificial Sequence; identical to SEQ ID NO: 81513
  Description of Artificial Sequence: Synthetic coding sequence

SEQ ID NO: 81515 - DNA, 2076 bp, Artificial Sequence
  Description of Artificial Sequence: Synthetic coding sequence
atggagatcgccccccaggaggccccccccgtgcccggcgccgacggcgacatcgaggaggcccccgccgaggccggcagccccagccccgccagcccccccgccgacggcagactgaaggccgccgccaagagagtgaccttccccagcgacgaggacatcgtgagcggcgccgtggagcccaaggacccctggagacacgcccagaacgtgaccgtggacgaggtgatcggcgcctacaagcaggcctgccagaagctgaactgcagacagatccccaagctgctgagacagctgcaggagttcaccgacctgggccacagactggactgcctggacctgaagggcgagaagctggactacaagacctgcgaggccctggaggaggtgttcaagagactgcagttcaaggtggtggacctggagcagaccaacctggacgaggacggcgccagcgccctgttcgacatgatcgagtactacgagagcgccacccacctgaacatcagcttcaacaagcacatcggcaccagaggctggcaggccgccgcccacatgatgagaaagaccagctgcctgcagtacctggacgccagaaacacccccctgctggaccacagcgcccccttcgtggccagagccctgagaatcagaagcagcctggccgtgctgcacctggagaacgccagcctgagcggcagacccctgatgctgctggccaccgccctgaagatgaacatgaacctgagagagctgtacctggccgacaacaagctgaacggcctgcaggacagcgcccagctgggcaacctgctgaagttcaactgcagcctgcagatcctggacctgagaaacaaccacgtgctggacagcggcctggcctacatctgcgagggcctgaaggagcagagaaagggcctggtgaccctggtgctgtggaacaaccagctgacccacaccggcatggccttcctgggcatgaccctgccccacacccagagcctggagaccctgaacctgggccacaaccccatcggcaacgagggcgtgagacacctgaagaacggcctgatcagcaacagaagcgtgctgagactgggcctggccagcaccaagctgacctgcgagggcgccgtggccgtggccgagttcatcgccgagagccccagactgctgagactggacctgagagagaacgagatcaagaccggcggcctgatggccctgagcctggccctgaaggtgaaccacagcctgctgagactggacctggacagagagcccaagaaggaggccgtgaagagcttcatcgagacccagaaggccctgctggccgagatccagaacggctgcaagagaaacctggtgctggccagagagagagaggagaaggagcagcccccccagctgagcgccagcatgcccgagaccaccgccaccgagccccagcccgacgacgagcccgccgccggcgtgcagaacggcgcccccagccccgcccccagccccgacagcgacagcgacagcgacagcgacggcgaggaggaggaggaggaggagggcgagagagacgagaccccctgccccgccctggtgccccccaccgacagcctgggccccggcgacagaagcccccccggcagccccagcacccccaccgagcagagaatcagcgtgagcagccccggcagaggccacaaggtgttcgtggtgaccagagtggagagcccccccgagagagccgagccccccgccagccccaccccccccagccccccccccccccccagcccccccgccagccccagcctgccccccgccggcgccatcgacaccagagacaccggcagcagcgagccccagcccccccccgagccccccagaagcggcccccccctgcccaacggcctgaagcccgagttcgccctggccctgccccccgagcccccccccggccccgaggtgaagggcggcagctgcggcctggagcacgagctgagctgcagcaagaacgagaaggagctggaggagctgctgctggaggccagccaggagagcggccaggagaccctgtag

SEQ ID NO: 81516 - DNA, 459 bp, Artificial Sequence
  Description of Artificial Sequence: Synthetic coding sequence
atgggcgtgcccagaccccagccctgggccctgggcctgctgctgttcctgctgcccggcagcctgggcgccgagagccacctgagcctgctgtaccacctgaccgccgtgagcagccccgcccccggcacccccgccttctgggtgagcggctggctgggcccccagcagtacctgagctacaacagcctgagaggcgaggccgagccctgcggcgcctgggtgtgggagaaccaggtgagctggtactgggagaaggagaccaccgacctgagaatcaaggagaagctgttcctggaggccttcaaggccctgggcggcaagggcccctacaccctgcagggcctgctgggctgcgagctgggccccgacaacaccagcgtgcccaccgcctgcggcagcacctggagaggcgccgccgagacctggagcggcagaagcccccccccctgcgcctag

SEQ ID NO: 81517 - DNA, 1098 bp, Artificial Sequence; identical to SEQ ID NO: 77753
  Description of Artificial Sequence: Synthetic coding sequence

SEQ ID NO: 81518 - DNA, 708 bp, Artificial Sequence
  Description of Artificial Sequence: Synthetic coding sequence
atgggcgtgcccagaccccagccctgggccctgggcctgctgctgttcctgctgcccggcagcctgggcgccgagagccacctgagcctgctgtaccacctgaccgccgtgagcagccccgcccccggcacccccgccttctgggtgagcggctggctgggcccccagcagtacctgagctacaacagcctgagaggcgaggccgagccctgcggcgcctgggtgtgggagaaccaggtgagctggtactgggagaaggagaccaccgacctgagaatcaaggagaagctgttcctggaggccttcaaggccctgggcggcaagggcccctacaccctgcagggcctgctgggctgcgagctgggccccgacaacaccagcgtgcccaccgccaagttcgccctgaacggcgaggagttcatgaacttcgacctgaagcagggcacctggggcggcgactggcccgaggccctggccatcagccagagatggcagcagcaggacaaggccgccaacaaggagctgaccttcctgctgttcagctgcccccacagactgagagagcacctggagagaggcagaggcaacctggagtggaagggctgctggaccaagatcgacaccagctggggctgcgcccagatcttcatccccagcgccaccaaggagaagctgagactgaaccagagcccccccccctgcgcctag

SEQ ID NO: 81519 - DNA, 1734 bp, Artificial Sequence
  Description of Artificial Sequence: Synthetic coding sequence
atggacggcgaggccaccgtgaagcccggcgagcagaaggaggtggtgagaagaggcagagaggtggactacagcagactgatcgccggcaccctgccccagagccacgtgaccagcagaagagccggctggaagatgcccctgttcctgatcctgtgcctgctgcagggcagcagcttcgccctgccccagaagagaccccaccccagatggctgtgggagggcagcctgcccagcagaacccacctgagagccatgggcaccctgagacccagcagccccctgtgctggagagaggagagcagcttcgccgcccccaacagcctgaagggcagcagactggtgagcggcgagcccggcggcgccgtgaccatccagtgccactacgcccccagcagcgtgaacagacaccagagaaagtactggtgcagactgggcccccccagatggatctgccagaccatcgtgagcaccaaccagtacacccaccacagatacagagacagagtggccctgaccgacttcccccagagaggcctgttcgtggtgagactgagccagctgagccccgacgacatcggctgctacctgtgcggcatcggcagcgagaacaacatgctgttcctgagcatgaacctgaccatcagcgccggccccgccagcaccctgcccaccgccacccccgccgccggcgagctgaccatgagaagctacggcaccgccagccccgtggccaacagatggacccccggcaccacccagaccctgggccagggcaccgcctgggacaccgtggccagcacccccggcaccagcaagaccaccgccagcgccgagggcagaagaacccccggcgccaccagacccgccgcccccggcaccggcagctgggccgagggcagcgtgaaggcccccgcccccatccccgagagcccccccagcaagagcagaagcatgagcaacaccaccgagggcgtgtgggagggcaccagaagcagcgtgaccaacagagccagagccagcaaggacagaagagagatgaccaccaccaaggccgacagacccagagaggacatcgagggcgtgagaatcgccctggacgccgccaagaaggtgctgggcaccatcggcccccccgccctggtgagcgagaccctggcctgggagatcctgccccaggccacccccgtgagcaagcagcagagccagggcagcatcggcgagaccacccccgccgccggcatgtggaccctgggcacccccgccgccgacgtgtggatcctgggcacccccgccgccgacgtgtggaccagcatggaggccgccagcggcgagggcagcgccgccggcgacctggacgccgccaccggcgacagaggcccccaggccaccctgagccagacccccgccgtgggcccctggggcccccccggcaaggagagcagcgtgaagagaaccttccccgaggacgagagcagcagcagaaccctggcccccgtgagcaccatgctggccctgttcatgctgatggccctggtgctgctgcagagaaagctgtggagaagaagaaccagccaggaggccgagagagtgaccctgatccagatgacccacttcctggaggtgaacccccaggccgaccagctgccccacgtggagagaaagatgctgcaggacgacagcctgcccgccggcgccagcctgaccgcccccgagagaaaccccggcccctag

SEQ ID NO: 81520 - DNA, 1608 bp, Artificial Sequence
  Description of Artificial Sequence: Synthetic coding sequence
atggacggcgaggccaccgtgaagcccggcgagcagaaggtgcccctgtggacccacggctggccccccgacgaccccagccccagcttcgccgccggcagcagcttcgccctgccccagaagagaccccaccccagatggctgtgggagggcagcctgcccagcagaacccacctgagagccatgggcaccctgagacccagcagccccctgtgctggagagaggagagcagcttcgccgcccccaacagcctgaagggcagcagactggtgagcggcgagcccggcggcgccgtgaccatccagtgccactacgcccccagcagcgtgaacagacaccagagaaagtactggtgcagactgggcccccccagatggatctgccagaccatcgtgagcaccaaccagtacacccaccacagatacagagacagagtggccctgaccgacttcccccagagaggcctgttcgtggtgagactgagccagctgagccccgacgacatcggctgctacctgtgcggcatcggcagcgagaacaacatgctgttcctgagcatgaacctgaccatcagcgccggccccgccagcaccctgcccaccgccacccccgccgccggcgagctgaccatgagaagctacggcaccgccagccccgtggccaacagatggacccccggcaccacccagaccctgggccagggcaccgcctgggacaccgtggccagcacccccggcaccagcaagaccaccgccagcgccgagggcagaagaacccccggcgccaccagacccgccgcccccggcaccggcagctgggccgagggcagcgtgaaggcccccgcccccatccccgagagcccccccagcaagagcagaagcatgagcaacaccaccgagggcgtgtgggagggcaccagaagcagcgtgaccaacagagccagagccagcaaggacagaagagagatgaccaccaccaaggccgacagacccagagaggacatcgagggcgtgagaatcgccctggacgccgccaagaaggtgctgggcaccatcggcccccccgccctggtgagcgagaccctggcctgggagatcctgccccaggccacccccgtgagcaagcagcagagccagggcagcatcggcgagaccacccccgccgccggcatgtggaccctgggcacccccgccgccgacgtgtggatcaccagcatggaggccgccagcggcgagggcagcgccgccggcgacctggacgccgccaccggcgacagaggcccccaggccaccctgagccagacccccgccgtgggcccctggggcccccccggcaaggagagcagcgtgaagagagccacctgccccggcctgagcaccctgaaggagatcaaggtgagcgccgtgctgacccagaacccccacagcctgctgtgcgtgagcgccgcccaggaggccgagagagtgaccctgatccagatgacccacttcctggaggtgaacccccaggccgaccagctgccccacgtggagagaaagatgctgcaggacgacagcctgcccgccggcgccagcctgaccgcccccgagagaaaccccggcccctag

SEQ ID NO: 81521 - DNA, 798 bp, Artificial Sequence
  Description of Artificial Sequence: Synthetic coding sequence
atggacggcgaggccaccgtgaagcccggcgagcagaaggaggtggtgagaagaggcagagaggtggactacagcagactgatcgccggcaccctgccccagagccacgtgaccagcagaagagccggctggaagatgcccctgttcctgatcctgtgcctgctgcagggcagcagcttcgccctgccccagaagagaccccaccccagatggctgtgggagggcagcctgcccagcagaacccacctgagagccatgggcaccctgagacccagcagccccctgtgctggagagaggagagcagcttcgccgcccccaacagcctgaagggcagcagactggtgagcggcgagcccggcggcgccgtgaccatccagtgccactacgcccccagcagcgtgaacagacaccagagaaagtactggtgcagactgggcccccccagatggatctgccagaccatcgtgagcaccaaccagtacacccaccacagatacagagacagagtggccctgaccgacttcccccagagaggcctgttcgtggtgagactgagccagctgagccccgacgacatcggctgctacctgtgcggcatcggcagcgagaacaacatgctgttcctgagcatgaacctgaccatcagcgccgtgctgttccagaagatgaaggccgccctgggcccctggctgctgagcctgccctgctggccctgcctgtgcctgtggctgtggttctactgcaagggcagcagcggcgagggcggccccctgagaagacagaagggcagcccctag

SEQ ID NO: 81522 - DNA, 798 bp, Artificial Sequence; identical to SEQ ID NO: 81521
  Description of Artificial Sequence: Synthetic coding sequence

SEQ ID NO: 81523 - DNA, 1101 bp, Artificial Sequence
  Description of Artificial Sequence: Synthetic coding sequence
atgctgcccagactgctgctgctgatctgcgcccccctgtgcgagcccgccgagctgttcctgatcgccagccccagccaccccaccgagggcagccccgtgaccctgacctgcaagatgcccttcctgcagagcagcgacgcccagttccagttctgcttcttcagagacaccagagccctgggccccggctggagcagcagccccaagctgcagatcgccgccatgtggaaggaggacaccggcagctactggtgcgaggcccagaccatggccagcaaggtgctgagaagcagaagaagccagatcaacgtgcacagagtgcccgtggccgacgtgagcctggagacccagccccccggcggccaggtgatggagggcgacagactggtgctgatctgcagcgtggccatgggcaccggcgacatcaccttcctgtggtacaagggcgccgtgggcctgaacctgcagagcaagacccagagaagcctgaccgccgagtacgagatccccagcgtgagagagagcgacgccgagcagtactactgcgtggccgagaacggctacggccccagccccagcggcctggtgagcatcaccgtgagaatccccgtgagcagacccatcctgatgctgagagcccccagagcccaggccgccgtggaggacgtgctggagctgcactgcgaggccctgagaggcagcccccccatcctgtactggttctaccacgaggacatcaccctgggcagcagaagcgcccccagcggcggcggcgccagcttcaacctgagcctgaccgaggagcacagcggcaactacagctgcgaggccaacaacggcctgggcgcccagagaagcgaggccgtgaccctgaacttcaccggcagaagaagcgccagagaccccctgagaagcctgcccagccccctgccccaggagttcacctacctgaacagccccacccccggccagctgcagcccatctacgagaacgagcccagagagcagagcgtggccgtgcacggcagacagcagcacagcagcgagcagaaggcccagaagccctggggccacatctggagaaccagattcccctag

SEQ ID NO: 81524 - DNA, 1290 bp, Artificial Sequence
  Description of Artificial Sequence: Synthetic coding sequence
atgctgcccagactgctgctgctgatctgcgcccccctgtgcgagcccgccgagctgttcctgatcgccagccccagccaccccaccgagggcagccccgtgaccctgacctgcaagatgcccttcctgcagagcagcgacgcccagttccagttctgcttcttcagagacaccagagccctgggccccggctggagcagcagccccaagctgcagatcgccgccatgtggaaggaggacaccggcagctactggtgcgaggcccagaccatggccagcaaggtgctgagaagcagaagaagccagatcaacgtgcacagagtgcccgtggccgacgtgagcctggagacccagccccccggcggccaggtgatggagggcgacagactggtgctgatctgcagcgtggccatgggcaccggcgacatcaccttcctgtggtacaagggcgccgtgggcctgaacctgcagagcaagacccagagaagcctgaccgccgagtacgagatccccagcgtgagagagagcgacgccgagcagtactactgcgtggccgagaacggctacggccccagccccagcggcctggtgagcatcaccgtgagaatccccgtgagcagacccatcctgatgctgagagcccccagagcccaggccgccgtggaggacgtgctggagctgcactgcgaggccctgagaggcagcccccccatcctgtactggttctaccacgaggacatcaccctgggcagcagaagcgcccccagcggcggcggcgccagcttcaacctgagcctgaccgaggagcacagcggcaactacagctgcgaggccaacaacggcctgggcgcccagagaagcgaggccgtgaccctgaacttcaccgtgcccaccggcgccagaagcaaccacctgaccagcggcgtgatcgagggcctgctgagcaccctgggccccgccaccgtggccctgctgttctgctacggcctgaagagaaagatcggcagaagaagcgccagagaccccctgagaagcctgcccagccccctgccccaggagttcacctacctgaacagccccacccccggccagctgcagcccatctacgagaacgtgaacgtggtgagcggcgacgaggtgtacagcctggcctactacaaccagcccgagcaggagagcgtggccgccgagaccctgggcacccacatggaggacaaggtgagcctggacatctacagcagactgagaaaggccaacatcaccgacgtggactacgaggacgccatgtag

SEQ ID NO: 81525 - DNA, 1287 bp, Artificial Sequence
  Description of Artificial Sequence: Synthetic coding sequence
atgctgcccagactgctgctgctgatctgcgcccccctgtgcgagcccgccgagctgttcctgatcgccagccccagccaccccaccgagggcagccccgtgaccctgacctgcaagatgcccttcctgcagagcagcgacgcccagttccagttctgcttcttcagagacaccagagccctgggccccggctggagcagcagccccaagctgcagatcgccgccatgtggaaggaggacaccggcagctactggtgcgaggcccagaccatggccagcaaggtgctgagaagcagaagaagccagatcaacgtgcacagagtgcccgtggccgacgtgagcctggagacccagccccccggcggccaggtgatggagggcgacagactggtgctgatctgcagcgtggccatgggcaccggcgacatcaccttcctgtggtacaagggcgccgtgggcctgaacctgcagagcaagacccagagaagcctgaccgccgagtacgagatccccagcgtgagagagagcgacgccgagcagtactactgcgtggccgagaacggctacggccccagccccagcggcctggtgagcatcaccgtgagaatccccgtgagcagacccatcctgatgctgagagcccccagagcccaggccgccgtggaggacgtgctggagctgcactgcgaggccctgagaggcagcccccccatcctgtactggttctaccacgaggacatcaccctgggcagcagaagcgcccccagcggcggcggcgccagcttcaacctgagcctgaccgaggagcacagcggcaactacagctgcgaggccaacaacggcctgggcgcccagagaagcgaggccgtgaccctgaacttcaccgtgcccaccggcgccagaagcaaccacctgaccagcggcgtgatcgagggcctgctgagcaccctgggccccgccaccgtggccctgctgttctgctacggcctgaagagaaagatcggcagaagaagcgccagagaccccctgagaagcctgcccagccccctgccccaggagttcacctacctgaacagccccacccccggccagctgcagcccatctacgagaacgtgaacgtggtgagcggcgacgaggtgtacagcctggcctactacaaccagcccgagcaggagagcgtggccgagaccctgggcacccacatggaggacaaggtgagcctggacatctacagcagactgagaaaggccaacatcaccgacgtggactacgaggacgccatgtag

SEQ ID NO: 81526 - DNA, 2670 bp, Artificial Sequence
  Description of Artificial Sequence: Synthetic coding sequence
atgagctacttcggcgagcacttctggggcgagaagaaccacggcttcgaggtgctgtaccacagcgtgaagcagggccccatcagcaccaaggagctggccgacttcatcagagagagagccaccatcgaggagacctacagcaaggccatggccaagctgagcaagctggccagcaacggcacccccatgggcaccttcgcccccctgtgggaggtgttcagagtgagcagcgacaagctggccctgtgccacctggagctgaccagaaagctgcaggacctgatcaaggacgtgctgagatacggcgaggagcagctgaagacccacaagaagtgcaaggaggaggtggtgagcaccctggacgccgtgcaggtgctgagcggcgtgagccagctgctgcccaagagcagagagaactacctgaacagatgcatggaccaggagagactgagaagagagagcaccagccagaaggagatggacaaggccgagaccaagaccaagaaggccgccgagagcctgagaagaagcgtggagaagtacaacagcgccagagccgacttcgagcagaagatgctggacagcgccctgagattccaggccatggaggagacccacctgagacacatgaaggccctgctgggcagctacgcccacagcgtggaggacacccacgtgcagatcggccaggtgcacgaggagttcaagcagaacatcgagaacgtgagcgtggagatgctgctgagaaagttcgccgagagcaagggcaccggcagagagaagcccggccccctggacttcgaggcctacagcgccgccgccctgcaggaggccatgaagagactgagaggcgccaaggccttcagactgcccggcctgagcagaagagagagagagcccgagccccccgccgccgtggacttcctggagcccgacagcggcacctgccccgaggtggacgaggagggcttcaccgtgagacccgacgtgacccagaacagcaccgccgagcccagcagattcagcagcagcgacagcgacttcgacgacgaggagcccagaaagttctacgtgcacatcaagcccgcccccgccagagcccccgcctgcagccccgaggccgccgccgcccagctgagagccaccgccggcagcctgatcctgccccccggccccggcggcaccatgaagagacacagcagcagagacgccgccggcaagccccagagacccagaagcgcccccagaaccagcagctgcgccgagagactgcagagcgaggagcaggtgagcaagaacctgttcggcccccccctggagagcgccttcgaccacgaggacttcaccggcagcagcagcctgggcttcaccagcagccccagccccttcagcagcagcagccccgagaacgtggaggacagcggcctggacagccccagccacgccgcccccggccccagccccgacagctgggtgcccagacccggcaccccccagagcccccccagctgcagagcccccccccccgaggccagaggcatcagagccccccccctgcccgacagcccccagcccctggccagcagccccggcccctggggcctggaggccctggccggcggcgacctgatgcccgcccccgccgaccccaccgccagagagggcctggccgccccccccagaagactgagaagcagaaaggtgagctgccccctgaccagaagcaacggcgacctgagcagaagcctgagccccagccccctgggcagcagcgccgccagcaccgccctggagagacccagcttcctgagccagaccggccacggcgtgagcagaggccccagccccgtggtgctgggcagccaggacgccctgcccatcgccaccgccttcaccgagtacgtgcacgcctacttcagaggccacagccccagctgcctggccagagtgaccggcgagctgaccatgaccttccccgccggcatcgtgagagtgttcagcggcaccccccccccccccgtgctgagcttcagactggtgcacaccaccgccatcgagcacttccagcccaacgccgacctgctgttcagcgaccccagccagagcgaccccgagaccaaggacttctggctgaacatggccgccctgaccgaggccctgcagagacaggccgagcagaaccccaccgccagctactacaacgtggtgctgctgagataccagttcagcagacccggcccccagagcgtgcccctgcagctgagcgcccactggcagtgcggcgccaccctgacccaggtgagcgtggagtacggctacagacccggcgccaccgccgtgcccacccccctgaccaacgtgcagatcctgctgcccgtgggcgagcccgtgaccaacgtgagactgcagcccgccgccacctggaacctggaggagaagagactgacctggagactgcccgacgtgagcgaggccggcggcagcggcagactgagcgccagctgggagcccctgagcggccccagcacccccagccccgtggccgcccagttcaccagcgagggcaccaccctgagcggcgtggacctggagctggtgggcagcggctacagaatgagcctggtgaagagaagattcgccaccggcatgtacctggtgagctgctag

SEQ ID NO: 81527 - DNA, 2670 bp, Artificial Sequence; identical to SEQ ID NO: 81526
  Description of Artificial Sequence: Synthetic coding sequence

SEQ ID NO: 81528 - DNA, 2670 bp, Artificial Sequence; identical to SEQ ID NO: 81526
  Description of Artificial Sequence: Synthetic coding sequence

SEQ ID NO: 81529 - DNA, 2676 bp, Artificial Sequence
  Description of Artificial Sequence: Synthetic coding sequence
atgagctacttcggcgagcacttctggggcgagaagaaccacggcttcgaggtgctgtaccacagcgtgaagcagggccccatcagcaccaaggagctggccgacttcatcagagagagagccaccatcgaggagacctacagcaaggccatggccaagctgagcaagctggccagcaacggcacccccatgggcaccttcgcccccctgtgggaggtgttcagagtgagcagcgacaagctggccctgtgccacctggagctgaccagaaagctgcaggacctgatcaaggacgtgctgagatacggcgaggagcagctgaagacccacaagaagtgcaaggaggaggtggtgagcaccctggacgccgtgcaggtgctgagcggcgtgagccagctgctgcccaagagcagagagaactacctgaacagatgcatggaccaggagagactgagaagagagagcaccagccagaaggagatggacaaggccgagaccaagaccaagaaggccgccgagagcctgagaagaagcgtggagaagtacaacagcgccagagccgacttcgagcagaagatgctggacagcgccctgagattccaggccatggaggagacccacctgagacacatgaaggccctgctgggcagctacgcccacagcgtggaggacacccacgtgcagatcggccaggtgcacgaggagttcaagcagaacatcgagaacgtgagcgtggagatgctgctgagaaagttcgccgagagcaagggcaccggcagagagaagcccggccccctggacttcgaggcctacagcgccgccgccctgcaggaggccatgaagagactgagaggcgccaaggccttcagactgcccggcctgagcagaagagagagagagcccgagccccccgccgccgtggacttcctggagcccgacagcggcacctgccccgaggtggacgaggagggcttcaccgtgagacccgacgtgacccagaacagcaccgccgagcccagcagattcagcagcagcgacagcgacttcgacgacgaggagcccagaaagttctacgtgcacatcaagcccgcccccgccagagcccccgcctgcagccccgaggccgccgccgcccagctgagagccaccgccggcagcctgatcctgccccccggccccggcggcaccatgaagagacacagcagcagagacgccgccggcaagccccagagacccagaagcgcccccagaaccagcagctgcgccgagagactgcagagcgaggagcaggtgagcaagaacctgttcggcccccccctggagagcgccttcgaccacgaggacttcaccggcagcagcagcctgggcttcaccagcagccccagccccttcagcagcagcagccccgagaacgtggaggacagcggcctggacagccccagccacgccgcccccggccccagccccgacagctgggtgcccagacccggcaccccccagagcccccccagctgcagagcccccccccccgaggccagaggcatcagagccccccccctgcccgacagcccccagcccctggccagcagccccggcccctggggcctggaggccctggccggcggcgacctgatgcccgcccccgccgaccccaccgccagagagggcctggccgccccccccagaagactgagaagcagaaaggtgagctgccccctgaccagaagcaacggcgacctgagcagaagcctgagccccagccccctgggcagcagcgccgccagcaccgccctggagagacccagcttcctgagccagaccggccacggcgtgagcagaggccccagccccgtggtgctgggcagccaggacgccctgcccatcgccaccgccttcaccgagtacgtgcacgcctacttcagaggccacagccccagctgcctggccagagtgaccggcgagctgaccatgaccttccccgccggcatcgtgagagtgttcagcggcaccccccccccccccgtgctgagcttcagactggtgcacaccaccgccatcgagcacttccagcccaacgccgacctgctgttcagcgaccccagccagagcgaccccgagaccaaggacttctggctgaacatggccgccctgaccgaggccctgcagagacaggccgagcagaaccccaccgccagctactacaacgtggtgctgctgagataccagttcagcagacccggcccccagagcgtgcccctgcagctgagcgcccactggcagtgcggcgccaccctgacccaggtgagcgtggagtacggctacagacccggcgccaccgccgtgcccacccccctgaccaacgtgcagatcctgctgcccgtgggcgagcccgtgaccaacgtgagactgcagcccgccgccacctggaacctggaggagaagagactgacctggagactgcccgacgtgagcgaggccggcggcagcggcagactgagcgccagctgggagcccctgagcggccccagcacccccagccccgtggccgcccagttcaccagcgagggcaccaccctgagcggcgtggacctggagctggtgggcagcggctacagaatgagcctggtgaagagaagattcgccaccgccgcccccccccagggctgcacctggtag

SEQ ID NO: 81530 - DNA, 2520 bp, Artificial Sequence
  Description of Artificial Sequence: Synthetic coding sequence
atggccaagctgagcaagctggccagcaacggcacccccatgggcaccttcgcccccctgtgggaggtgttcagagtgagcagcgacaagctggccctgtgccacctggagctgaccagaaagctgcaggacctgatcaaggacgtgctgagatacggcgaggagcagctgaagacccacaagaagtgcaaggaggaggtggtgagcaccctggacgccgtgcaggtgctgagcggcgtgagccagctgctgcccaagagcagagagaactacctgaacagatgcatggaccaggagagactgagaagagagagcaccagccagaaggagatggacaaggccgagaccaagaccaagaaggccgccgagagcctgagaagaagcgtggagaagtacaacagcgccagagccgacttcgagcagaagatgctggacagcgccctgagattccaggccatggaggagacccacctgagacacatgaaggccctgctgggcagctacgcccacagcgtggaggacacccacgtgcagatcggccaggtgcacgaggagttcaagcagaacatcgagaacgtgagcgtggagatgctgctgagaaagttcgccgagagcaagggcaccggcagagagaagcccggccccctggacttcgaggcctacagcgccgccgccctgcaggaggccatgaagagactgagaggcgccaaggccttcagactgcccggcctgagcagaagagagagagagcccgagccccccgccgccgtggacttcctggagcccgacagcggcacctgccccgaggtggacgaggagggcttcaccgtgagacccgacgtgacccagaacagcaccgccgagcccagcagattcagcagcagcgacagcgacttcgacgacgaggagcccagaaagttctacgtgcacatcaagcccgcccccgccagagcccccgcctgcagccccgaggccgccgccgcccagctgagagccaccgccggcagcctgatcctgccccccggccccggcggcaccatgaagagacacagcagcagagacgccgccggcaagccccagagacccagaagcgcccccagaaccagcagctgcgccgagagactgcagagcgaggagcaggtgagcaagaacctgttcggcccccccctggagagcgccttcgaccacgaggacttcaccggcagcagcagcctgggcttcaccagcagccccagccccttcagcagcagcagccccgagaacgtggaggacagcggcctggacagccccagccacgccgcccccggccccagccccgacagctgggtgcccagacccggcaccccccagagcccccccagctgcagagcccccccccccgaggccagaggcatcagagccccccccctgcccgacagcccccagcccctggccagcagccccggcccctggggcctggaggccctggccggcggcgacctgatgcccgcccccgccgaccccaccgccagagagggcctggccgccccccccagaagactgagaagcagaaaggtgagctgccccctgaccagaagcaacggcgacctgagcagaagcctgagccccagccccctgggcagcagcgccgccagcaccgccctggagagacccagcttcctgagccagaccggccacggcgtgagcagaggccccagccccgtggtgctgggcagccaggacgccctgcccatcgccaccgccttcaccgagtacgtgcacgcctacttcagaggccacagccccagctgcctggccagagtgaccggcgagctgaccatgaccttccccgccggcatcgtgagagtgttcagcggcaccccccccccccccgtgctgagcttcagactggtgcacaccaccgccatcgagcacttccagcccaacgccgacctgctgttcagcgaccccagccagagcgaccccgagaccaaggacttctggctgaacatggccgccctgaccgaggccctgcagagacaggccgagcagaaccccaccgccagctactacaacgtggtgctgctgagataccagttcagcagacccggcccccagagcgtgcccctgcagctgagcgcccactggcagtgcggcgccaccctgacccaggtgagcgtggagtacggctacagacccggcgccaccgccgtgcccacccccctgaccaacgtgcagatcctgctgcccgtgggcgagcccgtgaccaacgtgagactgcagcccgccgccacctggaacctggaggagaagagactgacctggagactgcccgacgtgagcgaggccggcggcagcggcagactgagcgccagctgggagcccctgagcggccccagcacccccagccccgtggccgcccagttcaccagcgagggcaccaccctgagcggcgtggacctggagctggtgggcagcggctacagaatgagcctggtgaagagaagattcgccaccggcatgtacctggtgagctgctag

SEQ ID NO: 81531 - DNA, 2670 bp, Artificial Sequence; identical to SEQ ID NO: 81526
  Description of Artificial Sequence: Synthetic coding sequence

SEQ ID NO: 81532 - DNA, 2670 bp, Artificial Sequence; identical to SEQ ID NO: 81526
  Description of Artificial Sequence: Synthetic coding sequence

SEQ ID NO: 81533 - DNA, 1137 bp, Artificial Sequence
  Description of Artificial Sequence: Synthetic coding sequence
atggtgatggcctacttcgtggagaacttctggggcgagaagaacagcggcttcgacgtgctgtaccacaacatgaagcacggccagatcagcaccaaggagctggccgacttcgtgagagagagagccaccatcgaggaggcctacagcagaagcatgaccaagctggccaagagcgccagcaactacagccagctgggcaccttcgcccccgtgtgggacgtgttcaagaccagcaccgagaagctggccaactgccacctggacctggtgagaaagctgcaggagctgatcaaggaggtgcagaagtacggcgaggagcaggtgaagagccacaagaagaccaaggaggaggtggccggcaccctggaggccgtgcagaccatccagagcatcacccaggccctgcagaagagcaaggagaactacaacgccaagtgcgtggagcaggagagactgaagaaggagggcgccacccagagagagatcgagaaggccgccgtgaagagcaagaaggccaccgacacctacaagctgtacgtggagaagtacgccctggccaaggccgacttcgagcagaagatgaccgagaccgcccagaagttccaggacatcgaggagacccacctgatccacatcaaggagatcatcggcagcctgagcaacgccatcaaggagatccacctgcagatcggccaggtgcacgaggagttcatcaacaacatggccaacaccaccgtggagagcctgatccagaagttcgccgagagcaagggcaccggcaaggagagacccggcctgatcgagttcgaggagtgcgacaccgccagcgccgtggagggcatcaagcccagaaagagaaagaccttcgccctgcccggcatcatcaagaaggagaaggacgccgagagcgtgtggagcttcaccgtggtggcccaggtgggcatgcagtggagagacctgggcctgctgcacagccccccccccagattcaagagattcagcagctacctgagcctgcccagcagctggaactacggcgcccaccaccacatctggctgatcttctgcatcttcagcagagacagagtgagcccctactggcccggctggagcagaacccccgacctgagatag

SEQ ID NO: 81534 - DNA, 2433 bp, Artificial Sequence
  Description of Artificial Sequence: Synthetic coding sequence
atggtgatggcctacttcgtggagaacttctggggcgagaagaacagcggcttcgacgtgctgtaccacaacatgaagcacggccagatcagcaccaaggagctggccgacttcgtgagagagagagccaccatcgaggaggcctacagcagaagcatgaccaagctggccaagagcgccagcaactacagccagctgggcaccttcgcccccgtgtgggacgtgttcaagaccagcaccgagaagctggccaactgccacctggacctggtgagaaagctgcaggagctgatcaaggaggtgcagaagtacggcgaggagcaggtgaagagccacaagaagaccaaggaggaggtggccggcaccctggaggccgtgcagaccatccagagcatcacccaggccctgcagaagagcaaggagaactacaacgccaagtgcgtggagcaggagagactgaagaaggagggcgccacccagagagagatcgagaaggccgccgtgaagagcaagaaggccaccgacacctacaagctgtacgtggagaagtacgccctggccaaggccgacttcgagcagaagatgaccgagaccgcccagaagttccaggacatcgaggagacccacctgatccacatcaaggagatcatcggcagcctgagcaacgccatcaaggagatccacctgcagatcggccaggtgcacgaggagttcatcaacaacatggccaacaccaccgtggagagcctgatccagaagttcgccgagagcaagggcaccggcaaggagagacccggcctgatcgagttcgaggagtgcgacaccgccagcgccgtggagggcatcaagcccagaaagagaaagaccttcgccctgcccggcatcatcaagaaggagaaggacgccgagagcgtggagtgccccgacgccgacagcctgaacatccccgacgtggacgaggagggctacagcatcaagcccgagaccaaccagaacgacaccaaggagaaccacttctacagcagcagcgacagcgacagcgaggacgaggagcccaagaagtacagaatcgagatcaagcccatgcaccccaacaacagccaccacaccatggccagcctggacgagctgaaggtgagcatcggcaacatcaccctgagccccgccatcagcgtgagcaccaacaccagactgaacagaaacttcaacgacgaggagctgaccaagagcaagcccagcgccccccccaacgagaagggcaccagcgacctgctggcctgggaccccctgttcggccccagcctggacagcagcagcagcagcagcctgaccagcagcagcagcgccagacccaccacccccctgagcgtgggcaccatcgtgcccccccccagacccgccagcagacccaagctgaccagcggcaagctgagcggcatcaacgagatccccagacccttcagcccccccgtgaccagcaacaccagccccccccccgccgcccccctggccagagccgagagcagcagcagcatcagcagcagcgccagcctgagcgccgccaacacccccaccgtgggcgtgagcagaggccccagccccgtgagcctgggcaaccaggacaccctgcccgtggccgtggccctgaccgagagcgtgaacgcctacttcaagggcgccgaccccaccaagtgcatcgtgaagatcaccggcgacatgaccatgagcttccccagcggcatcatcaaggtgttcaccagcaaccccacccccgccgtgctgtgcttcagagtgaagaacatcagcagactggagcagatcctgcccaacgcccagctggtgttcagcgaccccagccagtgcgacagcaacaccaaggacttctggatgaacatgcaggccgtgaccgtgtacctgaagaagctgagcgagcagaaccccgccgccagctactacaacgtggacgtgctgaagtaccaggtgagcagcaacggcatccagagcacccccctgaacctggccacctactggaagtgcagcgccagcaccaccgacctgagagtggactacaagtacaaccccgaggccatggtggcccccagcgtgctgagcaacatccaggtggtggtgcccgtggacggcggcgtgaccaacatgcagagcctgccccccgccatctggaacgccgagcagatgaaggccttctggaagctgagcagcatcagcgagaagagcgagaacggcggcagcggcagcctgagagccaagttcgacctgagcgagggccccagcaagcccaccaccctggccgtgcagttcctgagcgagggcagcaccctgagcggcgtggacttcgagctggtgggcaccggctacagactgagcctgatcaagaagagattcgccaccggcagatacctggccgactgctag

SEQ ID NO: 81535 - DNA, 2433 bp, Artificial Sequence
  Description of Artificial Sequence: Synthetic coding sequence
atggtgatggcctacttcgtggagaacttctggggcgagaagaacagcggcttcgacgtgctgtaccacaacatgaagcacggccagatcagcaccaaggagctggccgacttcgtgagagagagagccaccatcgaggaggcctacagcagaagcatgaccaagctggccaagagcgccagcaactacagccagctgggcaccttcgcccccgtgtgggacgtgttcaagaccagcaccgagaagctggccaactgccacctggacctggtgagaaagctgcaggagctgatcaaggaggtgcagaagtacggcgaggagcaggtgaagagccacaagaagaccaaggaggaggtggccggcaccctggaggccgtgcagaccatccagagcatcacccaggccctgcagaagagcaaggagaactacaacgccaagtgcgtggagcaggagagactgaagaaggagggcgccacccagagagagatcgagaaggccgccgtgaagagcaagaaggccaccgacacctacaagctgtacgtggagaagtacgccctggccaaggccgacttcgagcagaagatgaccgagaccgcccagaagttccaggacatcgaggagacccacctgatccacatcaaggagatcatcggcagcctgagcaacgccatcaaggagatccacctgcagatcggccaggtgcacgaggagttcatcaacaacatggccaacaccaccgtggagagcctgatccagaagttcgccgagagcaagggcaccggcaaggagagacccggcctgatcgagttcgaggagtgcgacaccgccagcgccgtggagggcatcaagcccagaaagagaaagaccttcgccctgcccggcatcatcaagaaggagaaggacgccgagagcgtggagtgccccgacgccgacagcctgaacatccccgacgtggacgaggagggctacagcatcaagcccgagaccaaccagaacgacaccaaggagaaccacttctacagcagcagcgacagcgacagcgaggacgaggagcccaagaagtacagaatcgagatcaagcccatgcaccccaacaacagccaccacaccatggccagcctggacgagctgaaggtgagcatcggcaacatcaccctgagccccgccatcagcagacacagccccgtgcagatgaacagaaacctgagcaacgaggagctgaccaagagcaagcccagcgccccccccaacgagaagggcaccagcgacctgctggcctgggaccccctgttcggccccagcctggacagcagcagcagcagcagcctgaccagcagcagcagcgccagacccaccacccccctgagcgtgggcaccatcgtgcccccccccagacccgccagcagacccaagctgaccagcggcaagctgagcggcatcaacgagatccccagacccttcagcccccccgtgaccagcaacaccagccccccccccgccgcccccctggccagagccgagagcagcagcagcatcagcagcagcgccagcctgagcgccgccaacacccccaccgtgggcgtgagcagaggccccagccccgtgagcctgggcaaccaggacaccctgcccgtggccgtggccctgaccgagagcgtgaacgcctacttcaagggcgccgaccccaccaagtgcatcgtgaagatcaccggcgacatgaccatgagcttccccagcggcatcatcaaggtgttcaccagcaaccccacccccgccgtgctgtgcttcagagtgaagaacatcagcagactggagcagatcctgcccaacgcccagctggtgttcagcgaccccagccagtgcgacagcaacaccaaggacttctggatgaacatgcaggccgtgaccgtgtacctgaagaagctgagcgagcagaaccccgccgccagctactacaacgtggacgtgctgaagtaccaggtgagcagcaacggcatccagagcacccccctgaacctggccacctactggaagtgcagcgccagcaccaccgacctgagagtggactacaagtacaaccccgaggccatggtggcccccagcgtgctgagcaacatccaggtggtggtgcccgtggacggcggcgtgaccaacatgcagagcctgccccccgccatctggaacgccgagcagatgaaggccttctggaagctgagcagcatcagcgagaagagcgagaacggcggcagcggcagcctgagagccaagttcgacctgagcgagggccccagcaagcccaccaccctggccgtgcagttcctgagcgagggcagcaccctgagcggcgtggacttcgagctggtgggcaccggctacagactgagcctgatcaagaagagattcgccaccggcagatacctggccgactgctag

SEQ ID NO: 81536 - DNA, 2334 bp, Artificial Sequence
  Description of Artificial Sequence: Synthetic coding sequence
atggtgatggcctacttcgtggagaacttctggggcgagaagaacagcggcttcgacgtgctgtaccacaacatgaagcacggccagatcagcaccaaggagctggccgacttcgtgagagagagagccaccatcgaggaggcctacagcagaagcatgaccaagctggccaagagcgccagcaactacagccagctgggcaccttcgcccccgtgtgggacgtgttcaagaccagcaccgagaagctggccaactgccacctggacctggtgagaaagctgcaggagctgatcaaggaggtgcagaagtacggcgaggagcaggtgaagagccacaagaagaccaaggaggaggtggccggcaccctggaggccgtgcagaccatccagagcatcacccaggccctgcagaagagcaaggagaactacaacgccaagtgcgtggagcaggagagactgaagaaggagggcgccacccagagagagatcgagaaggccgccgtgaagagcaagaaggccaccgacacctacaagctgtacgtggagaagtacgccctggccaaggccgacttcgagcagaagatgaccgagaccgcccaggtgcacgaggagttcatcaacaacatggccaacaccaccgtggagagcctgatccagaagttcgccgagagcaagggcaccggcaaggagagacccggcctgatcgagttcgaggagtgcgacaccgccagcgccgtggagggcatcaagcccagaaagagaaagaccttcgccctgcccggcatcatcaagaaggagaaggacgccgagagcgtggagtgccccgacgccgacagcctgaacatccccgacgtggacgaggagggctacagcatcaagcccgagaccaaccagaacgacaccaaggagaaccacttctacagcagcagcgacagcgacagcgaggacgaggagcccaagaagtacagaatcgagatcaagcccatgcaccccaacaacagccaccacaccatggccagcctggacgagctgaaggtgagcatcggcaacatcaccctgagccccgccatcagcagacacagccccgtgcagatgaacagaaacctgagcaacgaggagctgaccaagagcaagcccagcgccccccccaacgagaagggcaccagcgacctgctggcctgggaccccctgttcggccccagcctggacagcagcagcagcagcagcctgaccagcagcagcagcgccagacccaccacccccctgagcgtgggcaccatcgtgcccccccccagacccgccagcagacccaagctgaccagcggcaagctgagcggcatcaacgagatccccagacccttcagcccccccgtgaccagcaacaccagccccccccccgccgcccccctggccagagccgagagcagcagcagcatcagcagcagcgccagcctgagcgccgccaacacccccaccgtgggcgtgagcagaggccccagccccgtgagcctgggcaaccaggacaccctgcccgtggccgtggccctgaccgagagcgtgaacgcctacttcaagggcgccgaccccaccaagtgcatcgtgaagatcaccggcgacatgaccatgagcttccccagcggcatcatcaaggtgttcaccagcaaccccacccccgccgtgctgtgcttcagagtgaagaacatcagcagactggagcagatcctgcccaacgcccagctggtgttcagcgaccccagccagtgcgacagcaacaccaaggacttctggatgaacatgcaggccgtgaccgtgtacctgaagaagctgagcgagcagaaccccgccgccagctactacaacgtggacgtgctgaagtaccaggtgagcagcaacggcatccagagcacccccctgaacctggccacctactggaagtgcagcgccagcaccaccgacctgagagtggactacaagtacaaccccgaggccatggtggcccccagcgtgctgagcaacatccaggtggtggtgcccgtggacggcggcgtgaccaacatgcagagcctgccccccgccatctggaacgccgagcagatgaaggccttctggaagctgagcagcatcagcgagaagagcgagaacggcggcagcggcagcctgagagccaagttcgacctgagcgagggccccagcaagcccaccaccctggccgtgcagttcctgagcgagggcagcaccctgagcggcgtggacttcgagctggtgggcaccggctacagactgagcctgatcaagaagagattcgccaccggcagatacctggccgactgctag

SEQ ID NO: 81537 - DNA, 1668 bp, Artificial Sequence
  Description of Artificial Sequence: Synthetic coding sequence
atggccagacccgacgacgaggagggcgccgccgtggcccccggccaccccctggccaagggctacctgcccctgcccagaggcgcccccgtgggcaaggagagcgtggagctgcagaacggccccaaggccggcaccttccccgtgaacggcgcccccagagacagcctggccgccgccagcggcgtgctgggcggcccccagacccccctggcccccgaggaggagacccaggccagactgctgcccgccggcgccggcgccgagacccccggcgccgagagcagccccctgcccctgaccgccctgagccccagaagattcgtggtgctgctgatcttcagcctgtacagcctggtgaacgccttccagtggatccagtacagcatcatcagcaacgtgttcgagggcttctacggcgtgaccctgctgcacatcgactggctgagcatggtgtacatgctggcctacgtgcccctgatcttccccgccacctggctgctggacaccagaggcctgagactgaccgccctgctgggcagcggcctgaactgcctgggcgcctggatcaagtgcggcagcgtgcagcagcacctgttctgggtgaccatgctgggccagtgcctgtgcagcgtggcccaggtgttcatcctgggcctgcccagcagaatcgccagcgtgtggttcggccccaaggaggtgagcaccgcctgcgccaccgccgtgctgggcaaccagctgggcaccgccgtgggcttcctgctgccccccgtgctggtgcccaacacccagaacgacaccaacctgctggcctgcaacatcagcaccatgttctacggcaccagcgccgtggccaccctgctgttcatcctgaccgccatcgccttcaaggagaagcccagatacccccccagccaggcccaggccgccctgcaggacagcccccccgaggagtacagctacaagaagagcatcagaaacctgttcaagaacatccccttcgtgctgctgctgatcacctacggcatcatgaccggcgccttctacagcgtgagcaccctgctgaaccagatgatcctgacctactacgagggcgaggaggtgaacgccggcagaatcggcctgaccctggtggtggccggcatggtgggcagcatcctgtgcggcctgtggctggactacaccaagacctacaagcagaccaccctgatcgtgtacatcctgagcttcatcggcatggtgatcttcaccttcaccctggacctgagatacatcatcatcgtgttcgtgaccggcggcgtgctgggcttcttcatgaccggctacctgcccctgggcttcgagttcgccgtggagatcacctaccccgagagcgagggcaccagcagcggcctgctgaacgccagcgcccagatcttcggcatcctgttcaccctggcccagggcaagctgaccagcgactacggccccaaggccggcaacatcttcctgtgcgtgtggatgttcatcggcatcatcctgaccgccctgatcaagagcgacctgagaagacacaacatcaacatcggcatcaccaacgtggacgtgaaggccatccccgccgacagccccaccgaccaggagcccaagaccgtgatgctgagcaagcagagcgagagcgccatctag

SEQ ID NO: 81538 - DNA, 2469 bp, Artificial Sequence
  Description of Artificial Sequence: Synthetic coding sequence
atgggcttcggcagcgacctgaagaacagccacgaggccgtgctgaagctgcaggactgggagctgagactgctggagaccgtgaagaagttcatggccctgagaatcaagagcgacaaggagtacgccagcaccctgcagaacctgtgcaaccaggtggacaaggagagcaccgtgcagatgaactacgtgagcaacgtgagcaagagctggctgctgatgatccagcagaccgagcagctgagcagaatcatgaagacccacgccgaggacctgaacagcggccccctgcacagactgaccatgatgatcaaggacaagcagcaggtgaagaagagctacatcggcgtgcaccagcagatcgaggccgagatgatcaaggtgaccaagaccgagctggagaagctgaagtgcagctacagacagctgatcaaggagatgaacagcgccaaggagaagtacaaggaggccctggccaagggcaaggagaccgagaaggccaaggagagatacgacaaggccaccatgaagctgcacatgctgcacaaccagtacgtgctggccctgaagggcgcccagctgcaccagaaccagtactacgacatcaccctgcccctgctgctggacagcctgcagaagatgcaggaggagatgatcaaggccctgaagggcatcttcgacgagtacagccagatcaccagcctggtgaccgaggagatcgtgaacgtgcacaaggagatccagatgagcgtggagcagatcgaccccagcaccgagtacaacaacttcatcgacgtgcacagaaccaccgccgccaaggagcaggagatcgagttcgacaccagcctgctggaggagaacgagaacctgcaggccaacgagatcatgtggaacaacctgaccgccgagagcctgcaggtgatgctgaagaccctggccgaggagctgatgcagacccagcagatgctgctgaacaaggaggaggccgtgctggagctggagaagagaatcgaggagagcagcgagacctgcgagaagaagagcgacatcgtgctgctgctgagccagaagcaggccctggaggagctgaagcagagcgtgcagcagctgagatgcaccgaggccaagttcagcgcccagaaggagctgctggagcagaaggtgcaggagaacgacggcaaggagcccccccccgtggtgaactacgaggaggacgccagaagcgtgaccagcatggagagaaaggagagactgagcaagttcgagagcatcagacacagcatcgccggcatcatcagaagccccaagagcgccctgggcagcagcgccctgagcgacatgatcagcatcagcgagaagcccctggccgagcaggactggtaccacggcgccatccccagaatcgaggcccaggagctgctgaagaagcagggcgacttcctggtgagagagagccacggcaagcccggcgagtacgtgctgagcgtgtacagcgacggccagagaagacacttcatcatccagtacgtggacaacatgtacagattcgagggcaccggcttcagcaacatcccccagctgatcgaccaccactacaccaccaagcaggtgatcaccaagaagagcggcgtggtgctgctgaaccccatccccaaggacaagaagtggatcctgagccacgaggacgtgatcctgggcgagctgctgggcaagggcaacttcggcgaggtgtacaagggcaccctgaaggacaagaccagcgtggccgtgaagacctgcaaggaggacctgccccaggagctgaagatcaagttcctgcaggaggccaagatcctgaagcagtacgaccaccccaacatcgtgaagctgatcggcgtgtgcacccagagacagcccgtgtacatcatcatggagctggtgagcggcggcgacttcctgaccttcctgagaagaaagaaggacgagctgaagctgaagcagctggtgaagttcagcctggacgccgccgccggcatgctgtacctggagagcaagaactgcatccacagagacctggccgccagaaactgcctggtgggcgagaacaacgtgctgaagatcagcgacttcggcatgagcagacaggaggacggcggcgtgtacagcagcagcggcctgaagcagatccccatcaagtggaccgcccccgaggccctgaactacggcagatacagcagcgagagcgacgtgtggagcttcggcatcctgctgtgggagaccttcagcctgggcgtgtgcccctaccccggcatgaccaaccagcaggccagagagcaggtggagagaggctacagaatgagcgccccccagcactgccccgaggacatcagcaagatcatgatgaagtgctgggactacaagcccgagaacagacccaagttcagcgagctgcagaaggagctgaccatcatcaagagaaagctgacctag

SEQ ID NO: 81539 - DNA, 1944 bp, Artificial Sequence
  Description of Artificial Sequence: Synthetic coding sequence
atgaagctgcacatgctgcacaaccagtacgtgctggccctgaagggcgcccagctgcaccagaaccagtactacgacatcaccctgcccctgctgctggacagcctgcagaagatgcaggaggagatgatcaaggccctgaagggcatcttcgacgagtacagccagatcaccagcctggtgaccgaggagatcgtgaacgtgcacaaggagatccagatgagcgtggagcagatcgaccccagcaccgagtacaacaacttcatcgacgtgcacagaaccaccgccgccaaggagcaggagatcgagttcgacaccagcctgctggaggagaacgagaacctgcaggccaacgagatcatgtggaacaacctgaccgccgagagcctgcaggtgatgctgaagaccctggccgaggagctgatgcagacccagcagatgctgctgaacaaggaggaggccgtgctggagctggagaagagaatcgaggagagcagcgagacctgcgagaagaagagcgacatcgtgctgctgctgagccagaagcaggccctggaggagctgaagcagagcgtgcagcagctgagatgcaccgaggccaagttcagcgcccagaaggagctgctggagcagaaggtgcaggagaacgacggcaaggagcccccccccgtggtgaactacgaggaggacgccagaagcgtgaccagcatggagagaaaggagagactgagcaagttcgagagcatcagacacagcatcgccggcatcatcagaagccccaagagcgccctgggcagcagcgccctgagcgacatgatcagcatcagcgagaagcccctggccgagcaggactggtaccacggcgccatccccagaatcgaggcccaggagctgctgaagaagcagggcgacttcctggtgagagagagccacggcaagcccggcgagtacgtgctgagcgtgtacagcgacggccagagaagacacttcatcatccagtacgtggacaacatgtacagattcgagggcaccggcttcagcaacatcccccagctgatcgaccaccactacaccaccaagcaggtgatcaccaagaagagcggcgtggtgctgctgaaccccatccccaaggacaagaagtggatcctgagccacgaggacgtgatcctgggcgagctgctgggcaagggcaacttcggcgaggtgtacaagggcaccctgaaggacaagaccagcgtggccgtgaagacctgcaaggaggacctgccccaggagctgaagatcaagttcctgcaggaggccaagatcctgaagcagtacgaccaccccaacatcgtgaagctgatcggcgtgtgcacccagagacagcccgtgtacatcatcatggagctggtgagcggcggcgacttcctgaccttcctgagaagaaagaaggacgagctgaagctgaagcagctggtgaagttcagcctggacgccgccgccggcatgctgtacctggagagcaagaactgcatccacagagacctggccgccagaaactgcctggtgggcgagaacaacgtgctgaagatcagcgacttcggcatgagcagacaggaggacggcggcgtgtacagcagcagcggcctgaagcagatccccatcaagtggaccgcccccgaggccctgaactacggcagatacagcagcgagagcgacgtgtggagcttcggcatcctgctgtgggagaccttcagcctgggcgtgtgcccctaccccggcatgaccaaccagcaggccagagagcaggtggagagaggctacagaatgagcgccccccagcactgccccgaggacatcagcaagatcatgatgaagtgctgggactacaagcccgagaacagacccaagttcagcgagctgcagaaggagctgaccatcatcaagagaaagctgacctag

SEQ ID NO: 81540 - DNA, 981 bp, Artificial Sequence
  Description of Artificial Sequence: Synthetic coding sequence
atgggcttcggcagcgacctgaagaacagccacgaggccgtgctgaagctgcaggactgggagctgagactgctggagaccgtgaagaagttcatggccctgagaatcaagagcgacaaggagtacgccagcaccctgcagaacctgtgcaaccaggtggacaaggagagcaccgtgcagatgaactacgtgagcaacgtgagcaagagctggctgctgatgatccagcagaccgagcagctgagcagaatcatgaagacccacgccgaggacctgaacagcggccccctgcacagactgaccatgatgatcaaggacaagcagcaggtgaagaagagctacatcggcgtgcaccagcagatcgaggccgagatgatcaaggtgaccaagaccgagctggagaagctgaagtgcagctacagacagctgatcaaggagatgaacagcgccaaggagaagtacaaggaggccctggccaagggcaaggagaccgagaaggccaaggagagatacgacaaggccaccatgaagctgcacatgctgcacaaccagtacgtgctggccctgaagggcgcccagctgcaccagaaccagtactacgacatcaccctgcccctgctgctggacagcctgcagaagatgcaggaggagatgatcaaggccctgaagggcatcttcgacgagtacagccagatcaccagcctggtgaccgaggagatcgtgaacgtgcacaaggagatccagatgagcgtggagcagatcgaccccagcaccgagtacaacaacttcatcgacgtgcacagaaccaccgccgccaaggagcaggagatcgagttcgacaccagcctgctggaggagaacgagaacctgcaggccaacgagatcatgtggaacaacctgaccgccgagagcctgcaggtgatgaaggagagaagaggctaccccaacctgaacctgttcgtgatccagctgctggagtag

SEQ ID NO: 81541 - DNA, 3855 bp, Artificial Sequence
  Description of Artificial Sequence: Synthetic coding sequence
atgcacgtgttcatcgtgggcatgagcctgagcagcgtgaccctggccagcgccctgcaggtgagaggcgaggccctgagcgaggaggagatctggagcctgctgttcctggccgccgagcagctgctggaggacctgagaaacgacagcagcgactacgtggtgtgcccctggagcgccctgctgagcgccgccggcagcctgagcttccagggcagagtgagccacatcgaggccgcccccttcaaggcccccgagctgctgcagggccagagcgaggacgagcagcccgacgccagccagcccctgcagctgtgcgagcccctgcacagcatcctgctgaccatgtgcgaggaccagccccacagaagatgcaccctgcagagcgtgctggaggcctgcagagtgcacgagaaggaggtgagcgtgtaccccgcccccgccggcctgcacatcagaagactggtgggcctggtgctgggcaccatcagcgaggtggagaagagagtggtggaggagagcagcagcgtgcagcagaacagaagctacctgctgagaaagagactgagaggcaccagcagcgagagccccgccgcccaggcccccgagtgcctgcacccctgcagagtgagcgagagaagcaccgagacccagagcagccccgagccccactggagcaccctgacccacagccactgcagcctgctggtgaacagagccctgcccggcgccgacccccaggaccagcaggccggcagaagactgagcagcggcagcgtgcacagcgccgccgacagcagctggcccaccacccccagccagagaggcttcctgcagagaagaagcaagttcagcagacccgagttcatcctgctggccggcgaggcccccatgaccctgcacctgcccggcagcgtggtgaccaagaagggcaagagctacctggccctgagagacctgtgcgtggtgctgctgaacggccagcacctggaggtgaagtgcgacgtggagagcaccgtgggcgccgtgttcaacgccgtgaccagcttcgccaacctggaggagctgacctacttcggcctggcctacatgaagagcaaggagttcttcttcctggacagcgagaccagactgtgcaagatcgcccccgagggctggagagagcagccccagaagaccagcatgaacaccttcaccctgttcctgagaatcaagttcttcgtgagccactacggcctgctgcagcacagcctgaccagacaccagttctacctgcagctgagaaaggacatcctggaggagagactgtactgcaacgaggagatcctgctgcagctgggcgtgctggccctgcaggccgagttcggcaactaccccaaggaggtggagagcaagccctacttccacgtggaggactacatccccgccagcctgatcgagagaatgaccgccctgagagtgcaggtggaggtgagcgagatgcacagactgagcagcgccctgtggggcgaggacgccgagctgaagttcctgagagtgacccagcagctgcccgagtacggcgtgctggtgcaccaggtgttcagcgagaagagaagacccgaggaggagatggccctgggcatctgcgccaagggcgtgatcgtgtacgaggtgaagaacaacagcagaatcgccatgctgagattccagtggagagagaccggcaagatcagcacctaccagaagaagttcaccatcaccagcagcgtgaccggcaagaagcacaccttcgtgaccgacagcgccaagaccagcaagtacctgctggacctgtgcagcgcccagcacggcttcaacgcccagatgggcagcggccagcccagccacgtgctgttcgaccacgacaagttcgtgcagatggccaacctgagccccgcccaccaggccagaagcaagcccctgatctggatccagagactgagctgcagcgagaacgagctgttcgtgagcagactgcagggcgccgccggcggcctgctgagcaccagcatggacaacttcaacgtggacggcagcaaggaggccggcgccgagggcatcggcagaagcccctgcaccggcagagagcagctgaagagcgcctgcgtgatccagaagcccatgacctgggacagcctgagcggcccccccgtgcagagcatgcacgccggcagcaagaacaacagaagaaagagcttcatcgccgagcccggcagagagatcgtgagagtgaccctgaagagagacccccacagaggcttcggcttcgtgatcaacgagggcgagtacagcggccaggccgaccccggcatcttcatcagcagcatcatccccggcggccccgccgagaaggccaagaccatcaagcccggcggccagatcctggccctgaaccacatcagcctggagggcttcaccttcaacatggccgtgagaatgatccagaacagccccgacaacatcgagctgatcatcagccagagcaagggcgtgggcggcaacaaccccgacgaggagaagaacagcaccgccaacagcggcgtgagcagcaccgacatcctgagcttcggctaccagggcagcctgctgagccacacccaggaccaggacagaaacaccgaggagctggacatggccggcgtgcagagcctggtgcccagactgagacaccagctgagcttcctgcccctgaagggcgccggcagcagctgcccccccagcccccccgagatcagcgccggcgagatctacttcgtggagctggtgaaggaggacggcaccctgggcttcagcgtgaccggcggcatcaacaccagcgtgccctacggcggcatctacgtgaagagcatcgtgcccggcggccccgccgccaaggagggccagatcctgcagggcgacagactgctgcaggtggacggcgtgatcctgtgcggcctgacccacaagcaggccgtgcagtgcctgaccggccccggccaggtggccagactggtgctggagagaagagtgcccagaagcacccagcagtgccccagcgccaacgacagcatgggcgacgagagaaccgccgtgagcctggtgaccgccctgcccggcagacccagcagctgcgtgagcgtgaccgacggccccaagttcgaggtgaagctgaagaagaacgccaacggcctgggcttcagcttcgtgcagatggagaaggagagctgcagccacctgaagagcgacctggtgagaatcaagagactgttccccggccagcccgccgaggagaacggcgccatcgccgccggcgacatcatcctggccgtgaacggcagaagcaccgagggcctgatcttccaggaggtgctgcacctgctgagaggcgccccccaggaggtgaccctgctgctgtgcagacccccccccggcgccctgcccgagctggagcaggagtggcagacccccgagctgagcgccgacaaggagttcaccagagccacctgcaccgacagctgcaccagccccatcctggaccaggaggacagctggagagacagcgccagccccgacgccggcgagggcctgggcctgagacccgagagcagccagaaggccatcagagaggcccagtggggccagaacagagagagaccctgggccagcagcctgacccacagccccgagagccacccccacctgtgcaagctgcaccaggagagagacgagagcaccctggccaccagcctggagaaggacgtgagacagaactgctacagcgtgtgcgacatcatgagactgggcagatacagcttcagcagccccctgaccagactgagcaccgacatcttctag

SEQ ID NO: 81542 - DNA, 3930 bp, Artificial Sequence
  Description of Artificial Sequence: Synthetic coding sequence
atgcagcccctgaccaaggacgccggcatgagcctgagcagcgtgaccctggccagcgccctgcaggtgagaggcgaggccctgagcgaggaggagatctggagcctgctgttcctggccgccgagcagctgctggaggacctgagaaacgacagcagcgactacgtggtgtgcccctggagcgccctgctgagcgccgccggcagcctgagcttccagggcagagtgagccacatcgaggccgcccccttcaaggcccccgagctgctgcagggccagagcgaggacgagcagcccgacgccagccagatgcacgtgtacagcctgggcatgaccctgtactggagcgccggcttccacgtgcccccccaccagcccctgcagctgtgcgagcccctgcacagcatcctgctgaccatgtgcgaggaccagccccacagaagatgcaccctgcagagcgtgctggaggcctgcagagtgcacgagaaggaggtgagcgtgtaccccgcccccgccggcctgcacatcagaagactggtgggcctggtgctgggcaccatcagcgaggtggagaagagagtggtggaggagagcagcagcgtgcagcagaacagaagctacctgctgagaaagagactgagaggcaccagcagcgagagccccgccgcccaggcccccgagtgcctgcacccctgcagagtgagcgagagaagcaccgagacccagagcagccccgagccccactggagcaccctgacccacagccactgcagcctgctggtgaacagagccctgcccggcgccgacccccaggaccagcaggccggcagaagactgagcagcggcagcgtgcacagcgccgccgacagcagctggcccaccacccccagccagagaggcttcctgcagagaagaagcaagttcagcagacccgagttcatcctgctggccggcgaggcccccatgaccctgcacctgcccggcagcgtggtgaccaagaagggcaagagctacctggccctgagagacctgtgcgtggtgctgctgaacggccagcacctggaggtgaagtgcgacgtggagagcaccgtgggcgccgtgttcaacgccgtgaccagcttcgccaacctggaggagctgacctacttcggcctggcctacatgaagagcaaggagttcttcttcctggacagcgagaccagactgtgcaagatcgcccccgagggctggagagagcagccccagaagaccagcatgaacaccttcaccctgttcctgagaatcaagttcttcgtgagccactacggcctgctgcagcacagcctgaccagacaccagttctacctgcagctgagaaaggacatcctggaggagagactgtactgcaacgaggagatcctgctgcagctgggcgtgctggccctgcaggccgagttcggcaactaccccaaggagcaggtggagagcaagccctacttccacgtggaggactacatccccgccagcctgatcgagagaatgaccgccctgagagtgcaggtggaggtgagcgagatgcacagactgagcagcgccctgtggggcgaggacgccgagctgaagttcctgagagtgacccagcagctgcccgagtacggcgtgctggtgcaccaggtgttcagcgagaagagaagacccgaggaggagatggccctgggcatctgcgccaagggcgtgatcgtgtacgaggtgaagaacaacagcagaatcgccatgctgagattccagtggagagagaccggcaagatcagcacctaccagaagaagttcaccatcaccagcagcgtgaccggcaagaagcacaccttcgtgaccgacagcgccaagaccagcaagtacctgctggacctgtgcagcgcccagcacggcttcaacgcccagatgggcagcggccagcccagccacgtgctgttcgaccacgacaagttcgtgcagatggccaacctgagccccgcccaccaggccagaagcaagcccctgatctggatccagagactgagctgcagcgagaacgagctgttcgtgagcagactgcagggcgccgccggcggcctgctgagcaccagcatggacaacttcaacgtggacggcagcaaggaggccggcgccgagggcatcggcagaagcccctgcaccggcagagagcagctgaagagcgcctgcgtgatccagaagcccatgacctgggacagcctgagcggcccccccgtgcagagcatgcacgccggcagcaagaacaacagaagaaagagcttcatcgccgagcccggcagagagatcgtgagagtgaccctgaagagagacccccacagaggcttcggcttcgtgatcaacgagggcgagtacagcggccaggccgaccccggcatcttcatcagcagcatcatccccggcggccccgccgagaaggccaagaccatcaagcccggcggccagatcctggccctgaaccacatcagcctggagggcttcaccttcaacatggccgtgagaatgatccagaacagccccgacaacatcgagctgatcatcagccagagcaagggcgtgggcggcaacaaccccgacgaggagaagaacagcaccgccaacagcggcgtgagcagcaccgacatcctgagcttcggctaccagggcagcctgctgagccacacccaggaccaggacagaaacaccgaggagctggacatggccggcgtgcagagcctggtgcccagactgagacaccagctgagcttcctgcccctgaagggcgccggcagcagctgcccccccagcccccccgagatcagcgccggcgagatctacttcgtggagctggtgaaggaggacggcaccctgggcttcagcgtgaccggcggcatcaacaccagcgtgccctacggcggcatctacgtgaagagcatcgtgcccggcggccccgccgccaaggagggccagatcctgcagggcgacagactgctgcaggtggacggcgtgatcctgtgcggcctgacccacaagcaggccgtgcagtgcctgaccggccccggccaggtggccagactggtgctggagagaagagtgcccagaagcacccagcagtgccccagcgccaacgacagcatgggcgacgagagaaccgccgtgagcctggtgaccgccctgcccggcagacccagcagctgcgtgagcgtgaccgacggccccaagttcgaggtgaagctgaagaagaacgccaacggcctgggcttcagcttcgtgcagatggagaaggagagctgcagccacctgaagagcgacctggtgagaatcaagagactgttccccggccagcccgccgaggagaacggcgccatcgccgccggcgacatcatcctggccgtgaacggcagaagcaccgagggcctgatcttccaggaggtgctgcacctgctgagaggcgccccccaggaggtgaccctgctgctgtgcagacccccccccggcgccctgcccgagctggagcaggagtggcagacccccgagctgagcgccgacaaggagttcaccagagccacctgcaccgacagctgcaccagccccatcctggaccaggaggacagctggagagacagcgccagccccgacgccggcgagggcctgggcctgagacccgagagcagccagaaggccatcagagaggcccagtggggccagaacagagagagaccctgggccagcagcctgacccacagccccgagagccacccccacctgtgcaagctgcaccaggagagagacgagagcaccctggccaccagcctggagaaggacgtgagacagaactgctacagcgtgtgcgacatcatgagactgggcagatacagcttcagcagccccctgaccagactgagcaccgacatcttctag

SEQ ID NO: 81543 - DNA, 3834 bp, Artificial Sequence
  Description of Artificial Sequence: Synthetic coding sequence
atgagcctgagcagcgtgaccctggccagcgccctgcaggtgagaggcgaggccctgagcgaggaggagatctggagcctgctgttcctggccgccgagcagctgctggaggacctgagaaacgacagcagcgactacgtggtgtgcccctggagcgccctgctgagcgccgccggcagcctgagcttccagggcagagtgagccacatcgaggccgcccccttcaaggcccccgagctgctgcagggccagagcgaggacgagcagcccgacgccagccagcccctgcagctgtgcgagcccctgcacagcatcctgctgaccatgtgcgaggaccagccccacagaagatgcaccctgcagagcgtgctggaggcctgcagagtgcacgagaaggaggtgagcgtgtaccccgcccccgccggcctgcacatcagaagactggtgggcctggtgctgggcaccatcagcgaggtggagaagagagtggtggaggagagcagcagcgtgcagcagaacagaagctacctgctgagaaagagactgagaggcaccagcagcgagagccccgccgcccaggcccccgagtgcctgcacccctgcagagtgagcgagagaagcaccgagacccagagcagccccgagccccactggagcaccctgacccacagccactgcagcctgctggtgaacagagccctgcccggcgccgacccccaggaccagcaggccggcagaagactgagcagcggcagcgtgcacagcgccgccgacagcagctggcccaccacccccagccagagaggcttcctgcagagaagaagcaagttcagcagacccgagttcatcctgctggccggcgaggcccccatgaccctgcacctgcccggcagcgtggtgaccaagaagggcaagagctacctggccctgagagacctgtgcgtggtgctgctgaacggccagcacctggaggtgaagtgcgacgtggagagcaccgtgggcgccgtgttcaacgccgtgaccagcttcgccaacctggaggagctgacctacttcggcctggcctacatgaagagcaaggagttcttcttcctggacagcgagaccagactgtgcaagatcgcccccgagggctggagagagcagccccagaagaccagcatgaacaccttcaccctgttcctgagaatcaagttcttcgtgagccactacggcctgctgcagcacagcctgaccagacaccagttctacctgcagctgagaaaggacatcctggaggagagactgtactgcaacgaggagatcctgctgcagctgggcgtgctggccctgcaggccgagttcggcaactaccccaaggaggtggagagcaagccctacttccacgtggaggactacatccccgccagcctgatcgagagaatgaccgccctgagagtgcaggtggaggtgagcgagatgcacagactgagcagcgccctgtggggcgaggacgccgagctgaagttcctgagagtgacccagcagctgcccgagtacggcgtgctggtgcaccaggtgttcagcgagaagagaagacccgaggaggagatggccctgggcatctgcgccaagggcgtgatcgtgtacgaggtgaagaacaacagcagaatcgccatgctgagattccagtggagagagaccggcaagatcagcacctaccagaagaagttcaccatcaccagcagcgtgaccggcaagaagcacaccttcgtgaccgacagcgccaagaccagcaagtacctgctggacctgtgcagcgcccagcacggcttcaacgcccagatgggcagcggccagcccagccacgtgctgttcgaccacgacaagttcgtgcagatggccaacctgagccccgcccaccaggccagaagcaagcccctgatctggatccagagactgagctgcagcgagaacgagctgttcgtgagcagactgcagggcgccgccggcggcctgctgagcaccagcatggacaacttcaacgtggacggcagcaaggaggccggcgccgagggcatcggcagaagcccctgcaccggcagagagcagctgaagagcgcctgcgtgatccagaagcccatgacctgggacagcctgagcggcccccccgtgcagagcatgcacgccggcagcaagaacaacagaagaaagagcttcatcgccgagcccggcagagagatcgtgagagtgaccctgaagagagacccccacagaggcttcggcttcgtgatcaacgagggcgagtacagcggccaggccgaccccggcatcttcatcagcagcatcatccccggcggccccgccgagaaggccaagaccatcaagcccggcggccagatcctggccctgaaccacatcagcctggagggcttcaccttcaacatggccgtgagaatgatccagaacagccccgacaacatcgagctgatcatcagccagagcaagggcgtgggcggcaacaaccccgacgaggagaagaacagcaccgccaacagcggcgtgagcagcaccgacatcctgagcttcggctaccagggcagcctgctgagccacacccaggaccaggacagaaacaccgaggagctggacatggccggcgtgcagagcctggtgcccagactgagacaccagctgagcttcctgcccctgaagggcgccggcagcagctgcccccccagcccccccgagatcagcgccggcgagatctacttcgtggagctggtgaaggaggacggcaccctgggcttcagcgtgaccggcggcatcaacaccagcgtgccctacggcggcatctacgtgaagagcatcgtgcccggcggccccgccgccaaggagggccagatcctgcagggcgacagactgctgcaggtggacggcgtgatcctgtgcggcctgacccacaagcaggccgtgcagtgcctgaccggccccggccaggtggccagactggtgctggagagaagagtgcccagaagcacccagcagtgccccagcgccaacgacagcatgggcgacgagagaaccgccgtgagcctggtgaccgccctgcccggcagacccagcagctgcgtgagcgtgaccgacggccccaagttcgaggtgaagctgaagaagaacgccaacggcctgggcttcagcttcgtgcagatggagaaggagagctgcagccacctgaagagcgacctggtgagaatcaagagactgttccccggccagcccgccgaggagaacggcgccatcgccgccggcgacatcatcctggccgtgaacggcagaagcaccgagggcctgatcttccaggaggtgctgcacctgctgagaggcgccccccaggaggtgaccctgctgctgtgcagacccccccccggcgccctgcccgagctggagcaggagtggcagacccccgagctgagcgccgacaaggagttcaccagagccacctgcaccgacagctgcaccagccccatcctggaccaggaggacagctggagagacagcgccagccccgacgccggcgagggcctgggcctgagacccgagagcagccagaaggccatcagagaggcccagtggggccagaacagagagagaccctgggccagcagcctgacccacagccccgagagccacccccacctgtgcaagctgcaccaggagagagacgagagcaccctggccaccagcctggagaaggacgtgagacagaactgctacagcgtgtgcgacatcatgagactgggcagatacagcttcagcagccccctgaccagactgagcaccgacatcttctag

SEQ ID NO: 81544 - DNA, 786 bp, Artificial Sequence
  Description of Artificial Sequence: Synthetic coding sequence
atgggcgacgagagaaccgccgtgagcctggtgaccgccctgcccggcagacccagcagctgcgtgagcgtgaccgacggccccaagttcgaggtgaagctgaagaagaacgccaacggcctgggcttcagcttcgtgcagatggagaaggagagctgcagccacctgaagagcgacctggtgagaatcaagagactgttccccggccagcccgccgaggagaacggcgccatcgccgccggcgacatcatcctggccgtgaacggcagaagcaccgagggcctgatcttccaggaggtgctgcacctgctgagaggcgccccccaggaggtgaccctgctgctgtgcagacccccccccggcgccctgcccgagctggagcaggagtggcagacccccgagctgagcgccgacaaggagttcaccagagccacctgcaccgacagctgcaccagccccatcctggaccaggaggacagctggagagacagcgccagccccgacgccggcgagggcctgggcctgagacccgagagcagccagaaggccatcagagaggcccagtggggccagaacagagagagaccctgggccagcagcctgacccacagccccgagagccacccccacctgtgcaagctgcaccaggagagagacgagagcaccctggccaccagcctggagaaggacgtgagacagaactgctacagcgtgtgcgacatcatgagactgggcagatacagcttcagcagccccctgaccagactgagcaccgacatcttctag

SEQ ID NO: 81545 - DNA, 3936 bp, Artificial Sequence
  Description of Artificial Sequence: Synthetic coding sequence
ttcagcagccacagaaccaagagcagcggctggcccccccccagcggcacctggggcctgagccaggtgcccccctacggctgggagatgaccgccaacagagacggcagagactacttcatcaaccacatgacccaggccatccccttcgacgaccccagactggagagctgccagatcatcccccccgcccccagaaaggtggagatgagaagagaccccgtgctgggcttcggcttcgtggccggcagcgagaagcccgtggtggtgagaagcgtgacccccggcggccccagcgagggcaagctgatccccggcgaccagatcgtgatgatcaacgacgagcccgtgagcgccgcccccagagagagagtgatcgacctggtgagaagctgcaaggagagcatcctgctgaccgtgatccagccctaccccagccccaagagcgccttcatcagcgccgccaagaaggccagactgaagagcaaccccgtgaaggtgagattcagcgaggaggtgatcatcaacggccaggtgagcgagaccgtgaaggacaacagcctgctgttcatgcccaacgtgctgaaggtgtacctggagaacggccagaccaagagcttcagattcgactgcagcaccagcatcaaggacgtgatcctgaccctgcaggagaagctgagcatcaagggcatcgagcacttcagcctgatgctggagcagagaaccgagggcgccggcaccaagctgctgctgctgcacgagcaggagaccctgacccaggtgacccagagacccagcagccacaagatgagatgcctgttcagaatcagcttcgtgcccaaggaccccatcgacctgctgagaagagaccccgtggccttcgagtacctgtacgtgcagagctgcaacgacgtggtgcaggagagattcggccccgagctgaagtacgacatcgccctgagactggccgccctgcagatgtacatcgccaccgtgaccaccaagcagacccagaagatcagcctgaagtacatcgagaaggagtggggcctggagaccttcctgcccagcgccgtgctgcagagcatgaaggagaagaacatcaagaaggccctgagccacctggtgaaggccaaccagaacctggtgccccccggcaagaagctgagcgccctgcaggccaaggtgcactacctgaagttcctgagcgacctgagactgtacggcggcagagtgttcaaggccaccctggtgcaggccgagaagagaagcgaggtgaccctgctggtgggccccagatacggcatcagccacgtgatcaacaccaagaccaacctggtggccctgctggccgacttcagccacgtgaacagaatcgagatgttcagcgaggaggagagcctggtgagagtggagctgcacgtgctggacgtgaagcccatcaccctgctgatggagagcagcgacgccatgaacctggcctgcctgaccgccggctactacagactgctggtggacagcagaagaagcatcttcaacatggccaacaagaagaacaccgccacccaggagaccggccccgagaacaagggcaagcacaacctgctgggccccgactggaactgcatcccccagatgaccaccttcatcggcgagggcgagcaggaggcccagatcacctacatcgacagcaagcagaagaccgtggagatcaccgacagcaccatgtgccccaaggagcacagacacctgtacatcgacaacgcctacagcagcgacggcctgaaccagcagctgagccagcccggcgaggccccctgcgaggccgactacagaagcctggcccagagaagcctgctgaccctgagcggccccgagaccctgaagaaggcccaggagagccccagaggcgccaaggtgagcttcatcttcggcgacttcgccctggacgacggcatcagcccccccaccctgggctacgagaccctgctggacgagggccccgagatgctggagaagcagagaaacctgtacatcggcagcgccaacgacatgaagggcctggacctgacccccgaggccgagggcatccagttcgtggagaacagcgtgtacgccaacatcggcgacgtgaagagcttccaggccgccgagggcatcgaggagcccctgctgcacgacatctgctacgccgagaacaccgacgacgccgaggacgaggacgaggtgagctgcgaggaggacctggtggtgggcgagatgaaccagcccgccatcctgaacctgagcggcagcagcgacgacatcatcgacctgaccagcctgcccccccccgagggcgacgacaacgaggacgacttcctgctgagaagcctgaacatggccatcgccgcccccccccccggcttcagagacagcagcgacgaggaggacagccagagccaggccgccagcttccccgaggacaaggagaagggcagcagcctgcagaacgacgagatccccgtgagcctgatcgacgccgtgcccaccagcgccgagggcaagtgcgagaagggcctggacaacgccgtggtgagcaccctgggcgccctggaggccctgagcgtgagcgaggagcagcagaccagcgacaacagcggcgtggccatcctgagagcctacagccccgagagcagcagcgacagcggcaacgagaccaacagcagcgagatgaccgagagcagcgagctggccaccgcccagaagcagagcgagaacctgagcagaatgttcctggccacccacgagggctaccaccccctggccgaggagcagaccgagttccccgccagcaagacccccgccggcggcctgccccccaagagcagccacgccctggccgccagacccgccaccgacctgccccccaaggtggtgcccagcaagcagctgctgcacagcgaccacatggagatggagcccgagaccatggagaccaagagcgtgaccgactacttcagcaagctgcacatgggcagcgtggcctacagctgcaccagcaagagaaagagcaagctggccgacggcgagggcaaggccccccccaacggcaacaccaccggcaagaagcagcagggcaccaagaccgccgagatggaggaggaggccagcggcaagttcggcaccgtgagcagcagagacagccagcacctgagcaccttcaacctggagagaaccgccttcagaaaggacagccagagatggtacgtggccaccgagggcggcatggccgagaagagcggcctggaggccgccaccggcaagaccttccccagagccagcggcctgggcgccagagaggccgagggcaaggaggagggcgcccccgacggcgagaccagcgacggcagcggcctgggccagggcgacagattcctgaccgacgtgacctgcgccagcagcgccaaggacctggacaaccccgaggacgccgacagcagcacctgcgaccaccccagcaagctgcccgaggccgacgagagcgtggccagactgtgcgactaccacctggccaagagaatgagcagcctgcagagcgagggccacttcagcctgcagagcagccagggcagcagcgtggacgccggctgcggcaccggcagcagcggcagcgcctgcgccacccccgtggagagccccctgtgccccagcctgggcaagcacctgatccccgacgccagcggcaagggcgtgaactacatccccagcgaggagagagcccccggcctgcccaaccacggcgccaccttcaaggagctgcacccccagaccgagggcatgtgccccagaatgaccgtgcccgccctgcacaccgccatcaacaccgagcccctgttcggcaccctgagagacggctgccacagactgcccaagatcaaggagaccaccgtgtag

SEQ ID NO: 81546 - DNA, 3969 bp, Artificial Sequence
  Description of Artificial Sequence: Synthetic coding sequence
atggacgtgttcagcttcgtgaagatcgccaagctgagcagccacagaaccaagagcagcggctggcccccccccagcggcacctggggcctgagccaggtgcccccctacggctgggagatgaccgccaacagagacggcagagactacttcatcaaccacatgacccaggccatccccttcgacgaccccagactggagagctgccagatcatcccccccgcccccagaaaggtggagatgagaagagaccccgtgctgggcttcggcttcgtggccggcagcgagaagcccgtggtggtgagaagcgtgacccccggcggccccagcgagggcaagctgatccccggcgaccagatcgtgatgatcaacgacgagcccgtgagcgccgcccccagagagagagtgatcgacctggtgagaagctgcaaggagagcatcctgctgaccgtgatccagccctaccccagccccaagagcgccttcatcagcgccgccaagaaggccagactgaagagcaaccccgtgaaggtgagattcagcgaggaggtgatcatcaacggccaggtgagcgagaccgtgaaggacaacagcctgctgttcatgcccaacgtgctgaaggtgtacctggagaacggccagaccaagagcttcagattcgactgcagcaccagcatcaaggacgtgatcctgaccctgcaggagaagctgagcatcaagggcatcgagcacttcagcctgatgctggagcagagaaccgagggcgccggcaccaagctgctgctgctgcacgagcaggagaccctgacccaggtgacccagagacccagcagccacaagatgagatgcctgttcagaatcagcttcgtgcccaaggaccccatcgacctgctgagaagagaccccgtggccttcgagtacctgtacgtgcagagctgcaacgacgtggtgcaggagagattcggccccgagctgaagtacgacatcgccctgagactggccgccctgcagatgtacatcgccaccgtgaccaccaagcagacccagaagatcagcctgaagtacatcgagaaggagtggggcctggagaccttcctgcccagcgccgtgctgcagagcatgaaggagaagaacatcaagaaggccctgagccacctggtgaaggccaaccagaacctggtgccccccggcaagaagctgagcgccctgcaggccaaggtgcactacctgaagttcctgagcgacctgagactgtacggcggcagagtgttcaaggccaccctggtgcaggccgagaagagaagcgaggtgaccctgctggtgggccccagatacggcatcagccacgtgatcaacaccaagaccaacctggtggccctgctggccgacttcagccacgtgaacagaatcgagatgttcagcgaggaggagagcctggtgagagtggagctgcacgtgctggacgtgaagcccatcaccctgctgatggagagcagcgacgccatgaacctggcctgcctgaccgccggctactacagactgctggtggacagcagaagaagcatcttcaacatggccaacaagaagaacaccgccacccaggagaccggccccgagaacaagggcaagcacaacctgctgggccccgactggaactgcatcccccagatgaccaccttcatcggcgagggcgagcaggaggcccagatcacctacatcgacagcaagcagaagaccgtggagatcaccgacagcaccatgtgccccaaggagcacagacacctgtacatcgacaacgcctacagcagcgacggcctgaaccagcagctgagccagcccggcgaggccccctgcgaggccgactacagaagcctggcccagagaagcctgctgaccctgagcggccccgagaccctgaagaaggcccaggagagccccagaggcgccaaggtgagcttcatcttcggcgacttcgccctggacgacggcatcagcccccccaccctgggctacgagaccctgctggacgagggccccgagatgctggagaagcagagaaacctgtacatcggcagcgccaacgacatgaagggcctggacctgacccccgaggccgagggcatccagttcgtggagaacagcgtgtacgccaacatcggcgacgtgaagagcttccaggccgccgagggcatcgaggagcccctgctgcacgacatctgctacgccgagaacaccgacgacgccgaggacgaggacgaggtgagctgcgaggaggacctggtggtgggcgagatgaaccagcccgccatcctgaacctgagcggcagcagcgacgacatcatcgacctgaccagcctgcccccccccgagggcgacgacaacgaggacgacttcctgctgagaagcctgaacatggccatcgccgcccccccccccggcttcagagacagcagcgacgaggaggacagccagagccaggccgccagcttccccgaggacaaggagaagggcagcagcctgcagaacgacgagatccccgtgagcctgatcgacgccgtgcccaccagcgccgagggcaagtgcgagaagggcctggacaacgccgtggtgagcaccctgggcgccctggaggccctgagcgtgagcgaggagcagcagaccagcgacaacagcggcgtggccatcctgagagcctacagccccgagagcagcagcgacagcggcaacgagaccaacagcagcgagatgaccgagagcagcgagctggccaccgcccagaagcagagcgagaacctgagcagaatgttcctggccacccacgagggctaccaccccctggccgaggagcagaccgagttccccgccagcaagacccccgccggcggcctgccccccaagagcagccacgccctggccgccagacccgccaccgacctgccccccaaggtggtgcccagcaagcagctgctgcacagcgaccacatggagatggagcccgagaccatggagaccaagagcgtgaccgactacttcagcaagctgcacatgggcagcgtggcctacagctgcaccagcaagagaaagagcaagctggccgacggcgagggcaaggccccccccaacggcaacaccaccggcaagaagcagcagggcaccaagaccgccgagatggaggaggaggccagcggcaagttcggcaccgtgagcagcagagacagccagcacctgagcaccttcaacctggagagaaccgccttcagaaaggacagccagagatggtacgtggccaccgagggcggcatggccgagaagagcggcctggaggccgccaccggcaagaccttccccagagccagcggcctgggcgccagagaggccgagggcaaggaggagggcgcccccgacggcgagaccagcgacggcagcggcctgggccagggcgacagattcctgaccgacgtgacctgcgccagcagcgccaaggacctggacaaccccgaggacgccgacagcagcacctgcgaccaccccagcaagctgcccgaggccgacgagagcgtggccagactgtgcgactaccacctggccaagagaatgagcagcctgcagagcgagggccacttcagcctgcagagcagccagggcagcagcgtggacgccggctgcggcaccggcagcagcggcagcgcctgcgccacccccgtggagagccccctgtgccccagcctgggcaagcacctgatccccgacgccagcggcaagggcgtgaactacatccccagcgaggagagagcccccggcctgcccaaccacggcgccaccttcaaggagctgcacccccagaccgagggcatgtgccccagaatgaccgtgcccgccctgcacaccgccatcaacaccgagcccctgttcggcaccctgagagacggctgccacagactgcccaagatcaaggagaccaccgtgtag

SEQ ID NO: 81547 - DNA, 3942 bp, Artificial Sequence
  Description of Artificial Sequence: Synthetic coding sequence
aagagccacagcccccacagaaccaagagcagcggctggcccccccccagcggcacctggggcctgagccaggtgcccccctacggctgggagatgaccgccaacagagacggcagagactacttcatcaaccacatgacccaggccatccccttcgacgaccccagactggagagctgccagatcatcccccccgcccccagaaaggtggagatgagaagagaccccgtgctgggcttcggcttcgtggccggcagcgagaagcccgtggtggtgagaagcgtgacccccggcggccccagcgagggcaagctgatccccggcgaccagatcgtgatgatcaacgacgagcccgtgagcgccgcccccagagagagagtgatcgacctggtgagaagctgcaaggagagcatcctgctgaccgtgatccagccctaccccagccccaagagcgccttcatcagcgccgccaagaaggccagactgaagagcaaccccgtgaaggtgagattcagcgaggaggtgatcatcaacggccaggtgagcgagaccgtgaaggacaacagcctgctgttcatgcccaacgtgctgaaggtgtacctggagaacggccagaccaagagcttcagattcgactgcagcaccagcatcaaggacgtgatcctgaccctgcaggagaagctgagcatcaagggcatcgagcacttcagcctgatgctggagcagagaaccgagggcgccggcaccaagctgctgctgctgcacgagcaggagaccctgacccaggtgacccagagacccagcagccacaagatgagatgcctgttcagaatcagcttcgtgcccaaggaccccatcgacctgctgagaagagaccccgtggccttcgagtacctgtacgtgcagagctgcaacgacgtggtgcaggagagattcggccccgagctgaagtacgacatcgccctgagactggccgccctgcagatgtacatcgccaccgtgaccaccaagcagacccagaagatcagcctgaagtacatcgagaaggagtggggcctggagaccttcctgcccagcgccgtgctgcagagcatgaaggagaagaacatcaagaaggccctgagccacctggtgaaggccaaccagaacctggtgccccccggcaagaagctgagcgccctgcaggccaaggtgcactacctgaagttcctgagcgacctgagactgtacggcggcagagtgttcaaggccaccctggtgcaggccgagaagagaagcgaggtgaccctgctggtgggccccagatacggcatcagccacgtgatcaacaccaagaccaacctggtggccctgctggccgacttcagccacgtgaacagaatcgagatgttcagcgaggaggagagcctggtgagagtggagctgcacgtgctggacgtgaagcccatcaccctgctgatggagagcagcgacgccatgaacctggcctgcctgaccgccggctactacagactgctggtggacagcagaagaagcatcttcaacatggccaacaagaagaacaccgccacccaggagaccggccccgagaacaagggcaagcacaacctgctgggccccgactggaactgcatcccccagatgaccaccttcatcggcgagggcgagcaggaggcccagatcacctacatcgacagcaagcagaagaccgtggagatcaccgacagcaccatgtgccccaaggagcacagacacctgtacatcgacaacgcctacagcagcgacggcctgaaccagcagctgagccagcccggcgaggccccctgcgaggccgactacagaagcctggcccagagaagcctgctgaccctgagcggccccgagaccctgaagaaggcccaggagagccccagaggcgccaaggtgagcttcatcttcggcgacttcgccctggacgacggcatcagcccccccaccctgggctacgagaccctgctggacgagggccccgagatgctggagaagcagagaaacctgtacatcggcagcgccaacgacatgaagggcctggacctgacccccgaggccgagggcatccagttcgtggagaacagcgtgtacgccaacatcggcgacgtgaagagcttccaggccgccgagggcatcgaggagcccctgctgcacgacatctgctacgccgagaacaccgacgacgccgaggacgaggacgaggtgagctgcgaggaggacctggtggtgggcgagatgaaccagcccgccatcctgaacctgagcggcagcagcgacgacatcatcgacctgaccagcctgcccccccccgagggcgacgacaacgaggacgacttcctgctgagaagcctgaacatggccatcgccgcccccccccccggcttcagagacagcagcgacgaggaggacagccagagccaggccgccagcttccccgaggacaaggagaagggcagcagcctgcagaacgacgagatccccgtgagcctgatcgacgccgtgcccaccagcgccgagggcaagtgcgagaagggcctggacaacgccgtggtgagcaccctgggcgccctggaggccctgagcgtgagcgaggagcagcagaccagcgacaacagcggcgtggccatcctgagagcctacagccccgagagcagcagcgacagcggcaacgagaccaacagcagcgagatgaccgagagcagcgagctggccaccgcccagaagcagagcgagaacctgagcagaatgttcctggccacccacgagggctaccaccccctggccgaggagcagaccgagttccccgccagcaagacccccgccggcggcctgccccccaagagcagccacgccctggccgccagacccgccaccgacctgccccccaaggtggtgcccagcaagcagctgctgcacagcgaccacatggagatggagcccgagaccatggagaccaagagcgtgaccgactacttcagcaagctgcacatgggcagcgtggcctacagctgcaccagcaagagaaagagcaagctggccgacggcgagggcaaggccccccccaacggcaacaccaccggcaagaagcagcagggcaccaagaccgccgagatggaggaggaggccagcggcaagttcggcaccgtgagcagcagagacagccagcacctgagcaccttcaacctggagagaaccgccttcagaaaggacagccagagatggtacgtggccaccgagggcggcatggccgagaagagcggcctggaggccgccaccggcaagaccttccccagagccagcggcctgggcgccagagaggccgagggcaaggaggagggcgcccccgacggcgagaccagcgacggcagcggcctgggccagggcgacagattcctgaccgacgtgacctgcgccagcagcgccaaggacctggacaaccccgaggacgccgacagcagcacctgcgaccaccccagcaagctgcccgaggccgacgagagcgtggccagactgtgcgactaccacctggccaagagaatgagcagcctgcagagcgagggccacttcagcctgcagagcagccagggcagcagcgtggacgccggctgcggcaccggcagcagcggcagcgcctgcgccacccccgtggagagccccctgtgccccagcctgggcaagcacctgatccccgacgccagcggcaagggcgtgaactacatccccagcgaggagagagcccccggcctgcccaaccacggcgccaccttcaaggagctgcacccccagaccgagggcatgtgccccagaatgaccgtgcccgccctgcacaccgccatcaacaccgagcccctgttcggcaccctgagagacggctgccacagactgcccaagatcaaggagaccaccggctag

SEQ ID NO: 81548 - DNA, 1794 bp, Artificial Sequence
  Description of Artificial Sequence: Synthetic coding sequence
atgttcgccagctgccactgcgtgcccagaggcagaagaaccatgaagatgatccacttcagaagcagcagcgtgaagagcctgagccaggagatgagatgcaccatcagactgctggacgacagcgagatcagctgccacatccagagagagaccaagggccagttcctgatcgaccacatctgcaactactacagcctgctggagaaggactacttcggcatcagatacgtggaccccgagaagcagagacactggctggagcccaacaagagcatcttcaagcagatgaagacccaccccccctacaccatgtgcttcagagtgaagttctacccccacgagcccctgaagatcaaggaggagctgaccagatacctgctgtacctgcagatcaagagagacatcttccacggcagactgctgtgcagcttcagcgacgccgcctacctgggcgcctgcatcgtgcaggccgagctgggcgactacgaccccgacgagcaccccgagaactacatcagcgagttcgagatcttccccaagcagagccagaagctggagagaaagatcgtggagatccacaagaacgagctgagaggccagagcccccccgtggccgagttcaacctgctgctgaaggcccacaccctggagacctacggcgtggacccccacccctgcaaggacagcaccggcaccaccaccttcctgggcttcaccgccgccggcttcgtggtgttccagggcaacaagagaatccacctgatcaagtggcccgacgtgtgcaagctgaagttcgagggcaagaccttctacgtgatcggcacccagaaggagaagaaggccatgctggccttccacaccagcacccccgccgcctgcaagcacctgtggaagtgcggcgtggagaaccaggccttctacaagtacgccaagagcagccagatcaagaccgtgagcagcagcaagatcttcttcaagggcagcagattcagatacagcggcaaggtggccaaggaggtggtggaggccagcagcaagatccagagagagccccccgaggtgcacagagccaacatcacccagagcagaagcagccacagcctgaacaagcagctgatcatcaacatggagcccctgcagcccctgctgcccagccccagcgagcaggaggaggagctgcccctgggcgagggcgtgcccctgcccaaggaggagaacatcagcgcccccctgatcagcagcagccccgtgaaggccgccagagagtacgaggacccccccagcgaggaggaggacaagatcaaggaggagcccctgaccatcagcgagctggtgtacaaccccagcgccagcctgctgcccacccccgtggacgacgacgagatcgacatgctgttcgactgccccagcagactggagctggagagagaggacaccgacagcttcgaggacctggaggccgacgagaacgccttcctgatcgccgaggaggaggagctgaaggaggccagaagagccctgagctggagctacgacatcctgaccggccacatcagagtgaaccccctggtgaagagcttcagcagactgctggtggtgggcctgggcctgctgctgttcgtgttccccctgctgctgctgctgctggagagcggcatcgacctgagcttcctgtgcgagatcagacagacccccgagttcgagcagttccactacgagtactactgccccctgaaggagtgggtggccggcaaggtgcacctgatcctgtacatgctgggctgcagctag

SEQ ID NO: 81549 - DNA, 642 bp, Artificial Sequence
  Description of Artificial Sequence: Synthetic coding sequence
atgcaggccgaggagaccaagggcatcggcatcaccagcatggccaagtgcctggtgaagatccagaccagaagaagcctgcagctgcacatggtgaaccactgcaacagcaacgtgttcgtgagactgctgagactgggcagcaaggtgaccgccagaaacaccggcgtgcccctgcccaaggaggagaacatcagcgcccccctgatcagcagcagccccgtgaaggccgccagagagtacgaggacccccccagcgaggaggaggacaagatcaaggaggagcccctgaccatcagcgagctggtgtacaaccccagcgccagcctgctgcccacccccgtggacgacgacgagatcgacatgctgttcgactgccccagcagactggagctggagagagaggacaccgacagcttcgaggacctggaggccgacgagaacgccttcctgatcgccgaggaggaggagctgaaggaggccagaagagccctgagctggagctacgacatcctgaccggccacatcagagtgaaccccctggtgaagagcttcagcagactgctggtggtgggcctgggcctgctgctgttcgtgttccccctgctgctgctgctgctggagagcgtgagcatgcagtag

SEQ ID NO: 81550 - DNA, 804 bp, Artificial Sequence
  Description of Artificial Sequence: Synthetic coding sequence
atgtgcttcagagtgaagttctacccccacgagcccctgaagatcaaggaggagctgaccagatacctgctgtacctgcagatcaagagagacatcttccacggcagactgctgtgcagcttcagcgacgccgcctacctgggcgcctgcatcgtgcaggccgagctgggcgactacgaccccgacgagcaccccgagaactacatcagcgagttcgagatcttccccaagcagagccagaagctggagagaaagatcgtggagatccacaagaacgagctgagaggccagagcccccccgtggccgagttcaacctgctgctgaaggcccacaccctggagacctacggcgtggacccccacccctgcaaggacagcaccggcaccaccaccttcctgggcttcaccgccgccggcttcgtggtgttccagggcaacaagagaatccacctgatcaagtggcccgacgtgtgcaagctgaagttcgagggcaagaccttctacgtgatcggcacccagaaggagaagaaggccatgctggccttccacaccagcacccccgccgcctgcaagcacctgtggaagtgcggcgtggagaaccaggccttctacaagtacgccaagagcagccagatcaagaccgtgagcagcagcaagatcttcttcaagggcagcagattcagatacagcggcaaggtggccaaggaggtggtggaggccagcagcaagatccagagagagccccccgaggtgcacagatgcgtgcagaagaagatctgcagctgcttcggcgtgacctggtag

SEQ ID NO: 81551 - DNA, 1089 bp, Artificial Sequence
  Description of Artificial Sequence: Synthetic coding sequence
atggtgttcagaagaggccagagcccccccgtggccgagttcaacctgctgctgaaggcccacaccctggagacctacggcgtggacccccacccctgcaaggacagcaccggcaccaccaccttcctgggcttcaccgccgccggcttcgtggtgttccagggcaacaagagaatccacctgatcaagtggcccgacgtgtgcaagctgaagttcgagggcaagaccttctacgtgatcggcacccagaaggagaagaaggccatgctggccttccacaccagcacccccgccgcctgcaagcacctgtggaagtgcggcgtggagaaccaggccttctacaagtacgccaagagcagccagatcaagaccgtgagcagcagcaagatcttcttcaagggcagcagattcagatacagcggcaaggtggccaaggaggtggtggaggccagcagcaagatccagagagagccccccgaggtgcacagagccaacatcacccagagcagaagcagccacagcctgaacaagcagctgatcatcaacatggagcccctgcagcccctgctgcccagccccagcgagcaggaggaggagctgcccctgggcgagggcgtgcccctgcccaaggaggagaacatcagcgcccccctgatcagcagcagccccgtgaaggccgccagagagtacgaggacccccccagcgaggaggaggacaagatcaaggaggagcccctgaccatcagcgagctggtgtacaaccccagcgccagcctgctgcccacccccgtggacgacgacgagatcgacatgctgttcgactgccccagcagactggagctggagagagaggacaccgacagcttcgaggacctggaggccgacgagaacgccttcctgatcgccgaggaggaggagctgaaggaggccagaagagccctgagctggagctacgacatcctgaccggccacatcagagtgaaccccctggtgaagagcttcagcagactgctggtggtgggcctgggcctgctgctgttcgtgttccccctgctgctgctgctgctggagagcgtgagcatgcagtag

SEQ ID NO: 81552 - DNA, 1671 bp, Artificial Sequence
  Description of Artificial Sequence: Synthetic coding sequence
atgttcgccagctgccactgcgtgcccagaggcagaagaaccatgaagatgatccacttcagaagcagcagcgtgaagagcctgagccaggagatgagatgcaccatcagactgctggacgacagcgagatcagctgccacatccagagagagaccaagggccagttcctgatcgaccacatctgcaactactacagcctgctggagaaggactacttcggcatcagatacgtggaccccgagaagcagagacactggctggagcccaacaagagcatcttcaagcagatgaagacccaccccccctacaccatgtgcttcagagtgaagttctacccccacgagcccctgaagatcaaggaggagctgaccagatacctgctgtacctgcagatcaagagagacatcttccacggcagactgctgtgcagcttcagcgacgccgcctacctgggcgcctgcatcgtgcaggccgagctgggcgactacgaccccgacgagcaccccgagaactacatcagcgagttcgagatcttccccaagcagagccagaagctggagagaaagatcgtggagatccacaagaacgagctgagaggccagagcccccccgtggccgagttcaacctgctgctgaaggcccacaccctggagacctacggcgtggacccccacccctgcaaggacagcaccggcaccaccaccttcctgggcttcaccgccgccggcttcgtggtgttccagggcaacaagagaatccacctgatcaagtggcccgacgtgtgcaagctgaagttcgagggcaagaccttctacgtgatcggcacccagaaggagaagaaggccatgctggccttccacaccagcacccccgccgcctgcaagcacctgtggaagtgcggcgtggagaaccaggccttctacaagtacgccaagagcagccagatcaagaccgtgagcagcagcaagatcttcttcaagggcagcagattcagatacagcggcaaggtggccaaggaggtggtggaggccagcagcaagatccagagagagccccccgaggtgcacagagccaacatcacccagagcagaagcagccacagcctgaacaagcagctgatcatcaacatggagcccctgcagcccctgctgcccagccccagcgagcaggaggaggagctgcccctgggcgagggcgtgcccctgcccaaggaggagaacatcagcgcccccctgatcagcagcagccccgtgaaggccgccagagagtacgaggacccccccagcgaggaggaggacaagatcaaggaggagcccctgaccatcagcgagctggtgtacaaccccagcgccagcctgctgcccacccccgtggacgacgacgagatcgacatgctgttcgactgccccagcagactggagctggagagagaggacaccgacagcttcgaggacctggaggccgacgagaacgccttcctgatcgccgaggaggaggagctgaaggaggccagaagagccctgagctggagctacgacatcctgaccggccacatcagagtgaaccccctggtgaagagcttcagcagactgctggtggtgggcctgggcctgctgctgttcgtgttccccctgctgctgctgctgctggagagcgtgagcatgcagtag

SEQ ID NO: 81553 - DNA, 423 bp, Artificial Sequence
  Description of Artificial Sequence: Synthetic coding sequence
ggcaccaccaccttcctgggcttcaccgccgccggcttcgtggtgttccagggcaacaagagaatccacctgatcaagtggcccgacgtgtgcaagctgaagttcgagggcaagaccttctacgtgatcggcacccagaaggagaagaaggccatgctggccttccacaccagcacccccgccgcctgcaagcacctgtggaagtgcggcgtggagaaccaggccttctacaagtacgccaagagcagccagatcaagaccgtgagcagcagcaagatcttcttcaagggcagcagattcagatacagcggcaaggtggccaaggaggtggtggaggccagcagcaagatccagagagagccccccgaggtgcacagatgcgtgcagaagaagatctgcagctgcttcggcgtgacctggtag

SEQ ID NO: 81554 - DNA, 2145 bp, Artificial Sequence
  Description of Artificial Sequence: Synthetic coding sequence
atgctgcacctgaaggtgcagttcctggacgacagccagaagatcttcgtggtggaccagaagagcagcggcaaggccctgttcaacctgagctgcagccacctgaacctggccgagaaggagtacttcggcctggagttctgcagccacagcggcaacaacgtgtggctggagctgctgaagcccatcaccaagcaggtgaagaaccccaaggagatcgtgttcaagttcatggtgaagttcttccccgtggaccccggccacctgagagaggagctgaccagatacctgttcaccctgcagatcaagaaggacctggccctgggcagactgccctgcagcgacaactgcaccgccctgatggtgagccacatcctgcagagcgagctgggcgacttccacgaggagaccgacagaaagcacctggcccagaccagatacctgcccaaccaggactgcctggagggcaagatcatgcacttccaccagaagcacatcggcagaagccccgccgagagcgacatcctgctgctggacatcgccagaaagctggacatgtacggcatcagaccccaccccgccagcgacggcgagggcatgcagatccacctggccgtggcccacatgggcgtgctggtgctgagaggcaacaccaagatcaacaccttcaactgggccaagatcagaaagctgagcttcaagagaaagcacttcctgatcaagctgcacgccaacatcctggtgctgtgcaaggacaccctggagttcaccatggccagcagagacgcctgcaaggccttctggaagacctgcgtggagtaccacgccttcttcagactgagcgaggagcccaagagcaagcccaagaccctgctgtgcagcaagggcagcagcttcagatacagcggcagaacccagagacagctgctggagtacggcagaaagggcagactgaagagcctgcccttcgagagaaagcactaccccagccagtaccacgagagacagtgcagaagcagccccgacctgctgagcgacgtgagcaagcaggtggaggacctgagactggcctacggcggcggctactaccagaacgtgaacggcgtgcacgccagcgagcccgtgctggagagcagaagaagaaacagcgccctggaggtgaccttcgccaccgagctggagcacagcaagcccgaggccgaccccaccctgctgcaccagagccagagcagcagcagcttccccttcatctacatggaccccgtgttcaacaccgagcccaaccccaaccccgaccccagagacatcttcagcgagagaagcagcctgagcagcttccagaccagctgcaagttcagcggcaaccacatgagcatctacagcggcctgaccagcaaggtgagacccgccaagcagctgacctacaccgacgtgccctacatcccctgcaccggccagcaggtgggcatcatgcccccccaggtgttcttctacgtggacaagcccccccaggtgcccagatggagccccatcagagccgaggagagaaccagcccccacagctacgtggagcccaccgccatgaagcccgccgagagaagccccagaaacatcagaatgaagagcttccagcaggacctgcaggtgctgcaggaggccatcgccagaaccagcggcagaagcaacatcaacgtgggcctggaggaggaggaccccaacctggaggacgccttcgtgtgcaacatccaggagcagacccccaagagaagccagagccagagcgacatgaagaccatcagattccccttcggcagcgagttcagacccctgggcccctgccccgccctgagccacaaggccgacctgttcaccgacatgttcgccgagcaggagctgcccgccgtgctgatggaccagagcaccgccgagagatacgtggccagcgagagcagcgacagcgagagcgagatcctgaagcccgactactacgccctgtacggcaaggagatcagaagccccatggccagaatcagactgagcagcggcagcctgcagctggacgaggaggacgaggacgcctacttcaacacccccaccgccgaggacagaaccagcctgaagccctgcaactacttcctggcctag

SEQ ID NO: 81555 - DNA, 1785 bp, Artificial Sequence
  Description of Artificial Sequence: Synthetic coding sequence
atggtgagccacatcctgcagagcgagctgggcgacttccacgaggagaccgacagaaagcacctggcccagaccagatacctgcccaaccaggactgcctggagggcaagatcatgcacttccaccagaagcacatcggcagaagccccgccgagagcgacatcctgctgctggacatcgccagaaagctggacatgtacggcatcagaccccaccccgccagcgacggcgagggcatgcagatccacctggccgtggcccacatgggcgtgctggtgctgagaggcaacaccaagatcaacaccttcaactgggccaagatcagaaagctgagcttcaagagaaagcacttcctgatcaagctgcacgccaacatcctggtgctgtgcaaggacaccctggagttcaccatggccagcagagacgcctgcaaggccttctggaagacctgcgtggagtaccacgccttcttcagactgagcgaggagcccaagagcaagcccaagaccctgctgtgcagcaagggcagcagcttcagatacagcggcagaacccagagacagctgctggagtacggcagaaagggcagactgaagagcctgcccttcgagagaaagcactaccccagccagtaccacgagagacagtgcagaagcagccccgacctgctgagcgacgtgagcaagcaggtggaggacctgagactggcctacggcggcggctactaccagaacgtgaacggcgtgcacgccagcgagcccgtgctggagagcagaagaagaaacagcgccctggaggtgaccttcgccaccgagctggagcacagcaagcccgaggccgaccccaccctgctgcaccagagccagagcagcagcagcttccccttcatctacatggaccccgtgttcaacaccgagcccaaccccaaccccgaccccagagacatcttcagcgagagaagcagcctgagcagcttccagaccagctgcaagttcagcggcaaccacatgagcatctacagcggcctgaccagcaaggtgagacccgccaagcagctgacctacaccgacgtgccctacatcccctgcaccggccagcaggtgggcatcatgcccccccaggtgttcttctacgtggacaagcccccccaggtgcccagatggagccccatcagagccgaggagagaaccagcccccacagctacgtggagcccaccgccatgaagcccgccgagagaagccccagaaacatcagaatgaagagcttccagcaggacctgcaggtgctgcaggaggccatcgccagaaccagcggcagaagcaacatcaacgtgggcctggaggaggaggaccccaacctggaggacgccttcgtgtgcaacatccaggagcagacccccaagagaagccagagccagagcgacatgaagaccatcagattccccttcggcagcgagttcagacccctgggcccctgccccgccctgagccacaaggccgacctgttcaccgacatgttcgccgagcaggagctgcccgccgtgctgatggaccagagcaccgccgagagatacgtggccagcgagagcagcgacagcgagagcgagatcctgaagcccgactactacgccctgtacggcaaggagatcagaagccccatggccagaatcagactgagcagcggcagcctgcagctggacgaggaggacgaggacgcctacttcaacacccccaccgccgaggacagaaccagcctgaagccctgcaactacttcctggcctag

SEQ ID NO: 81556 - DNA, 2043 bp, Artificial Sequence
  Description of Artificial Sequence: Synthetic coding sequence
atggccctggacggcatcagaatgcccgacggctgctacgccgacggcacctgggagctgagcgtgcacgtgaccgacctgaacagagacgtgaccctgagagtgaccggcgaggtgcacatcggcggcgtgatgctgaagctggtggagaagctggacgtgaagaaggactggagcgaccacgccctgtggtgggagaagaagagaacctggctgctgaagacccactggaccctggacaagtacggcatccaggccgacgccaagctgcagttcaccccccagcacaagctgctgagactgcagctgcccaacatgaagtacgtgaaggtgaaggtgaacttcagcgacagagtgttcaaggccgtgagcgacatctgcaagaccttcaacatcagacaccccgaggagctgagcctgctgaagaagcccagagaccccaccaagaagaagaagaagaagctggacgaccagagcgaggacgaggccctggagctggagggccccctgatcacccccggcagcggcagcatctacagcagccccggcctgtacagcaagaccatgacccccacctacgacgcccacgacggcagccccctgagccccaccagcgcctggttcggcgacagcgccctgagcgagggcaaccccggcatcctggccgtgagccagcccatcaccagccccgagatcctggccaagatgttcaagccccaggccctgctggacaaggccaagatcaaccagggctggctggacagcagcagaagcctgatggagcaggacgtgaaggagaacgaggccctgctgctgagattcaagtactacagcttcttcgacctgaaccccaagtacgacgccatcagaatcaaccagctgtacgagcaggccaagtgggccatcctgctggaggagatcgagtgcaccgaggaggagatgatgatgttcgccgccctgcagtaccacatcaacaagctgagcatcatgaccagcgagaaccacctgaacaacagcgacaaggaggtggacgaggtggacgccgccctgagcgacctggagatcaccctggagggcggcaagaccagcaccatcctgggcgacatcaccagcatccccgagctggccgactacatcaaggtgttcaagcccaagaagctgaccctgaagggctacaagcagtactggtgcaccttcaaggacaccagcatcagctgctacaagagcaaggaggagagcagcggcacccccgcccaccagatgaacctgagaggctgcgaggtgacccccgacgtgaacatcagcggccagaagttcaacatcaagctgctgatccccgtggccgagggcatgaacgagatctggctgagatgcgacaacgagaagcagtacgcccactggatggccgcctgcagactggccagcaagggcaagaccatggccgacagcagctacaacctggaggtgcagaacatcctgagcttcctgaagatgcagcacctgaaccccgacccccagctgatccccgagcagatcaccaccgacatcacccccgagtgcctggtgagccccagatacctgaagaagtacaagaacaagcagatcaccgccagaatcctggaggcccaccagaacgtggcccagatgagcctgatcgaggccaagatgagattcatccaggcctggcagagcctgcccgagttcggcatcacccacttcatcgccagattccagggcggcaagaaggaggagctgatcggcatcgcctacaacagactgatcagaatggacgccagcaccggcgacgccatcaagacctggagattcagcaacatgaagcagtggaacgtgaactgggagatcaagatggtgaccgtggagttcgccgacgaggtgagactgagcttcatctgcaccgaggtggactgcaaggtggtgcacgagttcatcggcggctacatcttcctgagcaccagagccaaggaccagaacgagagcctggacgaggagatgttctacaagctgaccagcggctgggtgtag

SEQ ID NO: 81557 - DNA, 2064 bp, Artificial Sequence
  Description of Artificial Sequence: Synthetic coding sequence
atggccctggacggcatcagaatgcccgacggctgctacgccgacggcacctgggagctgagcgtgcacgtgaccgacctgaacagagacgtgaccctgagagtgaccggcgaggtgcacatcggcggcgtgatgctgaagctggtggagaagctggacgtgaagaaggactggagcgaccacgccctgtggtgggagaagaagagaacctggctgctgaagacccactggaccctggacaagtacggcatccaggccgacgccaagctgcagttcaccccccagcacaagctgctgagactgcagctgcccaacatgaagtacgtgaaggtgaaggtgaacttcagcgacagagtgttcaaggccgtgagcgacatctgcaagaccttcaacatcagacaccccgaggagctgagcctgctgaagaagcccagagaccccaccaagaagaagaagaagaagctggacgaccagagcgaggacgaggccctggagctggagggccccctgatcacccccggcagcggcagcatctacagcagccccggcctgtacagcaagaccatgacccccacctacgacgcccacgacggcagccccctgagccccaccagcgcctggttcggcgacagcgccctgagcgagggcaaccccggcatcctggccgtgagccagcccatcaccagccccgagatcctggccaagatgttcaagccccaggccctgctggacaaggccaagatcaaccagggctggctggacagcagcagaagcctgatggagcaggacgtgaaggagaacgaggccctgctgctgagattcaagtactacagcttcttcgacctgaaccccaagtacgacgccatcagaatcaaccagctgtacgagcaggccaagtgggccatcctgctggaggagatcgagtgcaccgaggaggagatgatgatgttcgccgccctgcagtaccacatcaacaagctgagcatcatgaccagcgagaaccacctgaacaacagcgacaaggaggtggacgaggtggacgccgccctgagcgacctggagatcaccctggagggcggcaagaccagcaccatcctgggcgacatcaccagcatccccgagctggccgactacatcaaggtgttcaagcccaagaagctgaccctgaagggctacaagcagtactggtgcaccttcaaggacaccagcatcagctgctacaagagcaaggaggagagcagcggcacccccgcccaccagatgaacctgagaggctgcgaggtgacccccgacgtgaacatcagcggccagaagttcaacatcaagctgctgatccccgtggccgagggcatgaacgagatctggctgagatgcgacaacgagaagcagtacgcccactggatggccgcctgcagactggccagcaagggcaagaccatggccgacagcagctacaacctggaggtgcagaacatcctgagcttcctgaagatgcagcacctgaaccccgacccccagctgatccccgagcagatcaccaccgacatcacccccgagtgcctggtgagccccagatacctgaagaagtacaagaacaagcagcccggctacatcagagacctgatcaccgccagaatcctggaggcccaccagaacgtggcccagatgagcctgatcgaggccaagatgagattcatccaggcctggcagagcctgcccgagttcggcatcacccacttcatcgccagattccagggcggcaagaaggaggagctgatcggcatcgcctacaacagactgatcagaatggacgccagcaccggcgacgccatcaagacctggagattcagcaacatgaagcagtggaacgtgaactgggagatcaagatggtgaccgtggagttcgccgacgaggtgagactgagcttcatctgcaccgaggtggactgcaaggtggtgcacgagttcatcggcggctacatcttcctgagcaccagagccaaggaccagaacgagagcctggacgaggagatgttctacaagctgaccagcggctgggtgtag

SEQ ID NO: 81558 - DNA, 2043 bp, Artificial Sequence; identical to SEQ ID NO: 81556
  Description of Artificial Sequence: Synthetic coding sequence

SEQ ID NO: 81559 - DNA, 1902 bp, Artificial Sequence
  Description of Artificial Sequence: Synthetic coding sequence
atggccctggacggcatcagaatgcccgacggctgctacgccgacggcacctgggagctgagcgtgcacgtgaccgacctgaacagagacgtgaccctgagagtgaccggcgaggtgcacatcggcggcgtgatgctgaagctggtggagaagctggacgtgaagaaggactggagcgaccacgccctgtggtgggagaagaagagaacctggctgctgaagacccactggaccctggacaagtacggcatccaggccgacgccaagctgcagttcaccccccagcacaagctgctgagactgcagctgcccaacatgaagtacgtgaaggtgaaggtgaacttcagcgacagagtgttcaaggccgtgagcgacatctgcaagaccttcaacatcagacaccccgaggagctgagcctgctgaagaagcccagagaccccaccaagaagaagaagaagaagctggacgaccagagcgaggacgaggccctggagctggagggccccctgatcacccccggcagcggcagcatctacagcagccccggcctgtacagcaagaccatgacccccacctacgacgcccacgacggcagccccctgagccccaccagcgcctggttcggcgacagcgccctgagcgagggcaaccccggcatcctggccgtgagccagcccatcaccagccccgagatcctggccaagatgttcaagccccaggccctgctggacaaggccaagatcaaccagggctggctggacagcagcagaagcctgatggagcaggacgtgaaggagaacgaggccctgctgctgagattcaagtactacagcttcttcgacctgaaccccaagtacgacgccatcagaatcaaccagctgtacgagcaggccaagtgggccatcctgctggaggagatcgagtgcaccgaggaggagatgatgatgttcgccgccctgcagtaccacatcaacaagctgagcatcatgaccagcgagaaccacctgaacaacagcgacaaggaggtggacgaggtggacgccgccctgagcgacctggagatcaccctggagggcggcaagaccagcaccatcctgggcgacatcaccagcatccccgagctggccgactacatcaaggtgttcaagcccaagaagctgaccctgaagggctacaagcagtactggtgcaccttcaaggacaccagcatcagctgctacaagagcaaggaggagagcagcggcacccccgcccaccagatgaacctgagaggctgcgaggtgacccccgacgtgaacatcagcggccagaagttcaacatcaagctgctgatccccgtggccgagggcatgaacgagatctggctgagatgcgacaacgagaagcagtacgcccactggatggccgcctgcagactggccagcaagggcaagaccatggccgacagcagctacaacctggaggtgcagaacatcctgagcttcctgaagatgcagcacctgaaccccgacccccagctgatccccgagcagatcaccaccgacatcacccccgagtgcctggtgagccccagatacctgaagaagtacaagaacaagcagcccggctacatcagagacctgatcaccgccagaatcctggaggcccaccagaacgtggcccagatgagcctgatcgaggccaagatgagattcatccaggcctggcagagcctgcccgagttcggcatcacccacttcatcgccagattccagggcggcaagaaggaggagctgatcggcatcgcctacaacagactgatcagaatggacgccagcaccggcgacgccatcaagacctggagattcagcaacatgaagcagtggaacgtgaactgggagatcaagatggtgaacagctag

SEQ ID NO: 81560 - DNA, 2064 bp, Artificial Sequence; identical to SEQ ID NO: 81557
  Description of Artificial Sequence: Synthetic coding sequence

SEQ ID NO: 81561 - DNA, 462 bp, Artificial Sequence
  Description of Artificial Sequence: Synthetic coding sequence
atggccctggacggcatcagaatgcccgacggctgctacgccgacggcacctgggagctgagcgtgcacgtgaccgacctgaacagagacgtgaccctgagagtgaccggcgaggtgcacatcggcggcgtgatgctgaagctggtggagaagctggacgtgaagaaggactggagcgaccacgccctgtggtgggagaagaagagaacctggctgctgaagacccactggaccctggacaagtacggcatccaggccgacgccaagctgcagttcaccccccagcacaagctgctgagactgcagctgcccaacatgaagtacgtgaaggtgaaggtgaacttcagcgacagagtgttcaaggccgtgagcgacatctgcaagaccttcaacatcagacaccccgaggagctgagcctgctgaagaagcccagagaccccaccaagaagaagaagaagtag

SEQ ID NO: 81562 - DNA, 2004 bp, Artificial Sequence
  Description of Artificial Sequence: Synthetic coding sequence
atggccggcatgaagaccgccagcggcgactacatcgacagcagctgggagctgagagtgttcgtgggcgaggaggaccccgaggccgagagcgtgaccctgagagtgaccggcgagagccacatcggcggcgtgctgctgaagatcgtggagcagatcaacagaaagcaggactggagcgaccacgccatctggtgggagcagaagagacagtggctgctgcagacccactggaccctggacaagtacggcatcctggccgacgccagactgttcttcggcccccagcacagacccgtgatcctgagactgcccaacagaagagccctgagactgagagccagcttcagccagcccctgttccaggccgtggccgccatctgcagactgctgagcatcagacaccccgaggagctgagcctgctgagagcccccgagaagaaggagaagaagaagaaggagaaggagcccgaggaggagctgtacgacctgagcaaggtggtgctggccggcggcgtggcccccgccctgttcagaggcatgcccgcccacttcagcgacagcgcccagaccgaggcctgctaccacatgctgagcagaccccagcccccccccgaccccctgctgctgcagagactgcccagacccagcagcctgagcgacaagacccagctgcacagcagatggctggacagcagcagatgcctgatgcagcagggcatcaaggccggcgacgccctgtggctgagattcaagtactacagcttcttcgacctggaccccaagaccgaccccgtgagactgacccagctgtacgagcaggccagatgggacctgctgctggaggagatcgactgcaccgaggaggagatgatggtgttcgccgccctgcagtaccacatcaacaagctgagccagagcggcgaggtgggcgagcccgccggcaccgaccccggcctggacgacctggacgtggccctgagcaacctggaggtgaagctggagggcagcgcccccaccgacgtgctggacagcctgaccaccatccccgagctgaaggaccacctgagaatcttcagaatccccagaagacccagaaagctgaccctgaagggctacagacagcactgggtggtgttcaaggagaccaccctgagctactacaagagccaggacgaggcccccggcgaccccatccagcagctgaacctgaagggctgcgaggtggtgcccgacgtgaacgtgagcggccagaagttctgcatcaagctgctggtgcccagccccgagggcatgagcgagatctacctgagatgccaggacgagcagcagtacgccagatggatggccggctgcagactggccagcaagggcagaaccatggccgacagcagctacaccagcgaggtgcaggccatcctggccttcctgagcctgcagagaaccggcagcggcggccccggcaaccacccccacggccccgacgccagcgccgagggcctgaacccctacggcctggtggcccccagattccagagaaagttcaaggccaagcagctgacccccagaatcctggaggcccaccagaacgtggcccagctgagcctggccgaggcccagctgagattcatccaggcctggcagagcctgcccgacttcggcatcagctacgtgatggtgagattcaagggcagcagaaaggacgagatcctgggcatcgccaacaacagactgatcagaatcgacctggccgtgggcgacgtggtgaagacctggagattcagcaacatgagacagtggaacgtgaactgggacatcagacaggtggccatcgagttcgacgagcacatcaacgtggccttcagctgcgtgagcgccagctgcagaatcgtgcacgagtacatcggcggctacatcttcctgagcaccagagagagagccagaggcgaggagctggacgaggacctgttcctgcagctgaccggcggccacgaggccttctag

SEQ ID NO: 81563 - DNA, 1992 bp, Artificial Sequence
  Description of Artificial Sequence: Synthetic coding sequence
atggccggcatgaagaccgccagcggcgactacatcgacagcagctgggagctgagagtgttcgtgggcgaggaggaccccgaggccgagagcgtgaccctgagagtgaccggcgagagccacatcggcggcgtgctgctgaagatcgtggagcagatcaacagaaagcaggactggagcgaccacgccatctggtgggagcagaagagacagtggctgctgcagacccactggaccctggacaagtacggcatcctggccgacgccagactgttcttcggcccccagcacagacccgtgatcctgagactgcccaacagaagagccctgagactgagagccagcttcagccagcccctgttccaggccgtggccgccatctgcagactgctgagcatcagacaccccgaggagctgagcctgctgagagcccccgagaagaaggagaagaagaagaaggagaaggagcccgaggaggagctgtacgacctgagcaaggtggtgctggccggcggcgtggcccccgccctgttcagaggcatgcccgcccacttcagcgacagcgcccagaccgaggcctgctaccacatgctgagcagaccccagcccccccccgaccccctgctgctgcagagactgcccagacccagcagcctgagcgacaagacccagctgcacagcagatggctggacagcagcagatgcctgatgcagcagggcatcaaggccggcgacgccctgtggctgagattcaagtactacagcttcttcgacctggaccccaagaccgaccccgtgagactgacccagctgtacgagcaggccagatgggacctgctgctggaggagatcgactgcaccgaggaggagatgatggtgttcgccgccctgcagtaccacatcaacaagctgagccagagcggcgaggtgggcgagcccgccggcaccgaccccggcctggacgacctggacgtggccctgagcaacctggaggtgaagctggagggcagcgcccccaccgacgtgctggacagcctgaccaccatccccgagctgaaggaccacctgagaatcttcagacccagaaagctgaccctgaagggctacagacagcactgggtggtgttcaaggagaccaccctgagctactacaagagccaggacgaggcccccggcgaccccatccagcagctgaacctgaagggctgcgaggtggtgcccgacgtgaacgtgagcggccagaagttctgcatcaagctgctggtgcccagccccgagggcatgagcgagatctacctgagatgccaggacgagcagcagtacgccagatggatggccggctgcagactggccagcaagggcagaaccatggccgacagcagctacaccagcgaggtgcaggccatcctggccttcctgagcctgcagagaaccggcagcggcggccccggcaaccacccccacggccccgacgccagcgccgagggcctgaacccctacggcctggtggcccccagattccagagaaagttcaaggccaagcagctgacccccagaatcctggaggcccaccagaacgtggcccagctgagcctggccgaggcccagctgagattcatccaggcctggcagagcctgcccgacttcggcatcagctacgtgatggtgagattcaagggcagcagaaaggacgagatcctgggcatcgccaacaacagactgatcagaatcgacctggccgtgggcgacgtggtgaagacctggagattcagcaacatgagacagtggaacgtgaactgggacatcagacaggtggccatcgagttcgacgagcacatcaacgtggccttcagctgcgtgagcgccagctgcagaatcgtgcacgagtacatcggcggctacatcttcctgagcaccagagagagagccagaggcgaggagctggacgaggacctgttcctgcagctgaccggcggccacgaggccttctag

SEQ ID NO: 81564 - DNA, 861 bp, Artificial Sequence
  Description of Artificial Sequence: Synthetic coding sequence
atggccggcatgaagaccgccagcggcgactacatcgacagcagctgggagctgagagtgttcgtgggcgaggaggaccccgaggccgagagcgtgaccctgagagtgaccggcgagagccacatcggcggcgtgctgctgaagatcgtggagcagatcaacagaaagcaggactggagcgaccacgccatctggtgggagcagaagagacagtggctgctgcagacccactggaccctggacaagtacggcatcctggccgacgccagactgttcttcggcccccagcacagacccgtgatcctgagactgcccaacagaagagccctgagactgagagccagcttcagccagcccctgttccaggccgtggccgccatctgcagactgctgagcatcagacaccccgaggagctgagcctgctgagagcccccgagaagaaggagaagaagaagaaggagaaggagcccgaggaggagctgtacgacctgagcaaggtggtgctggccggcggcgtggcccccgccctgttcagaggcatgcccgcccacttcagcgacagcgcccagaccgaggcctgctaccacatgctgagcagaccccagcccccccccgaccccctgctgctgcagagactgcccagacccagcagcctgagcgacaagacccagctgcacagcagatggctggacagcagcagatgcctgatgcagcagggcatcaaggccggcgacgccctgtggctgagattcaagtactacagcttcttcgacctggaccccaagaccgaccccgtgagactgacccagctgtacgagcaggccagatgggacctgctgctggaggagatcgactgctag

SEQ ID NO: 81565 - DNA, 555 bp, Artificial Sequence
  Description of Artificial Sequence: Synthetic coding sequence
atggccgccgccggcggcgccagactgctgagagccgccagcgccgtgctgggcggccccgccggcagatggctgcaccacgccggcagcagagccggcagcagcggcctgctgagaaacagaggccccggcggcagcgccgaggccagcagaagcctgagcgtgagcgccagagccagaagcagcagcgaggacaagatcaccgtgcacttcatcaacagagacggcgagaccctgaccaccaagggcaaggtgggcgacagcctgctggacgtggtggtggagaacaacctggacatcgacggcttcggcgcctgcgagggcaccctggcctgcagcacctgccacctgatcttcgaggaccacatctacgagaagctggacgccatcaccgacgaggagaacgacatgctggacctggcctacggcctgaccgacagaagcagactgggctgccagatctgcctgaccaagagcatggacaacatgaccgtgagagtgcccgagaccgtggccgacgccagacagagcatcgacgtgggcaagaccagctag

SEQ ID NO: 81566 - DNA, 1494 bp, Artificial Sequence
  Description of Artificial Sequence: Synthetic coding sequence
atggccagcagatgctggagatggtggggctggagcgcctggcccagaaccagactgccccccgccggcagcacccccagcttctgccaccacttcagcacccaggagaagaccccccagatctgcgtggtgggcagcggccccgccggcttctacaccgcccagcacctgctgaagcacccccaggcccacgtggacatctacgagaagcagcccgtgcccttcggcctggtgagattcggcgtggcccccgaccaccccgaggtgaagaacgtgatcaacaccttcacccagaccgcccacagcggcagatgcgccttctggggcaacgtggaggtgggcagagacgtgaccgtgcccgagctgagagaggcctaccacgccgtggtgctgagctacggcgccgaggaccacagagccctggagatccccggcgaggagctgcccggcgtgtgcagcgccagagccttcgtgggctggtacaacggcctgcccgagaaccaggagctggagcccgacctgagctgcgacaccgccgtgatcctgggccagggcaacgtggccctggacgtggccagaatcctgctgaccccccccgagcacctggaggccctgctgctgtgccagagaaccgacatcaccaaggccgccctgggcgtgctgagacagagcagagtgaagaccgtgtggctggtgggcagaagaggccccctgcaggtggccttcaccatcaaggagctgagagagatgatccagctgcccggcgccagacccatcctggaccccgtggacttcctgggcctgcaggacaagatcaaggaggtgcccagacccagaaagagactgaccgagctgctgctgagaaccgccaccgagaagcccggccccgccgaggccgccagacaggccagcgccagcagagcctggggcctgagattcttcagaagcccccagcaggtgctgcccagccccgacggcagaagagccgccggcgtgagactggccgtgaccagactggagggcgtggacgaggccaccagagccgtgcccaccggcgacatggaggacctgccctgcggcctggtgctgagcagcatcggctacaagagcagacccgtggaccccagcgtgcccttcgacagcaagctgggcgtgatccccaacgtggagggcagagtgatggacgtgcccggcctgtactgcagcggctgggtgaagagaggccccaccggcgtgatcgccaccaccatgaccgacagcttcctgaccggccagatgctgctgcaggacctgaaggccggcctgctgcccagcggccccagacccggctacgccgccatccaggccctgctgagcagcagaggcgtgagacccgtgagcttcagcgactgggagaagctggacgccgaggaggtggccagaggccagggcaccggcaagcccagagagaagctggtggacccccaggagatgctgagactgctgggccactag

SEQ ID NO: 81567 - DNA, 1569 bp, Artificial Sequence
  Description of Artificial Sequence: Synthetic coding sequence
atggccagcagatgctggagatggtggggctggagcgcctggcccagaaccagactgccccccgccggcagcacccccaccttcggcggcagcgacgaggtgagagaccccgccaacgccaaggccctgagaaacaagagaagaagaatgcaggtgagagtgaagctgggcaagttccagctgctgctggacatccaggagaagaccccccagatctgcgtggtgggcagcggccccgccggcttctacaccgcccagcacctgctgaagcacccccaggcccacgtggacatctacgagaagcagcccgtgcccttcggcctggtgagattcggcgtggcccccgaccaccccgaggtgaagaacgtgatcaacaccttcacccagaccgcccacagcggcagatgcgccttctggggcaacgtggaggtgggcagagacgtgaccgtgcccgagctgagagaggcctaccacgccgtggtgctgagctacggcgccgaggaccacagagccctggagatccccggcgaggagctgcccggcgtgtgcagcgccagagccttcgtgggctggtacaacggcctgcccgagaaccaggagctggagcccgacctgagctgcgacaccgccgtgatcctgggccagggcaacgtggccctggacgtggccagaatcctgctgaccccccccgagcacctggagagaaccgacatcaccaaggccgccctgggcgtgctgagacagagcagagtgaagaccgtgtggctggtgggcagaagaggccccctgcaggtggccttcaccatcaaggagctgagagagatgatccagctgcccggcgccagacccatcctggaccccgtggacttcctgggcctgcaggacaagatcaaggaggtgcccagacccagaaagagactgaccgagctgctgctgagaaccgccaccgagaagcccggccccgccgaggccgccagacaggccagcgccagcagagcctggggcctgagattcttcagaagcccccagcaggtgctgcccagccccgacggcagaagagccgccggcgtgagactggccgtgaccagactggagggcgtggacgaggccaccagagccgtgcccaccggcgacatggaggacctgccctgcggcctggtgctgagcagcatcggctacaagagcagacccgtggaccccagcgtgcccttcgacagcaagctgggcgtgatccccaacgtggagggcagagtgatggacgtgcccggcctgtactgcagcggctgggtgaagagaggccccaccggcgtgatcgccaccaccatgaccgacagcttcctgaccggccagatgctgctgcaggacctgaaggccggcctgctgcccagcggccccagacccggctacgccgccatccaggccctgctgagcagcagaggcgtgagacccgtgagcttcagcgactgggagaagctggacgccgaggaggtggccagaggccagggcaccggcaagcccagagagaagctggtggacccccaggagatgctgagactgctgggccactag

SEQ ID NO: 81568 - DNA, 1356 bp, Artificial Sequence
  Description of Artificial Sequence: Synthetic coding sequence
atggccagcagatgctggagatggtggggctggagcgcctggcccagaaccagactgccccccgccggcagcacccccagcttctgccaccacttcagcacccaggagaagaccccccagatctgcgtggtgggcagcggccccgccggcttctacaccgcccagcacctgctgaagcagcacccccaggcccacgtggacatctacgagaagcagcccgtgcccttcggcctggtgagattcggcgtggcccccgaccaccccgaggtgaagagctacggcgccgaggaccacagagccctggagatccccggcgaggagctgcccggcgtgtgcagcgccagagccttcgtgggctggtacaacggcctgcccgagaaccaggagctggagcccgacctgagctgcgacaccgccgtgatcctgggccagggcaacgtggccctggacgtggccagaatcctgctgaccccccccgagcacctggagagaaccgacatcaccaaggccgccctgggcgtgctgagacagagcagagtgaagaccgtgtggctggtgggcagaagaggccccctgcaggtggccttcaccatcaaggagctgagagagatgatccagctgcccggcgccagacccatcctggaccccgtggacttcctgggcctgcaggacaagatcaaggaggtgcccagacccagaaagagactgaccgagctgctgctgagaaccgccaccgagaagcccggccccgccgaggccgccagacaggccagcgccagcagagcctggggcctgagattcttcagaagcccccagcaggtgctgcccagccccgacggcagaagagccgccggcgtgagactggccgtgaccagactggagggcgtggacgaggccaccagagccgtgcccaccggcgacatggaggacctgccctgcggcctggtgctgagcagcatcggctacaagagcagacccgtggaccccagcgtgcccttcgacagcaagctgggcgtgatccccaacgtggagggcagagtgatggacgtgcccggcctgtactgcagcggctgggtgaagagaggccccaccggcgtgatcgccaccaccatgaccgacagcttcctgaccggccagatgctgctgcaggacctgaaggccggcctgctgcccagcggccccagacccggctacgccgccatccaggccctgctgagcagcagaggcgtgagacccgtgagcttcagcgactgggagaagctggacgccgaggaggtggccagaggccagggcaccggcaagcccagagagaagctggtggacccccaggagatgctgagactgctgggccactag

SEQ ID NO: 81569 - DNA, 1605 bp, Artificial Sequence
  Description of Artificial Sequence: Synthetic coding sequence
atggccagcagatgctggagatggtggggctggagcgcctggcccagaaccagactgccccccgccggcagcacccccagcttctgccaccacttcagcacccaggagaagaccccccagatctgcgtggtgggcagcggccccgccggcttctacaccgcccagcacctgctgaagagagtggaggccctgtgcagccagcccagagtgctgaacagccccgccctgagcggcgagggcgaggacctgggcgccagccagcccctgagcctggaccccaccagctgccaccccgtgccccagcagcacccccaggcccacgtggacatctacgagaagcagcccgtgcccttcggcctggtgagattcggcgtggcccccgaccaccccgaggtgaagaacgtgatcaacaccttcacccagaccgcccacagcggcagatgcgccttctggggcaacgtggaggtgggcagagacgtgaccgtgcccgagctgagagaggcctaccacgccgtggtgctgagctacggcgccgaggaccacagagccctggagatccccggcgaggagctgcccggcgtgtgcagcgccagagccttcgtgggctggtacaacggcctgcccgagaaccaggagctggagcccgacctgagctgcgacaccgccgtgatcctgggccagggcaacgtggccctggacgtggccagaatcctgctgaccccccccgagcacctggagagaaccgacatcaccaaggccgccctgggcgtgctgagacagagcagagtgaagaccgtgtggctggtgggcagaagaggccccctgcaggtggccttcaccatcaaggagctgagagagatgatccagctgcccggcgccagacccatcctggaccccgtggacttcctgggcctgcaggacaagatcaaggaggtgcccagacccagaaagagactgaccgagctgctgctgagaaccgccaccgagaagcccggccccgccgaggccgccagacaggccagcgccagcagagcctggggcctgagattcttcagaagcccccagcaggtgctgcccagccccgacggcagaagagccgccggcgtgagactggccgtgaccagactggagggcgtggacgaggccaccagagccgtgcccaccggcgacatggaggacctgccctgcggcctggtgctgagcagcatcggctacaagagcagacccgtggaccccagcgtgcccttcgacagcaagctgggcgtgatccccaacgtggagggcagagtgatggacgtgcccggcctgtactgcagcggctgggtgaagagaggccccaccggcgtgatcgccaccaccatgaccgacagcttcctgaccggccagatgctgctgcaggacctgaaggccggcctgctgcccagcggccccagacccggctacgccgccatccaggccctgctgagcagcagaggcgtgagacccgtgagcttcagcgactgggagaagctggacgccgaggaggtggccagaggccagggcaccggcaagcccagagagaagctggtggacccccaggagatgctgagactgctgggccactag

SEQ ID NO: 81570 - DNA, 1146 bp, Artificial Sequence
  Description of Artificial Sequence: Synthetic coding sequence
atgaccacctgcaaggccggcgtggtgcccctggccagccagcagcacccccaggcccacgtggacatctacgagaagcagcccgtgcccttcggcctggtgagattcggcgtggcccccgaccaccccgaggtgaagaacgtgatcaacaccttcacccagaccgcccacagcggcagatgcgccttctggggcaacgtggaggtgggcagagacgtgaccgtgcccgagctgagagaggcctaccacgccgtggtgctgagctacggcgccgaggaccacagagccctggagatccccggcgaggagctgcccggcgtgtgcagcgccagagccttcgtgggctggtacaacggcctgcccgagaaccaggagctggagcccgacctgagctgcgacaccgccgtgatcctgggccagggcaacgtggccctggacgtggccagaatcctgctgaccccccccgagcacctggagagaaccgacatcaccaaggccgccctgggcgtgctgagacagagcagagtgaagaccgtgtggctggtgggcagaagaggccccctgcaggtggccttcaccatcaaggagctgagagagatgatccagctgcccggcgccagacccatcctggaccccgtggacttcctgggcctgcaggacaagatcaaggaggtgcccagacccagaaagagactgaccgagctgctgctgagaaccgccaccgagaagcccggccccgccgaggccgccagacaggccagcgccagcagagcctggggcctgagattcttcagaagcccccagcaggtgctgcccagccccgacggcagaagagccgccggcgtgagactggccgtgaccagactggaggtgagcctgatgttcctgaaggacacccccttccccggcctgtgccacccccccggcgtggcccacaccctgcccaacagagtgagcatgagaccccccgtgcagtgccccagagagacctggaagaccagcctggtgggctggtgcagcgccgccctgggcatcagagccgccctgagcacccaggcctgccccctgacccccagcctgggcagcagccccatgtggagagccggcctgtggatgtgccaggccagcaccgccgccgccggctag

SEQ ID NO: 81571 - DNA, 1320 bp, Artificial Sequence
  Description of Artificial Sequence: Synthetic coding sequence
atggaggacaaggacagagagcacccccaggcccacgtggacatctacgagaagcagcccgtgcccttcggcctggtgagattcggcgtggcccccgaccaccccgaggtgaagaacgtgatcaacaccttcacccagaccgcccacagcggcagatgcgccttctggggcaacgtggaggtgggcagagacgtgaccgtgcccgagctgagagaggcctaccacgccgtggtgctgagctacggcgccgaggaccacagagccctggagatccccggcgaggagctgcccggcgtgtgcagcgccagagccttcgtgggctggtacaacggcctgcccgagaaccaggagctggagcccgacctgagctgcgacaccgccgtgatcctgggccagggcaacgtggccctggacgtggccagaatcctgctgaccccccccgagcacctggagagaaccgacatcaccaaggccgccctgggcgtgctgagacagagcagagtgaagaccgtgtggctggtgggcagaagaggccccctgcaggtggccttcaccatcaaggagctgagagagatgatccagctgcccggcgccagacccatcctggaccccgtggacttcctgggcctgcaggacaagatcaaggaggtgcccagacccagaaagagactgaccgagctgctgctgagaaccgccaccgagaagcccggccccgccgaggccgccagacaggccagcgccagcagagcctggggcctgagattcttcagaagcccccagcaggtgctgcccagccccgacggcagaagagccgccggcgtgagactggccgtgaccagactggagggcgtggacgaggccaccagagccgtgcccaccggcgacatggaggacctgccctgcggcctggtgctgagcagcatcggctacaagagcagacccgtggaccccagcgtgcccttcgacagcaagctgggcgtgatccccaacgtggagggcagagtgatggacgtgcccggcctgtactgcagcggctgggtgaagagaggccccaccggcgtgatcgccaccaccatgaccgacagcttcctgaccggccagatgctgctgcaggacctgaaggccggcctgctgcccagcggccccagacccggctacgccgccatccaggccctgctgagcagcagaggcgtgagacccgtgagcttcagcgactgggagaagctggacgccgaggaggtggccagaggccagggcaccggcaagcccagagagaagctggtggacccccaggagatgctgagactgctgggccactag

SEQ ID NO: 81572 - DNA, 1494 bp, Artificial Sequence; identical to SEQ ID NO: 81566
  Description of Artificial Sequence: Synthetic coding sequence

SEQ ID NO: 81573 - DNA, 1452 bp, Artificial Sequence
  Description of Artificial Sequence: Synthetic coding sequence
atggccagcagatgctggagatggtggggctggagcgcctggcccagaaccagactgccccccgccggcagcacccccagcttctgccaccacttcagcacccaggagaagaccccccagatctgcgtggtgggcagcggccccgccggcttctacaccgcccagcacctgctgaagcacccccaggcccacgtggacatctacgagaagcagcccgtgcccttcggcctggtgagattcggcgtggcccccgaccaccccgaggtgaagaccgcccacagcggcagatgcgccttctggggcaacgtggaggtgggcagagacgtgaccgtgcccgagctgagagaggcctaccacgccgtggtgctgagctacggcgccgaggaccacagagccctggagatccccggcgaggagctgcccggcgtgtgcagcgccagagccttcgtgggctggtacaacggcctgcccgagaaccaggagctggagcccgacctgagctgcgacaccgccgtgatcctgggccagggcaacgtggccctggacgtggccagaatcctgctgaccccccccgagcacctggagagaaccgacatcaccaaggccgccctgggcgtgctgagacagagcagagtgaagaccgtgtggctggtgggcagaagaggccccctgcaggtggccttcaccatcaaggagctgagagagatgatccagctgcccggcgccagacccatcctggaccccgtggacttcctgggcctgcaggacaagatcaaggaggtgcccagacccagaaagagactgaccgagctgctgctgagaaccgccaccgagaagcccggccccgccgaggccgccagacaggccagcgccagcagagcctggggcctgagattcttcagaagcccccagcaggtgctgcccagccccgacggcagaagagccgccggcgtgagactggccgtgaccagactggagggcgtggacgaggccaccagagccgtgcccaccggcgacatggaggacctgccctgcggcctggtgctgagcagcatcggctacaagagcagacccgtggaccccagcgtgcccttcgacagcaagctgggcgtgatccccaacgtggagggcagagtgatggacgtgcccggcctgtactgcagcggctgggtgaagagaggccccaccggcgtgatcgccaccaccatgaccgacagcttcctgaccggccagatgctgctgcaggacctgaaggccggcctgctgcccagcggccccagacccggctacgccgccatccaggccctgctgagcagcagaggcgtgagacccgtgagcttcagcgactgggagaagctggacgccgaggaggtggccagaggccagggcaccggcaagcccagagagaagctggtggacccccaggagatgctgagactgctgggccactag

SEQ ID NO: 81574 - DNA, 1881 bp, Artificial Sequence
  Description of Artificial Sequence: Synthetic coding sequence
atggccgtgagcggcttcaccctgggcacctgcatcctgctgctgcacatcagctacgtggccaactaccccaacggcaaggtgacccagagctgccacggcatgatccccgagcacggccacagcccccagagcgtgcccgtgcacgacatctacgtgagccagatgaccttcagacccggcgaccagatcgaggtgaccctgagcggccaccccttcaagggcttcctgctggaggccagaaacgccgaggacctgaacggcccccccatcggcagcttcaccctgatcgacagcgaggtgagccagctgctgacctgcgaggacatccagggcagcgccgtgagccacagaagcgccagcaagaagaccgagatcaaggtgtactggaacgcccccagcagcgcccccaaccacacccagttcctggtgaccgtggtggagaagtacaagatctactgggtgaagatccccggccccatcatcagccagcccaacgccttccccttcaccacccccaaggccaccgtggtgcccctgcccaccctgccccccgtgagccacctgaccaagcccttcagcgccagcgactgcggcaacaagaagttctgcatcagaagccccctgaactgcgaccccgagaaggaggccagctgcgtgttcctgagcttcaccagagacgaccagagcgtgatggtggagatgagcggccccagcaagggctacctgagcttcgccctgagccacgaccagtggatgggcgacgacgacgcctacctgtgcatccacgaggaccagaccgtgtacatccagcccagccacctgaccggcagaagccaccccgtgatggacagcagagacaccctggaggacatggcctggagactggccgacggcgtgatgcagtgcagcttcagaagaaacatcaccctgcccggcgtgaagaacagattcgacctgaacaccagctactacatcttcctggccgacggcgccgccaacgacggcagaatctacaagcacagccagcagcccctgatcacctacgagaagtacgacgtgaccgacagccccaagaacatcggcggcagccacagcgtgctgctgctgaaggtgcacggcgccctgatgttcgtggcctggatgaccaccgtgagcatcggcgtgctggtggccagattcttcaagcccgtgtggagcaaggccttcctgctgggcgaggccgcctggttccaggtgcacagaatgctgatgttcaccaccaccgtgctgacctgcatcgccttcgtgatgcccttcatctacagaggcggctggagcagacacgccggctaccacccctacctgggctgcatcgtgatgaccctggccgtgctgcagcccctgctggccgtgttcagaccccccctgcacgaccccagaagacagatgttcaactggacccactggagcatgggcaccgccgccagaatcatcgccgtggccgccatgttcctgggcatggacctgcccggcctgaacctgcccgacagctggaagacctacgccatgaccggcttcgtggcctggcacgtgggcaccgaggtggtgctggagctgaagtactggatgatgaccgagttcagaagcttcagccacctgctgcagtggaagcagagagtgatgctgctgaagagacagtgctggcagttcatgagcgtgggcatgctgctgttcagcagctacttctacctgcagagcaccatctacgagcaggccaagaccctggccttcgccggccaggtgatcatcatcatcaagcccaagaagctggaggcctgccccgactgcctggagcacatctgcgagttcagcctgggcagactgggcagctgcctgtag

SEQ ID NO: 81575 - DNA, 1779 bp, Artificial Sequence
  Description of Artificial Sequence: Synthetic coding sequence
atggccgtgagcggcttcaccctgggcacctgcatcctgctgctgcacatcagctacgtggccaactaccccaacggcaaggtgacccagagctgccacggcatgatccccgagcacggccacagcccccagagcgtgcccgtgcacgacatctacgtgagccagatgaccttcagacccggcgaccagatcgaggtgaccctgagcggccaccccttcaagggcttcctgctggaggccagaaacgccgaggacctgaacggcccccccatcggcagcttcaccctgatcgacagcgaggtgagccagctgctgacctgcgaggacatccagggcagcgccgtgagccacagaagcgccagcaagaagaccgagatcaaggtgtactggaacgcccccagcagcgcccccaaccacacccagttcctggtgaccgtggtggagaagtacaagatctactgggtgaagatccccggccccatcatcagccagcccaacgccttccccttcaccacccccaaggccaccgtggtgcccctgcccaccctgccccccgtgagccacctgaccaagcccttcagcgccagcgactgcggcaacaagaagttctgcatcagaagccccctgaactgcgaccccgagaaggaggccagctgcgtgttcctgagcttcaccagagacgaccagagcgtgatggtggagatgagcggccccagcaagggctacctgagcttcgccctgagccacgaccagtggatgggcgacgacgacgcctacctgtgcatccacgaggaccagaccgtgtacatccagcccagccacctgaccggcagaagccaccccgtgatggacagcagagacaccctggaggacatggcctggagactggccgacggcgtgatgcagtgcagcttcagaagaaacatcaccctgcccggcgtgaagaacagattcgacctgaacaccagctactacatcttcctggccgacggcgccgccaacgacggcagaatctacaagcacagccagcagcccctgatcacctacgagaagtacgacgtgaccgacagccccaagaacatcggcggcagccacagcgtgctgctgctgaaggtgcacggcgccctgatgttcgtggcctggatgaccaccgtgagcatcggcgtgctggtggccagattcttcaagcccgtgtggagcaaggccttcctgctgggcgaggccgcctggttccaggtgcacagaatgctgatgttcaccaccaccgtgctgacctgcatcgccttcgtgatgcccttcatctacagaggcggctggagcagacacgccggctaccacccctacctgggctgcatcgtgatgaccctggccgtgctgcagcccctgctggccgtgttcagaccccccctgcacgaccccagaagacagatgttcaactggacccactggagcatgggcaccgccgccagaatcatcgccgtggccgccatgttcctgggcatggacctgcccggcctgaacctgcccgacagctggaagacctacgccatgaccggcttcgtggcctggcacgtgggcaccgaggtggtgctggaggtgcacgcctacagactgagcagaaaggtggagatcctggacgacgacagaatccagatcctgcagagcttcaccgccgtggagaccgagggccacgccttcaagaaggccgtgctggccatctacgtgtgcggcaacgtgaccttcctgatcatcttcctgagcgccatcaaccacctgtag

SEQ ID NO: 81576 - DNA, 729 bp, Artificial Sequence
  Description of Artificial Sequence: Synthetic coding sequence
atgctgagctgcttcagactgctgagcagacacatcagccccagcctggccagcctgagacccgtgagatgctgcttcgccctgcccctgagatgggcccccggcagacccctggaccccagacagatcgcccccagaagacccctggccgccgccgccagcagcagagaccccaccggccccgccgccggccccagcagagtgagacagaacttccaccccgacagcgaggccgccatcaacagacagatcaacctggagctgtacgccagctacgtgtacctgagcatggcctactacttcagcagagacgacgtggccctgaacaacttcagcagatacttcctgcaccagagcagagaggagaccgagcacgccgagaagctgatgagactgcagaaccagagaggcggcagaatcagactgcaggacatcaagaagcccgagcaggacgactgggagagcggcctgcacgccatggagtgcgccctgctgctggagaagaacgtgaaccagagcctgctggagctgcacgccctggccagcgacaagggcgacccccacctgtgcgacttcctggagacctactacctgaacgagcaggtgaagagcatcaaggagctgggcgaccacgtgcacaacctggtgaagatgggcgcccccgacgccggcctggccgagtacctgttcgacacccacaccctgggcaacgagaacaagcagaactag

SEQ ID NO: 81577 - DNA, 552 bp, Artificial Sequence
  Description of Artificial Sequence: Synthetic coding sequence
atgaccaccgccagcaccagccaggtgagacagaactaccaccaggacagcgaggccgccatcaacagacagatcaacctggagctgtacgccagctacgtgtacctgagcatgagctactacttcgacagagacgacgtggccctgaagaacttcgccaagtacttcctgcaccagagccacgaggagagagagcacgccgagaagctgatgaagctgcagaaccagagaggcggcagaatcttcctgcaggacatcaagaagcccgactgcgacgactgggagagcggcctgaacgccatggagtgcgccctgcacctggagaagaacgtgaaccagagcctgctggagctgcacaagctggccaccgacaagaacgacccccacctgtgcgacttcatcgagacccactacctgaacgagcaggtgaaggccatcaaggagctgggcgaccacgtgaccaacctgagaaagatgggcgcccccgagagcggcctggccgagtacctgttcgacaagcacaccctgggcgacagcgacaacgagagctag

SEQ ID NO: 81578 - DNA, 699 bp, Artificial Sequence
  Description of Artificial Sequence: Synthetic coding sequence
agcggcttccccgccagcaccgtgctgggcagaaaccccgccctggtgccccaccccggcagaccccccatcgccagcccccccagccccctgcacagaaccctgggcctgccccagggccccagaagactgagcctggtggccgccatgaccaccgccagcaccagccaggtgagacagaactaccaccaggacagcgaggccgccatcaacagacagatcaacctggagctgtacgccagctacgtgtacctgagcatgagctactacttcgacagagacgacgtggccctgaagaacttcgccaagtacttcctgcaccagagccacgaggagagagagcacgccgagaagctgatgaagctgcagaaccagagaggcggcagaatcttcctgcaggacatcaagaagcccgactgcgacgactgggagagcggcctgaacgccatggagtgcgccctgcacctggagaagaacgtgaaccagagcctgctggagctgcacaagctggccaccgacaagaacgacccccacctgtgcgacttcatcgagacccactacctgaacgagcaggtgaaggccatcaaggagctgggcgaccacgtgaccaacctgagaaagatgggcgcccccgagagcggcctggccgagtacctgttcgacaagcacaccctgggcgacagcgacaacgagagctag

SEQ ID NO: 81579 - DNA, 462 bp, Artificial Sequence
  Description of Artificial Sequence: Synthetic coding sequence
atgaccaccgccagcaccagccagagctactacttcgacagagacgacgtggccctgaagaacttcgccaagtacttcctgcaccagagccacgaggagagagagcacgccgagaagctgatgaagctgcagaaccagagaggcggcagaatcttcctgcaggacatcaagaagcccgactgcgacgactgggagagcggcctgaacgccatggagtgcgccctgcacctggagaagaacgtgaaccagagcctgctggagctgcacaagctggccaccgacaagaacgacccccacctgtgcgacttcatcgagacccactacctgaacgagcaggtgaaggccatcaaggagctgggcgaccacgtgaccaacctgagaaagatgggcgcccccgagagcggcctggccgagtacctgttcgacaagcacaccctgggcgacagcgacaacgagagctag

SEQ ID NO: 81580 - DNA, 552 bp, Artificial Sequence
  Description of Artificial Sequence: Synthetic coding sequence
atggccaccgcccagcccagccaggtgagacagaagtacgacaccaactgcgacgccgccatcaacagccacatcaccctggagctgtacaccagctacctgtacctgagcatggccttctacttcaacagagacgacgtggccctggagaacttcttcagatacttcctgagactgagcgacgacaagatggagcacgcccagaagctgatgagactgcagaacctgagaggcggccacatctgcctgcacgacatcagaaagcccgagtgccagggctgggagagcggcctggtggccatggagagcgccttccacctggagaagaacgtgaaccagagcctgctggacctgtaccagctggccgtggagaagggcgacccccagctgtgccacttcctggagagccactacctgcacgagcaggtgaagaccatcaaggagctgggcggctacgtgagcaacctgagaaagatctgcagccccgaggccggcctggccgagtacctgttcgacaagctgaccctgggcggcagagtgaaggagacctag

SEQ ID NO: 81581 - DNA, 528 bp, Artificial Sequence
  Description of Artificial Sequence: Synthetic coding sequence
atgagcagccagatcagacagaactacagcaccgacgtggaggccgccgtgaacagcctggtgaacctgtacctgcaggccagctacacctacctgagcctgggcttctacttcgacagagacgacgtggccctggagggcgtgagccacttcttcagagagctggccgaggagaagagagagggctacgagagactgctgaagatgcagaaccagagaggcggcagagccctgttccaggacatcaagaagcccgccgaggacgagtggggcaagacccccgacgccatgaaggccgccatggccctggagaagaagctgaaccaggccctgctggacctgcacgccctgggcagcgccagaaccgacccccacctgtgcgacttcctggagacccacttcctggacgaggaggtgaagctgatcaagaagatgggcgaccacctgaccaacctgcacagactgggcggccccgaggccggcctgggcgagtacctgttcgagagactgaccctgaagcacgactag

SEQ ID NO: 81582 - DNA, 573 bp, Artificial Sequence
  Description of Artificial Sequence: Synthetic coding sequence
atgagcagccagatcagacagaactacagcaccgacgtggaggccgccgtgaacagcctggtgaacctgtacctgcaggccagctacacctacctgagcctgggcttctacttcgacagagacgacgtggccctggagggcgtgagccacttcttcagagagctggccgaggagaagagagagggctacgagagactgctgaagatgcagaaccagagaggcggcagagccctgttccaggacatcaagaagcccgccgaggacgagtggggcaagacccccgacgccatgaaggccgccatggccctggagaagaagctgaaccaggccctgctggacctgcacgccctgggcagcgccagaaccgacccccacctgtgcgacttcctggagacccacttcctggacgaggaggtgaagctgatcaagaagatgggcgaccacctgaccaacctgcacagactgggcggccccgaggccggcctgggcgagtacctgagcaagggcagcctgagcagcaccaccaagagcctgctgagccccgccaccagcgagggccccctggccaagtag

SEQ ID NO: 81583 - DNA, 1272 bp, Artificial Sequence
  Description of Artificial Sequence: Synthetic coding sequence
atgagaagcctgggcgccaacatggccgccgccctgagagccgccggcgtgctgctgagagaccccctggccagcagcagctggagagtgtgccagccctggagatggaagagcggcgccgccgccgccgccgtgaccaccgagaccgcccagcacgcccagggcgccaagccccaggtgcagccccagaagagaaagcccaagaccggcatcctgatgctgaacatgggcggccccgagaccctgggcgacgtgcacgacttcctgctgagactgttcctggacagagacctgatgaccctgcccatccagaacaagctggcccccttcatcgccaagagaagaacccccaagatccaggagcagtacagaagaatcggcggcggcagccccatcaagatctggaccagcaagcagggcgagggcatggtgaagctgctggacgagctgagccccaacaccgccccccacaagtactacatcggcttcagatacgtgcaccccctgaccgaggaggccatcgaggagatggagagagacggcctggagagagccatcgccttcacccagtacccccagtacagctgcagcaccaccggcagcagcctgaacgccatctacagatactacaaccaggtgggcagaaagcccaccatgaagtggagcaccatcgacagatggcccacccaccacctgctgatccagtgcttcgccgaccacatcctgaaggagctggaccacttccccctggagaagagaagcgaggtggtgatcctgttcagcgcccacagcctgcccatgagcgtggtgaacagaggcgacccctacccccaggaggtgagcgccaccgtgcagaaggtgatggagagactggagtactgcaacccctacagactggtgtggcagagcaaggtgggccccatgccctggctgggcccccagaccgacgagagcatcaagggcctgtgcgagagaggcagaaagaacatcctgctggtgcccatcgccttcaccagcgaccacatcgagaccctgtacgagctggacatcgagtacagccaggtgctggccaaggagtgcggcgtggagaacatcagaagagccgagagcctgaacggcaaccccctgttcagcaaggccctggccgacctggtgcacagccacatccagagcaacgagctgtgcagcaagcagctgaccctgagctgccccctgtgcgtgaaccccgtgtgcagagagaccaagagcttcttcaccagccagcagctgtag

SEQ ID NO: 81584 - DNA, 1290 bp, Artificial Sequence
  Description of Artificial Sequence: Synthetic coding sequence
atgagaagcctgggcgccaacatggccgccgccctgagagccgccggcgtgctgctgagagaccccctggccagcagcagctggagagtgtgccagccctggagatggaagagcggcgccgccgccgccgccgtgaccaccgagaccgcccagcacgcccagggcgccaagccccaggtgcagccccagaagagatacgagagcaacatcagaaagcccaagaccggcatcctgatgctgaacatgggcggccccgagaccctgggcgacgtgcacgacttcctgctgagactgttcctggacagagacctgatgaccctgcccatccagaacaagctggcccccttcatcgccaagagaagaacccccaagatccaggagcagtacagaagaatcggcggcggcagccccatcaagatctggaccagcaagcagggcgagggcatggtgaagctgctggacgagctgagccccaacaccgccccccacaagtactacatcggcttcagatacgtgcaccccctgaccgaggaggccatcgaggagatggagagagacggcctggagagagccatcgccttcacccagtacccccagtacagctgcagcaccaccggcagcagcctgaacgccatctacagatactacaaccaggtgggcagaaagcccaccatgaagtggagcaccatcgacagatggcccacccaccacctgctgatccagtgcttcgccgaccacatcctgaaggagctggaccacttccccctggagaagagaagcgaggtggtgatcctgttcagcgcccacagcctgcccatgagcgtggtgaacagaggcgacccctacccccaggaggtgagcgccaccgtgcagaaggtgatggagagactggagtactgcaacccctacagactggtgtggcagagcaaggtgggccccatgccctggctgggcccccagaccgacgagagcatcaagggcctgtgcgagagaggcagaaagaacatcctgctggtgcccatcgccttcaccagcgaccacatcgagaccctgtacgagctggacatcgagtacagccaggtgctggccaaggagtgcggcgtggagaacatcagaagagccgagagcctgaacggcaaccccctgttcagcaaggccctggccgacctggtgcacagccacatccagagcaacgagctgtgcagcaagcagctgaccctgagctgccccctgtgcgtgaaccccgtgtgcagagagaccaagagcttcttcaccagccagcagctgtag

SEQ ID NO: 81585 - DNA, 1149 bp, Artificial Sequence
  Description of Artificial Sequence: Synthetic coding sequence
atgggcctgctgctgcccctggccctgtgcatcctggtgctgtgctgcggcgccatgagccccccccagctggccctgaaccccagcgccctgctgagcagaggctgcaacgacagcgacgtgctggccgtggccggcttcgccctgagagacatcaacaaggacagaaaggacggctacgtgctgagactgaacagagtgaacgacgcccaggagtacagaagaggcggcctgggcagcctgttctacctgaccctggacgtgctggagaccgactgccacgtgctgagaaagaaggcctggcaggactgcggcatgagaatcttcttcgagagcgtgtacggccagtgcaaggccatcttctacatgaacaaccccagcagagtgctgtacctggccgcctacaactgcaccctgagacccgtgagcaagaagaagatctacatgacctgccccgactgccccagcagcatccccaccgacagcagcaaccaccaggtgctggaggccgccaccgagagcctggccaagtacaacaacgagaacaccagcaagcagtacagcctgttcaaggtgaccagagccagcagccagtgggtggtgggccccagctacttcgtggagtacctgatcaaggagagcccctgcaccaagagccaggccagcagctgcagcctgcagagcagcgacagcgtgcccgtgggcctgtgcaagggcagcctgaccagaacccactgggagaagttcgtgagcgtgacctgcgacttcttcgagagccaggcccccgccaccggcagcgagaacagcgccgtgaaccagaagcccaccaacctgcccaaggtggaggagagccagcagaagaacaccccccccaccgacagccccagcaaggccggccccagaggcagcgtgcagtacctgcccgacctggacgacaagaacagccaggagaagggcccccaggaggccttccccgtgcacctggacctgaccaccaacccccagggcgagaccctggacatcagcttcctgttcctggagcccatggaggagaagctggtggtgctgcccttccccaaggagaaggccagaaccgccgagtgccccggccccgcccagaacgccagccccctggtgctgcccccctag

SEQ ID NO: 81586 - DNA, 1149 bp, Artificial Sequence; identical to SEQ ID NO: 81585
  Description of Artificial Sequence: Synthetic coding sequence

SEQ ID NO: 81587 - DNA, 705 bp, Artificial Sequence
  Description of Artificial Sequence: Synthetic coding sequence
atgacctgccccgactgccccagcagcatccccaccgacagcagcaaccaccaggtgctggaggccgccaccgagagcctggccaagtacaacaacgagaacaccagcaagcagtacagcctgttcaaggtgaccagagccagcagccagtgggtggtgggccccagctacttcgtggagtacctgatcaaggagagcccctgcaccaagagccaggccagcagctgcagcctgcagagcagcgacagcgtgcccgtgggcctgtgcaagggcagcctgaccagaacccactgggagaagttcgtgagcgtgacctgcgacttcttcgagagccaggcccccgccaccggcagcgagaacagcgccgtgaaccagaagcccaccaacctgcccaaggtggaggagagccagcagaagaacaccccccccaccgacagccccagcaaggccggccccagaggcagcgtgcagtacctgcccgacctggacgacaagaacagccaggagaagggcccccaggaggccttccccgtgcacctggacctgaccaccaacccccagggcgagaccctggacatcagcttcctgttcctggagcccatggaggagaagctggtggtgctgcccttccccaaggagaaggccagaaccgccgagtgccccggccccgcccagaacgccagccccctggtgctgcccccctag

SEQ ID NO: 81588 - DNA, 717 bp, Artificial Sequence
  Description of Artificial Sequence: Synthetic coding sequence
atgagacagagcggcgccagccagcccctgctgatcaacatgtacctgcccgaccccgtgggcgacggcctgttcaaggacggcaagaaccccagctggggccccctgagccccgccgtgcagaagggcagcggccagatccagctgtggcagttcctgctggagctgctggccgacagagccaacgccggctgcatcgcctgggagggcggccacggcgagttcaagctgaccgaccccgacgaggtggccagaagatggggcgagagaaagagcaagcccaacatgaactacgacaagctgagcagagccctgagatactactacgacaagaacatcatgagcaaggtgcacggcaagagatacgcctacagattcgacttccagggcctggcccaggcctgccagcccccccccgcccacgcccacgccgccgccgccgccgccgccgccgccgccgccgcccaggacggcgccctgtacaagctgcccgccggcctggcccccctgcccttccccggcctgagcaagctgaacctgatggccgccagcgccggcgtggcccccgccggcttcagctactggcccggccccggccccgccgccaccgccgccgccgccaccgccgccctgtaccccagccccagcctgcagcccccccccggccccttcggcgccgtggccgccgccagccacctgggcggccactaccactag

SEQ ID NO: 81589 - DNA, 1416 bp, Artificial Sequence
  Description of Artificial Sequence: Synthetic coding sequence
atggacagcagctgccacaacgccaccaccaagatgctggccaccgcccccgccagaggcaacatgatgagcaccagcaagcccctggccttcagcatcgagagaatcatggccagaacccccgagcccaaggccctgcccgtgccccacttcctgcagggcgccctgcccaagggcgagcccaagcacagcctgcacctgaacagcagcatcccctgcatgatccccttcgtgcccgtggcctacgacaccagccccaaggccggcgtgaccggcagcgagcccagaaaggccagcctggaggcccccgccgcccccgccgccgtgcccagcgcccccgccttcagctgcagcgacctgctgaactgcgccctgagcctgaagggcgacctggccagagacgccctgcccctgcagcagtacaagctggtgagacccagagtggtgaaccacagcagcttccacgccatgggcgccctgtgctacctgaacagaggcgacggcccctgccaccccgccgccggcgtgaacatccaccccgtggccagctacttcctgagcagccccctgcacccccagcccaagacctacctggccgagagaaacaagctggtggtgcccgccgtggagaagtaccccagcggcgtggccttcaaggacctgagccaggcccagctgcagcactacatgaaggagagcgcccagctgctgagcgagaagatcgccttcaagaccagcgacttcagcagaggcagccccaacgccaagcccaaggtgttcacctgcgaggtgttcaacgcccactacaacctgaccagacacatgcccgtgcacaccggcgccagacccttcgtgtgcaaggtgtgcggcaagggcttcagacaggccagcaccctgtgcagacacaagatcatccacacccaggagaagccccacaagtgcaaccagtgcggcaaggccttcaacagaagcagcaccctgaacacccacaccagaatccacgccggctacaagcccttcgtgtgcgagttctgcggcaagggcttccaccagaagggcaactacaagaaccacaagctgacccacagcggcgagaagcagttcaagtgcaacatctgcaacaaggccttccaccaggtgtacaacctgaccttccacatgcacacccacaacgacaagaagcccttcacctgccccacctgcggcaagggcttctgcagaaacttcgacctgaagaagcacgtgagaaagctgcacgacagcagcctgggcctggccagaacccccgccggcgagcccggcaccgagccccccccccccctgccccagcagccccccatgaccctgccccccctgcagccccccctgcccacccccggccccctgcagcccggcctgcaccagggccaccagtag

SEQ ID NO: 81590 - DNA, 108 bp, Artificial Sequence
  Description of Artificial Sequence: Synthetic coding sequence
atggacagcagctgccacaacgccaccaccaagatgctggccaccgcccccgccagaggcaacatgatgagcaccagcaagcccctggccttcagcatcgagagatag

SEQ ID NO: 81591 - DNA, 1278 bp, Artificial Sequence
  Description of Artificial Sequence: Synthetic coding sequence
atggacagcagctgccacaacgccaccaccaagatgctggccaccgcccccgccagaggcaacatgatgagcaccagcaagcccctggccttcagcatcgagagaatcatggccagaacccccgagcccaaggccctgcccgtgccccacttcctgcagggcgccctgcccaagggcgagcccaagcacagcctgcacctgaacagcagcatcccctgcatgatccccttcgtgcccgtggcctacgacaccagccccaaggccggcgtgaccggcagcgagcccagaaaggccagcctggaggcccccgccgcccccgccgccgtgcccagcgcccccgccttcagctgcagcgacctgctgaactgcgccctgagcctgaagggcgacctggccagagacgccctgcccctgcagcagtacaagctgcccaagacctacctggccgagagaaacaagctggtggtgcccgccgtggagaagtaccccagcggcgtggccttcaaggacctgagccaggcccagctgcagcactacatgaaggagagcgcccagctgctgagcgagaagatcgccttcaagaccagcgacttcagcagaggcagccccaacgccaagcccaaggtgttcacctgcgaggtgtgcggcaaggtgttcaacgcccactacaacctgaccagacacatgcccgtgcacaccggcgccagacccttcgtgtgcaaggtgtgcggcaagggcttcagacaggccagcaccctgtgcagacacaagatcatccacacccaggagaagccccacaagtgcaaccagtgcggcaaggccttcaacagaagcagcaccctgaacacccacaccagaatccacgccggctacaagcccttcgtgtgcgagttctgcggcaagggcttccaccagaagggcaactacaagaaccacaagctgacccacagcggcgagaagcagttcaagtgcaacatctgcaacaaggccttccaccaggtgtacaacctgaccttccacatgcacacccacaacgacaagaagcccttcacctgccccacctgcggcaagggcttctgcagaaacttcgacctgaagaagcacgtgagaaagctgcacgacagcagcctgggcctggccagaacccccgccggcgagcccggcaccgagccccccccccccctgccccagcagccccccatgaccctgccccccctgcagccccccctgcccacccccggccccctgcagcccggcctgcaccagggccaccagtag

SEQ ID NO: 81592 - DNA, 1428 bp, Artificial Sequence
  Description of Artificial Sequence: Synthetic coding sequence
atggacagcagctgccacaacgccaccaccaagatgctggccaccgcccccgccagaggcaacatgatgagcaccagcaagcccctggccttcagcatcgagagaatcatggccagaacccccgagcccaaggccctgcccgtgccccacttcctgcagggcgccctgcccaagggcgagcccaagcacagcctgcacctgaacagcagcatcccctgcatgatccccttcgtgcccgtggcctacgacaccagccccaaggccggcgtgaccggcagcgagcccagaaaggccagcctggaggcccccgccgcccccgccgccgtgcccagcgcccccgccttcagctgcagcgacctgctgaactgcgccctgagcctgaagggcgacctggccagagacgccctgcccctgcagcagtacaagctggtgagacccagagtggtgaaccacagcagcttccacgccatgggcgccctgtgctacctgaacagaggcgacggcccctgccaccccgccgccggcgtgaacatccaccccgtggccagctacttcctgagcagccccctgcacccccagcccaagacctacctggccgagagaaacaagctggtggtgcccgccgtggagaagtaccccagcggcgtggccttcaaggacctgagccaggcccagctgcagcactacatgaaggagagcgcccagctgctgagcgagaagatcgccttcaagaccagcgacttcagcagaggcagccccaacgccaagcccaaggtgttcacctgcgaggtgtgcggcaaggtgttcaacgcccactacaacctgaccagacacatgcccgtgcacaccggcgccagacccttcgtgtgcaaggtgtgcggcaagggcttcagacaggccagcaccctgtgcagacacaagatcatccacacccaggagaagccccacaagtgcaaccagtgcggcaaggccttcaacagaagcagcaccctgaacacccacaccagaatccacgccggctacaagcccttcgtgtgcgagttctgcggcaagggcttccaccagaagggcaactacaagaaccacaagctgacccacagcggcgagaagcagttcaagtgcaacatctgcaacaaggccttccaccaggtgtacaacctgaccttccacatgcacacccacaacgacaagaagcccttcacctgccccacctgcggcaagggcttctgcagaaacttcgacctgaagaagcacgtgagaaagctgcacgacagcagcctgggcctggccagaacccccgccggcgagcccggcaccgagccccccccccccctgccccagcagccccccatgaccctgccccccctgcagccccccctgcccacccccggccccctgcagcccggcctgcaccagggccaccagtag

SEQ ID NO: 81593 - DNA, 1380 bp, Artificial Sequence
  Description of Artificial Sequence: Synthetic coding sequence
atggccagcagcgccagcctggagaccatggtgccccccgcctgccccagagccggcgccagccccgccaccagcaagaccctggccttcagcatcgagagaatcatggccaagaccagcgagcccagagcccccttcgagcccagacccggcgccctggaggccgacggcagccagggcaagaagctgctgaacctgtgcagccccctgccctgcatgatccccctgcagcccctgggctacgaggtgcccagcaagaccctgctgagctacagcgagctgtggaagagcagcctgagagccggcggcggcggcggcggcggcggcggcggcggcggcggcggcggcggcgcccccgtgtgcggcgccagcggcctgtgcaagaccaactgcggcgtgtgctgcaaggccgagctgggcctggcccccagcgccctgcccgccggcagagtgatcaagccccaggtgatcaaccaggccgtgggcctgcccgccagcggcagcctgtactacttcaactacctggacagcaccgcctacccccccagcgagctgctgagcggccacctgttccccagcggcctgctgaacgcccaggcccccgccgccctggccgcccaccccaagctgttcctgctggagaacgccaagctggccggcctggccgccgacaagttcccccaccccgccccctacccccacaaggagagactgcccgcccccctggagcaggtgctgaaggagaacagcgccctgaccgccgagagaggcggcgtgaagggccacagcaagctgcccggcggcagcgccgacggcaagcccaagaacttcacctgcgaggtgtgcggcaaggtgttcaacgcccactacaacctgaccagacacatgcccgtgcacaccggcgccagacccttcgtgtgcaaggtgtgcggcaagggcttcagacaggccagcaccctgtgcagacacaagatcatccacacccaggagaagccccacaagtgcaaccagtgcggcaaggccttcaacagaagcagcaccctgaacacccacatcagaatccacgccggctacaagcccttcgtgtgcgagttctgcggcaagggcttccaccagaagggcaactacaagaaccacaagctgacccacagcggcgagaagcagtacaagtgcaccatctgcaacaaggccttccaccaggtgtacaacctgaccttccacatgcacacccacaacgacaagaagcccttcacctgcgccacctgcggcaagggcttctgcagaaacttcgacctgaagaagcacgtgagaaagctgcacgacagcgtgggccccgccgcccccagcgccaaggacctgaccagaaccgtgcagagctag

SEQ ID NO: 81594 - DNA, 1380 bp, Artificial Sequence; identical to SEQ ID NO: 81593
  Description of Artificial Sequence: Synthetic coding sequence

SEQ ID NO: 81595 - DNA, 1380 bp, Artificial Sequence; identical to SEQ ID NO: 81593
  Description of Artificial Sequence: Synthetic coding sequence

SEQ ID NO: 81596 - DNA, 1140 bp, Artificial Sequence
  Description of Artificial Sequence: Synthetic coding sequence
atggccgccaccgccgccgccgtggtggccgaggaggacaccgagctgagagacctgctggtgcagaccctggagaacagcggcgtgctgaacagaatcaaggccgagctgagagccgccgtgttcctggccctggaggagcaggagaaggtggagaacaagacccccctggtgaacgagagcctgaagaagttcctgaacaccaaggacggcagactggtggccagcctggtggccgagttcctgcagttcttcaacctggacttcaccctggccgtgttccagcccgagaccagcaccctgcagggcctggagggcagagagaacctggccagagacctgggcatcatcgaggccgagggcaccgtgggcggccccctgctgctggaggtgatcagaagatgccagcagaaggagaagggccccaccaccggcgagggcgccctggacctgagcgacgtgcacagcccccccaagagccccgagggcaagaccagcgcccagaccacccccagcaagaaggccaacgacgaggccaaccagagcgacaccagcgtgagcctgagcgagcccaagagcaagagcagcctgcacctgctgagccacgagaccaagatcggcagcttcctgagcaacagaaccctggacggcaaggacaaggccggcctgtgccccgacgaggacgacatggagggcgacagcttcttcgacgaccccatccccaagcccgagaagacctacggcctgagaaaggagcccagaaagcaggccggcagcctggccagcctgagcgacgccccccccctgaagagcggcctgagcagcctggccggcgcccccagcctgaaggacagcgagagcaagagaggcaacaccgtgctgaaggacctgaagctgatcagcgacaagatcggcagcctgggcctgggcaccggcgaggacgacgactacgtggacgacttcaacagcaccagccacagaagcgagaagagcgagatcagcatcggcgaggagatcgaggaggacctgagcgtggagatcgacgacatcaacaccagcgacaagctggacgacctgacccaggacctgaccgtgagccagctgagcgacgtggccgactacctggaggacgtggcctag

SEQ ID NO: 81597 - DNA, 1200 bp, Artificial Sequence
  Description of Artificial Sequence: Synthetic coding sequence
atggccgccaccgccgccgccgtggtggccgaggaggacaccgagctgagagacctgctggtgcagaccctggagaacagcggcgtgctgaacagaatcaaggccgagctgagagccgccgtgttcctggccctggaggagcaggagaaggtggagaacaagacccccctggtgaacgagagcctgaagaagttcctgaacaccaaggacggcagactggtggccagcctggtggccgagttcctgcagttcttcaacctggacttcaccctggccgtgttccagcccgagaccagcaccctgcagggcctggagggcagagagaacctggccagagacctgggcatcatcgaggccgagggcaccgtgggcggccccctgctgctggaggtgatcagaagatgccagcagaaggagaagggccccaccaccggcgagggcgccctggacctgagcgacgtgcacagcccccccaagagccccgagggcaagaccagcgcccagaccacccccagcaagatccccagatacaagggccagggcaagaagaagaccagcggccagaaggccggcgacaagaaggccaacgacgaggccaaccagagcgacaccagcgtgagcctgagcgagcccaagagcaagagcagcctgcacctgctgagccacgagaccaagatcggcagcttcctgagcaacagaaccctggacggcaaggacaaggccggcctgtgccccgacgaggacgacatggagggcgacagcttcttcgacgaccccatccccaagcccgagaagacctacggcctgagaaaggagcccagaaagcaggccggcagcctggccagcctgagcgacgccccccccctgaagagcggcctgagcagcctggccggcgcccccagcctgaaggacagcgagagcaagagaggcaacaccgtgctgaaggacctgaagctgatcagcgacaagatcggcagcctgggcctgggcaccggcgaggacgacgactacgtggacgacttcaacagcaccagccacagaagcgagaagagcgagatcagcatcggcgaggagatcgaggaggacctgagcgtggagatcgacgacatcaacaccagcgacaagctggacgacctgacccaggacctgaccgtgagccagctgagcgacgtggccgactacctggaggacgtggcctag

SEQ ID NO: 81598 - DNA, 1095 bp, Artificial Sequence
  Description of Artificial Sequence: Synthetic coding sequence
atggccgccaccgccgccgccgtggtggccgaggaggacaccgagctgagagacctgctggtgcagaccctggagaacagcggcgtgctgaacagaatcaaggccgagctgagagccgccgtgttcctggccctggaggagcaggagaaggtggagaacaagacccccctggtgaacgagagcctgaagaagttcctgaacaccaaggacggcagactggtggccagcctggtggccgagttcctgcagttcttcaacctggacttcaccctggccgtgttccagcccgagaccagcaccctgcagggcctggagggcagagagaacctggccagagacctgggcatcatcgaggccgagggcaccgtgggcggccccctgctgctggaggtgatcagaagatgccagcagaaggagaagggccccaccaccggcgagaaggccaacgacgaggccaaccagagcgacaccagcgtgagcctgagcgagcccaagagcaagagcagcctgcacctgctgagccacgagaccaagatcggcagcttcctgagcaacagaaccctggacggcaaggacaaggccggcctgtgccccgacgaggacgacatggagggcgacagcttcttcgacgaccccatccccaagcccgagaagacctacggcctgagaaaggagcccagaaagcaggccggcagcctggccagcctgagcgacgccccccccctgaagagcggcctgagcagcctggccggcgcccccagcctgaaggacagcgagagcaagagaggcaacaccgtgctgaaggacctgaagctgatcagcgacaagatcggcagcctgggcctgggcaccggcgaggacgacgactacgtggacgacttcaacagcaccagccacagaagcgagaagagcgagatcagcatcggcgaggagatcgaggaggacctgagcgtggagatcgacgacatcaacaccagcgacaagaccatcacccagctggagtgcctgctgagcatcggcgccctgcacttcaagaacaccgccgacatcttcaaggtgatcttcatcctgctgaacaagatcctgcccatctag

SEQ ID NO: 81599 - DNA, 420 bp, Artificial Sequence
  Description of Artificial Sequence: Synthetic coding sequence
atgagcagcctgcccgtgccctacaagctgcccgtgagcctgagcgtgggcagctgcgtgatcatcaagggcacccccatccacagcttcatcaacgacccccagctgcaggtggacttctacaccgacatggacgaggacagcgacatcgccttcagattcagagtgcacttcggcaaccacgtggtgatgaacagaagagagttcggcatctggatgctggaggagaccaccgactacgtgcccttcgaggacggcaagcagttcgagctgtgcatctacgtgcactacaacgagtacgagatcaaggtgaacggcatcagaatctacggcttcgtgcacagaatcccccccagcttcgtgaagatggtgcaggtgagcagagacatcagcctgaccagcgtgtgcgtgtgcaactag

SEQ ID NO: 81600 - DNA, 8616 bp, Artificial Sequence
  Description of Artificial Sequence: Synthetic coding sequence
atgagaagaggcagactgctggagatcgccctgggcttcaccgtgctgctggccagctacaccagccacggcgccgacgccaacctggaggccggcaacgtgaaggagaccagagccagcagagccaagagaagaggcggcggcggccacgacgccctgaagggccccaacgtgtgcggcagcagatacaacgcctactgctgccccggctggaagaccctgcccggcggcaaccagtgcatcgtgcccatctgcagacacagctgcggcgacggcttctgcagcagacccaacatgtgcacctgccccagcggccagatcgcccccagctgcggcagcagaagcatccagcactgcaacatcagatgcatgaacggcggcagctgcagcgacgaccactgcctgtgccagaagggctacatcggcacccactgcggccagcccgtgtgcgagagcggctgcctgaacggcggcagatgcgtggcccccaacagatgcgcctgcacctacggcttcaccggcccccagtgcgagagagactacagaaccggcccctgcttcaccgtgatcagcaaccagatgtgccagggccagctgagcggcatcgtgtgcaccaagaccctgtgctgcgccaccgtgggcagagcctggggccacccctgcgagatgtgccccgcccagccccacccctgcagaagaggcttcatccccaacatcagaaccggcgcctgccaggacgtggacgagtgccaggccatccccggcctgtgccagggcggcaactgcatcaacaccgtgggcagcttcgagtgcaagtgccccgccggccacaagctgaacgaggtgagccagaagtgcgaggacatcgacgagtgcagcaccatccccggcatctgcgagggcggcgagtgcaccaacaccgtgagcagctacttctgcaagtgcccccccggcttctacaccagccccgacggcaccagatgcatcgacgtgagacccggctactgctacaccgccctgaccaacggcagatgcagcaaccagctgccccagagcatcaccaagatgcagtgctgctgcgacgccggcagatgctggagccccggcgtgaccgtggcccccgagatgtgccccatcagagccaccgaggacttcaacaagctgtgcagcgtgcccatggtgatccccggcagacccgagtacccccccccccccctgggccccatcccccccgtgctgcccgtgccccccggcttcccccccggcccccagatccccgtgcccagaccccccgtggagtacctgtaccccagcagagagccccccagagtgctgcccgtgaacgtgaccgactactgccagctggtgagatacctgtgccagaacggcagatgcatccccacccccggcagctgcagatgcgagtgcaacaagggcttccagctggacctgagaggcgagtgcatcgacgtggacgagtgcgagaagaacccctgcgccggcggcgagtgcatcaacaaccagggcagctacacctgccagtgcagagccggctaccagagcaccctgaccagaaccgagtgcagagacatcgacgagtgcctgcagaacggcagaatctgcaacaacggcagatgcatcaacaccgacggcagcttccactgcgtgtgcaacgccggcttccacgtgaccagagacggcaagaactgcgaggacatggacgagtgcagcatcagaaacatgtgcctgaacggcatgtgcatcaacgaggacggcagcttcaagtgcatctgcaagcccggcttccagctggccagcgacggcagatactgcaaggacatcaacgagtgcgagacccccggcatctgcatgaacggcagatgcgtgaacaccgacggcagctacagatgcgagtgcttccccggcctggccgtgggcctggacggcagagtgtgcgtggacacccacatgagaagcacctgctacggcggctacaagagaggccagtgcatcaagcccctgttcggcgccgtgaccaagagcgagtgctgctgcgccagcaccgagtacgccttcggcgagccctgccagccctgccccgcccagaacagcgccgagtaccaggccctgtgcagcagcggccccggcatgaccagcgccggcagcgacatcaacgagtgcgccctggaccccgacatctgccccaacggcatctgcgagaacctgagaggcacctacaagtgcatctgcaacagcggctacgaggtggacagcaccggcaagaactgcgtggacatcaacgagtgcgtgctgaacagcctgctgtgcgacaacggccagtgcagaaacacccccggcagcttcgtgtgcacctgccccaagggcttcatctacaagcccgacctgaagacctgcgaggacatcgacgagtgcgagagcagcccctgcatcaacggcgtgtgcaagaacagccccggcagcttcatctgcgagtgcagcagcgagagcaccctggaccccaccaagaccatctgcatcgagaccatcaagggcacctgctggcagaccgtgatcgacggcagatgcgagatcaacatcaacggcgccaccctgaagagccagtgctgcagcagcctgggcgccgcctggggcagcccctgcaccctgtgccaggtggaccccatctgcggcaagggctacagcagaatcaagggcacccagtgcgaggacatcgacgagtgcgaggtgttccccggcgtgtgcaagaacggcctgtgcgtgaacaccagaggcagcttcaagtgccagtgccccagcggcatgaccctggacgccaccggcagaatctgcctggacatcagactggagacctgcttcctgagatacgaggacgaggagtgcaccctgcccatcgccggcagacacagaatggacgcctgctgctgcagcgtgggcgccgcctggggcaccgaggagtgcgaggagtgccccatgagaaacacccccgagtacgaggagctgtgccccagaggccccggcttcgccaccaaggagatcaccaacggcaagcccttcttcaaggacatcaacgagtgcaagatgatccccagcctgtgcacccacggcaagtgcagaaacaccatcggcagcttcaagtgcagatgcgacagcggcttcgccctggacagcgaggagagaaactgcaccgacatcgacgagtgcagaatcagccccgacctgtgcggcagaggccagtgcgtgaacacccccggcgacttcgagtgcaagtgcgacgagggctacgagagcggcttcatgatgatgaagaactgcatggacatcgacgagtgccagagagaccccctgctgtgcagaggcggcgtgtgccacaacaccgagggcagctacagatgcgagtgcccccccggccaccagctgagccccaacatcagcgcctgcatcgacatcaacgagtgcgagctgagcgcccacctgtgccccaacggcagatgcgtgaacctgatcggcaagtaccagtgcgcctgcaaccccggctaccacagcacccccgacagactgttctgcgtggacatcgacgagtgcagcatcatgaacggcggctgcgagaccttctgcaccaacagcgagggcagctacgagtgcagctgccagcccggcttcgccctgatgcccgaccagagaagctgcaccgacatcgacgagtgcgaggacaaccccaacatctgcgacggcggccagtgcaccaacatccccggcgagtacagatgcctgtgctacgacggcttcatggccagcgaggacatgaagacctgcgtggacgtgaacgagtgcgacctgaaccccaacatctgcctgagcggcacctgcgagaacaccaagggcagcttcatctgccactgcgacatgggctacagcggcaagaagggcaagaccggctgcaccgacatcaacgagtgcgagatcggcgcccacaactgcggcaagcacgccgtgtgcaccaacaccgccggcagcttcaagtgcagctgcagccccggctggatcggcgacggcatcaagtgcaccgacctggacgagtgcagcaacggcacccacatgtgcagccagcacgccgactgcaagaacaccatgggcagctacagatgcctgtgcaaggagggctacaccggcgacggcttcacctgcaccgacctggacgagtgcagcgagaacctgaacctgtgcggcaacggccagtgcctgaacgcccccggcggctacagatgcgagtgcgacatgggcttcgtgcccagcgccgacggcaaggcctgcgaggacatcgacgagtgcagcctgcccaacatctgcgtgttcggcacctgccacaacctgcccggcctgttcagatgcgagtgcgagatcggctacgagctggacagaagcggcggcaactgcaccgacgtgaacgagtgcctggaccccaccacctgcatcagcggcaactgcgtgaacacccccggcagctacatctgcgactgcccccccgacttcgagctgaaccccaccagagtgggctgcgtggacaccagaagcggcaactgctacctggacatcagacccagaggcgacaacggcgacaccgcctgcagcaacgagatcggcgtgggcgtgagcaaggccagctgctgctgcagcctgggcaaggcctggggcaccccctgcgagatgtgccccgccgtgaacaccagcgagtacaagatcctgtgccccggcggcgagggcttcagacccaaccccatcaccgtgatcctggaggacatcgacgagtgccaggagctgcccggcctgtgccagggcggcaagtgcatcaacaccttcggcagcttccagtgcagatgccccaccggctactacctgaacgaggacaccagagtgtgcgacgacgtgaacgagtgcgagacccccggcatctgcggccccggcacctgctacaacaccgtgggcaactacacctgcatctgcccccccgactacatgcaggtgaacggcggcaacaactgcatggacatgagaagaagcctgtgctacagaaactactacgccgacaaccagacctgcgacggcgagctgctgttcaacatgaccaagaagatgtgctgctgcagctacaacatcggcagagcctggaacaagccctgcgagcagtgccccatccccagcaccgacgagttcgccaccctgtgcggcagccagagacccggcttcgtgatcgacatctacaccggcctgcccgtggacatcgacgagtgcagagagatccccggcgtgtgcgagaacggcgtgtgcatcaacatggtgggcagcttcagatgcgagtgccccgtgggcttcttctacaacgacaagctgctggtgtgcgaggacatcgacgagtgccagaacggccccgtgtgccagagaaacgccgagtgcatcaacaccgccggcagctacagatgcgactgcaagcccggctacagattcaccagcaccggccagtgcaacgacagaaacgagtgccaggagatccccaacatctgcagccacggccagtgcatcgacaccgtgggcagcttctactgcctgtgccacaccggcttcaagaccaacgacgaccagaccatgtgcctggacatcaacgagtgcgagagagacgcctgcggcaacggcacctgcagaaacaccatcggcagcttcaactgcagatgcaaccacggcttcatcctgagccacaacaacgactgcatcgacgtggacgagtgcgccagcggcaacggcaacctgtgcagaaacggccagtgcatcaacaccgtgggcagcttccagtgccagtgcaacgagggctacgaggtggcccccgacggcagaacctgcgtggacatcaacgagtgcctgctggagcccagaaagtgcgcccccggcacctgccagaacctggacggcagctacagatgcatctgcccccccggctacagcctgcagaacgagaagtgcgaggacatcgacgagtgcgtggaggagcccgagatctgcgccctgggcacctgcagcaacaccgagggcagcttcaagtgcctgtgccccgagggcttcagcctgagcagcagcggcagaagatgccaggacctgagaatgagctactgctacgccaagttcgagggcggcaagtgcagcagccccaagagcagaaaccacagcaagcaggagtgctgctgcgccctgaagggcgagggctggggcgacccctgcgagctgtgccccaccgagcccgacgaggccttcagacagatctgcccctacggcagcggcatcatcgtgggccccgacgacagcgccgtggacatggacgagtgcaaggagcccgacgtgtgcaagcacggccagtgcatcaacaccgacggcagctacagatgcgagtgccccttcggctacatcctggccggcaacgagtgcgtggacaccgacgagtgcagcgtgggcaacccctgcggcaacggcacctgcaagaacgtgatcggcggcttcgagtgcacctgcgaggagggcttcgagcccggccccatgatgacctgcgaggacatcaacgagtgcgcccagaaccccctgctgtgcgccttcagatgcgtgaacacctacggcagctacgagtgcaagtgccccgtgggctacgtgctgagagaggacagaagaatgtgcaaggacgaggacgagtgcgaggagggcaagcacgactgcaccgagaagcagatggagtgcaagaacctgatcggcacctacatgtgcatctgcggccccggctaccagagaagacccgacggcgagggctgcgtggacgagaacgagtgccagaccaagcccggcatctgcgagaacggcagatgcctgaacaccagaggcagctacacctgcgagtgcaacgacggcttcaccgccagccccaaccaggacgagtgcctggacaacagagagggctactgcttcaccgaggtgctgcagaacatgtgccagatcggcagcagcaacagaaaccccgtgaccaagagcgagtgctgctgcgacggcggcagaggctggggcccccactgcgagatctgccccttccagggcaccgtggccttcaagaagctgtgcccccacggcagaggcttcatgaccaacggcgccgacatcgacgagtgcaaggtgatccacgacgtgtgcagaaacggcgagtgcgtgaacgacagaggcagctaccactgcatctgcaagaccggctacacccccgacatcaccggcaccagctgcgtggacctgaacgagtgcaaccaggcccccaagccctgcaacttcatctgcaagaacaccgagggcagctaccagtgcagctgccccaagggctacatcctgcaggaggacggcagaagctgcaaggacctggacgagtgcgccaccaagcagcacaactgccagttcctgtgcgtgaacaccatcggcggcttcacctgcaagtgcccccccggcttcacccagcaccacaccagctgcatcgacaacaacgagtgcaccagcgacatcaacctgtgcggcagcaagggcatctgccagaacacccccggcagcttcacctgcgagtgccagagaggcttcagcctggaccagaccggcagcagctgcgaggacgtggacgagtgcgagggcaaccacagatgccagcacggctgccagaacatcatcggcggctacagatgcagctgcccccagggctacctgcagcactaccagtggaaccagtgcgtggacgagaacgagtgcctgagcgcccacatctgcggcggcgccagctgccacaacaccctgggcagctacaagtgcatgtgccccgccggcttccagtacgagcagttcagcggcggctgccaggacatcaacgagtgcggcagcgcccaggccccctgcagctacggctgcagcaacaccgagggcggctacctgtgcggctgcccccccggctacttcagaatcggccagggccactgcgtgagcggcatgggcatgggcagaggcaaccccgagccccccgtgagcggcgagatggacgacaacagcctgagccccgaggcctgctacgagtgcaagatcaacggctaccccaagagaggcagaaagagaagaagcaccaacgagaccgacgccagcaacatcgaggaccagagcgagaccgaggccaacgtgagcctggccagctgggacgtggagaagaccgccatcttcgccttcaacatcagccacgtgagcaacaaggtgagaatcctggagctgctgcccgccctgaccaccctgaccaaccacaacagatacctgatcgagagcggcaacgaggacggcttcttcaagatcaaccagaaggagggcatcagctacctgcacttcaccaagaagaagcccgtggccggcacctacagcctgcagatcagcagcacccccctgtacaagaagaaggagctgaaccagctggaggacaagtacgacaaggactacctgagcggcgagctgggcgacaacctgaagatgaagatccaggtgctgctgcactag

SEQ ID NO: 81601 - DNA, 2958 bp, Artificial Sequence
  Description of Artificial Sequence: Synthetic coding sequence
atgggcttcgtgcccagcgccgacggcaaggcctgcgaggacatcgacgagtgcagcctgcccaacatctgcgtgttcggcacctgccacaacctgcccggcctgttcagatgcgagtgcgagatcggctacgagctggacagaagcggcggcaactgcaccgacgtgaacgagtgcctggaccccaccacctgcatcagcggcaactgcgtgaacacccccggcagctacatctgcgactgcccccccgacttcgagctgaaccccaccagagtgggctgcgtggacaccagaagcggcaactgctacctggacatcagacccagaggcgacaacggcgacaccgcctgcagcaacgagatcggcgtgggcgtgagcaaggccagctgctgctgcagcctgggcaaggcctggggcaccccctgcgagatgtgccccgccgtgaacaccagcgagtacaagatcctgtgccccggcggcgagggcttcagacccaaccccatcaccgtgatcctggaggacatcgacgagtgccaggagctgcccggcctgtgccagggcggcaagtgcatcaacaccttcggcagcttccagtgcagatgccccaccggctactacctgaacgaggacaccagagtgtgcgacgacgtgaacgagtgcgagacccccggcatctgcggccccggcacctgctacaacaccgtgggcaactacacctgcatctgcccccccgactacatgcaggtgaacggcggcaacaactgcatggacatgagaagaagcctgtgctacagaaactactacgccgacaaccagacctgcgacggcgagctgctgttcaacatgaccaagaagatgtgctgctgcagctacaacatcggcagagcctggaacaagccctgcgagcagtgccccatccccagcaccgacgagttcgccaccctgtgcggcagccagagacccggcttcgtgatcgacatctacaccggcctgcccgtggacatcgacgagtgcagagagatccccggcgtgtgcgagaacggcgtgtgcatcaacatggtgggcagcttcagatgcgagtgccccgtgggcttcttctacaacgacaagctgctggtgtgcgaggacatcgacgagtgccagaacggccccgtgtgccagagaaacgccgagtgcatcaacaccgccggcagctacagatgcgactgcaagcccggctacagattcaccagcaccggccagtgcaacgacagaaacgagtgccaggagatccccaacatctgcagccacggccagtgcatcgacaccgtgggcagcttctactgcctgtgccacaccggcttcaagaccaacgacgaccagaccatgtgcctggacatcaacgagtgcgagagagacgcctgcggcaacggcacctgcagaaacaccatcggcagcttcaactgcagatgcaaccacggcttcatcctgagccacaacaacgactgcatcgacgtggacgagtgcgccagcggcaacggcaacctgtgcagaaacggccagtgcatcaacaccgtgggcagcttccagtgccagtgcaacgagggctacgaggtggcccccgacggcagaacctgcgtggacatcaacgagtgcctgctggagcccagaaagtgcgcccccggcacctgccagaacctggacggcagctacagatgcatctgcccccccggctacagcctgcagaacgagaagtgcgaggacatcgacgagtgcgtggaggagcccgagatctgcgccctgggcacctgcagcaacaccgagggcagcttcaagtgcctgtgccccgagggcttcagcctgagcagcagcggcagaagatgccaggacctgagaatgagctactgctacgccaagttcgagggcggcaagtgcagcagccccaagagcagaaaccacagcaagcaggagtgctgctgcgccctgaagggcgagggctggggcgacccctgcgagctgtgccccaccgagcccgacgaggccttcagacagatctgcccctacggcagcggcatcatcgtgggccccgacgacagcgccgtggacatggacgagtgcaaggagcccgacgtgtgcaagcacggccagtgcatcaacaccgacggcagctacagatgcgagtgccccttcggctacatcctggccggcaacgagtgcgtggacaccgacgagtgcagcgtgggcaacccctgcggcaacggcacctgcaagaacgtgatcggcggcttcgagtgcacctgcgaggagggcttcgagcccggccccatgatgacctgcgaggacatcaacgagtgcgcccagaaccccctgctgtgcgccttcagatgcgtgaacacctacggcagctacgagtgcaagtgccccgtgggctacgtgctgagagaggacagaagaatgtgcaaggacgaggacgagtgcgaggagggcaagcacgactgcaccgagaagcagatggagtgcaagaacctgatcggcacctacatgtgcatctgcggccccggctaccagagaagacccgacggcgagggctgcgtggacgagaacgagtgccagaccaagcccggcatctgcgagaacggcagatgcctgaacaccagaggcagctacacctgcgagtgcaacgacggcttcaccgccagccccaaccaggacgagtgcctggacgtgatcctgagcctgctgctgctgagccccgccttccccagctgcttcttcagccccagaaccatcggcaagggcaccgccagccagagatgctacaagacctgcgtgagaagcgcccccgccaccggcacccccagccccaacagaaacgccgccgtgaccgagggcgaggccggcgtgcccaccgtgagaagcgccctgagcagaggcctgtggctgagcagaaacagcgtgcccatggccgaggacagctag

SEQ ID NO: 81602 - DNA, 3450 bp, Artificial Sequence
  Description of Artificial Sequence: Synthetic coding sequence
atgagaagaggcagactgctggagatcgccctgggcttcaccgtgctgctggccagctacaccagccacggcgccgacgccaacctggaggccggcaacgtgaaggagaccagagccagcagagccaagagaagaggcggcggcggccacgacgccctgaagggccccaacgtgtgcggcagcagatacaacgcctactgctgccccggctggaagaccctgcccggcggcaaccagtgcatcgtgcccatctgcagacacagctgcggcgacggcttctgcagcagacccaacatgtgcacctgccccagcggccagatcgcccccagctgcggcagcagaagcatccagcactgcaacatcagatgcatgaacggcggcagctgcagcgacgaccactgcctgtgccagaagggctacatcggcacccactgcggccagcccgtgtgcgagagcggctgcctgaacggcggcagatgcgtggcccccaacagatgcgcctgcacctacggcttcaccggcccccagtgcgagagagactacagaaccggcccctgcttcaccgtgatcagcaaccagatgtgccagggccagctgagcggcatcgtgtgcaccaagaccctgtgctgcacctacatcaacgagtgcgagatcggcgcccacaactgcggcaagcacgccgtgtgcaccaacaccgccggcagcttcaagtgcagctgcagccccggctggatcggcgacggcatcaagtgcaccgacctggacgagtgcagcaacggcacccacatgtgcagccagcacgccgactgcaagaacaccatgggcagctacagatgcctgtgcaaggagggctacaccggcgacggcttcacctgcaccgacctggacgagtgcagcgagaacctgaacctgtgcggcaacggccagtgcctgaacgcccccggcggctacagatgcgagtgcgacatgggcttcgtgcccagcgccgacggcaaggcctgcgaggacatcgacgagtgcagcctgcccaacatctgcgtgttcggcacctgccacaacctgcccggcctgttcagatgcgagtgcgagatcggctacgagctggacagaagcggcggcaactgcaccgacgtgaacgagtgcctggaccccaccacctgcatcagcggcaactgcgtgaacacccccggcagctacatctgcgactgcccccccgacttcgagctgaaccccaccagagtgggctgcgtggacaccagaagcggcaactgctacctggacatcagacccagaggcgacaacggcgacaccgcctgcagcaacgagatcggcgtgggcgtgagcaaggccagctgctgctgcagcctgggcaaggcctggggcaccccctgcgagatgtgccccgccgtgaacaccagcgagtacaagatcctgtgccccggcggcgagggcttcagacccaaccccatcaccgtgatcctggaggacatcgacgagtgccaggagctgcccggcctgtgccagggcggcaagtgcatcaacaccttcggcagcttccagtgcagatgccccaccggctactacctgaacgaggacaccagagtgtgcgacgacgtgaacgagtgcgagacccccggcatctgcggccccggcacctgctacaacaccgtgggcaactacacctgcatctgcccccccgactacatgcaggtgaacggcggcaacaactgcatggacatgagaagaagcctgtgctacagaaactactacgccgacaaccagacctgcgacggcgagctgctgttcaacatgaccaagaagatgtgctgctgcagctacaacatcggcagagcctggaacaagccctgcgagcagtgccccatccccagcaccgacgagttcgccaccctgtgcggcagccagagacccggcttcgtgatcgacatctacaccggcctgcccgtggacatcgacgagtgcagagagatccccggcgtgtgcgagaacggcgtgtgcatcaacatggtgggcagcttcagatgcgagtgccccgtgggcttcttctacaacgacaagctgctggtgtgcgaggacatcgacgagtgccagaacggccccgtgtgccagagaaacgccgagtgcatcaacaccgccggcagctacagatgcgactgcaagcccggctacagattcaccagcaccggccagtgcaacgacagaaacgagtgccaggagatccccaacatctgcagccacggccagtgcatcgacaccgtgggcagcttctactgcctgtgccacaccggcttcaagaccaacgacgaccagaccatgtgcctggacatcaacgagtgcgagagagacgcctgcggcaacggcacctgcagaaacaccatcggcagcttcaactgcagatgcaaccacggcttcatcctgagccacaacaacgactgcatcgacgtggacgagtgcgccagcggcaacggcaacctgtgcagaaacggccagtgcatcaacaccgtgggcagcttccagtgccagtgcaacgagggctacgaggtggcccccgacggcagaacctgcgtggacatcaacgagtgcctgctggagcccagaaagtgcgcccccggcacctgccagaacctggacggcagctacagatgcatctgcccccccggctacagcctgcagaacgagaagtgcgaggacatcgacgagtgcgtggaggagcccgagatctgcgccctgggcacctgcagcaacaccgagggcagcttcaagtgcctgtgccccgagggcttcagcctgagcagcagcggcagaagatgccaggacctgagaatgagctactgctacgccaagttcgagggcggcaagtgcagcagccccaagagcagaaaccacagcaagcaggagtgctgctgcgccctgaagggcgagggctggggcgacccctgcgagctgtgccccaccgagcccgacgaggccttcagacagatctgcccctacggcagcggcatcatcgtgggccccgacgacagcgccgtggacatggacgagtgcaaggagcccgacgtgtgcaagcacggccagtgcatcaacaccgacggcagctacagatgcgagtgccccttcggctacatcctggccggcaacgagtgcgtggacaccgacgagtgcagcgtgggcaacccctgcggcaacggcacctgcaagaacgtgatcggcggcttcgagtgcacctgcgaggagggcttcgagcccggccccatgatgacctgcgaggacatcaacgagtgcgcccagaaccccctgctgtgcgccttcagatgcgtgaacacctacggcagctacgagtgcaagtgccccgtgggctacgtgctgagagaggacagaagaatgtgcaaggacgaggacgagtgcgaggagggcaagcacgactgcacctag

SEQ ID NO: 81603 - DNA, 8739 bp, Artificial Sequence
  Description of Artificial Sequence: Synthetic coding sequence
atgggcagaagaagaagactgtgcctgcagctgtacttcctgtggctgggctgcgtggtgctgtgggcccagggcaccgccggccagccccagccccccccccccaagccccccagaccccagccccccccccagcaggtgagaagcgccaccgccggcagcgagggcggcttcctggcccccgagtacagagaggagggcgccgccgtggccagcagagtgagaagaagaggccagcaggacgtgctgagaggccccaacgtgtgcggcagcagattccacagctactgctgccccggctggaagaccctgcccggcggcaaccagtgcatcgtgcccatctgcagaaacagctgcggcgacggcttctgcagcagacccaacatgtgcacctgcagcagcggccagatcagcagcacctgcggcagcaagagcatccagcagtgcagcgtgagatgcatgaacggcggcacctgcgccgacgaccactgccagtgccagaagggctacatcggcacctactgcggccagcccgtgtgcgagaacggctgccagaacggcggcagatgcatcggccccaacagatgcgcctgcgtgtacggcttcaccggcccccagtgcgagagagactacagaaccggcccctgcttcacccaggtgaacaaccagatgtgccagggccagctgaccggcatcgtgtgcaccaagaccctgtgctgcgccaccatcggcagagcctggggccacccctgcgagatgtgccccgcccagccccagccctgcagaagaggcttcatccccaacatcagaaccggcgcctgccaggacgtggacgagtgccaggccatccccggcatctgccagggcggcaactgcatcaacaccgtgggcagcttcgagtgcagatgccccgccggccacaagcagagcgagaccacccagaagtgcgaggacatcgacgagtgcagcatcatccccggcatctgcgagaccggcgagtgcagcaacaccgtgggcagctacttctgcgtgtgccccagaggctacgtgaccagcaccgacggcagcagatgcatcgaccagagaaccggcatgtgcttcagcggcctggtgaacggcagatgcgcccaggagctgcccggcagaatgaccaagatgcagtgctgctgcgagcccggcagatgctggggcatcggcaccatccccgaggcctgccccgtgagaggcagcgaggagtacagaagactgtgcatggacggcctgcccatgggcggcatccccggcagcgccggcagcagacccggcggcaccggcggcaacggcttcgcccccagcggcaacggcaacggctacggccccggcggcaccggcttcatccccatccccggcggcaacggcttcagccccggcgtgggcggcgccggcgtgggcgccggcggccagggccccatcatcaccggcctgaccatcctgaaccagaccatcgacatctgcaagcaccacgccaacctgtgcctgaacggcagatgcatccccaccgtgagcagctacagatgcgagtgcaacatgggctacaagcaggacgccaacggcgactgcatcgacgtggacgagtgcaccagcaacccctgcaccaacggcgactgcgtgaacacccccggcagctactactgcaagtgccacgccggcttccagagaacccccaccaagcaggcctgcatcgacatcgacgagtgcatccagaacggcgtgctgtgcaagaacggcagatgcgtgaacaccgacggcagcttccagtgcatctgcaacgccggcttcgagctgaccaccgacggcaagaactgcgtggaccacgacgagtgcaccaccaccaacatgtgcctgaacggcatgtgcatcaacgaggacggcagcttcaagtgcatctgcaagcccggcttcgtgctggcccccaacggcagatactgcaccgacgtggacgagtgccagacccccggcatctgcatgaacggccactgcatcaacagcgagggcagcttcagatgcgactgcccccccggcctggccgtgggcatggacggcagagtgtgcgtggacacccacatgagaagcacctgctacggcggcatcaagaagggcgtgtgcgtgagacccttccccggcgccgtgaccaagagcgagtgctgctgcgccaaccccgactacggcttcggcgagccctgccagccctgccccgccaagaacagcgccgagttccacggcctgtgcagcagcggcgtgggcatcaccgtggacggcagagacatcaacgagtgcgccctggaccccgacatctgcgccaacggcatctgcgagaacctgagaggcagctacagatgcaactgcaacagcggctacgagcccgacgccagcggcagaaactgcatcgacatcgacgagtgcctggtgaacagactgctgtgcgacaacggcctgtgcagaaacacccccggcagctacagctgcacctgcccccccggctacgtgttcagaaccgagaccgagacctgcgaggacatcaacgagtgcgagagcaacccctgcgtgaacggcgcctgcagaaacaacctgggcagcttcaactgcgagtgcagccccggcagcaagctgagcagcaccggcctgatctgcatcgacagcctgaagggcacctgctggctgaacatccaggacagcagatgcgaggtgaacatcaacggcgccaccctgaagagcgagtgctgcgccaccctgggcgccgcctggggcagcccctgcgagagatgcgagctggacaccgcctgccccagaggcctggccagaatcaagggcgtgacctgcgaggacgtgaacgagtgcgaggtgttccccggcgtgtgccccaacggcagatgcgtgaacagcaagggcagcttccactgcgagtgccccgagggcctgaccctggacggcaccggcagagtgtgcctggacatcagaatggagcagtgctacctgaagtgggacgaggacgagtgcatccaccccgtgcccggcaagttcagaatggacgcctgctgctgcgccgtgggcgccgcctggggcaccgagtgcgaggagtgccccaagcccggcaccaaggagtacgagaccctgtgccccagaggcgccggcttcgccaacagaggcgacgtgctgaccggcagacccttctacaaggacatcaacgagtgcaaggccttccccggcatgtgcacctacggcaagtgcagaaacaccatcggcagcttcaagtgcagatgcaacagcggcttcgccctggacatggaggagagaaactgcaccgacatcgacgagtgcagaatcagccccgacctgtgcggcagcggcatctgcgtgaacacccccggcagcttcgagtgcgagtgcttcgagggctacgagagcggcttcatgatgatgaagaactgcatggacatcgacgagtgcgagagaaaccccctgctgtgcagaggcggcacctgcgtgaacaccgagggcagcttccagtgcgactgccccctgggccacgagctgagccccagcagagaggactgcgtggacatcaacgagtgcagcctgagcgacaacctgtgcagaaacggcaagtgcgtgaacatgatcggcacctaccagtgcagctgcaaccccggctaccaggccacccccgacagacagggctgcaccgacatcgacgagtgcatgatcatgaacggcggctgcgacacccagtgcaccaacagcgagggcagctacgagtgcagctgcagcgagggctacgccctgatgcccgacggcagaagctgcgccgacatcgacgagtgcgagaacaaccccgacatctgcgacggcggccagtgcaccaacatccccggcgagtacagatgcctgtgctacgacggcttcatggccagcatggacatgaagacctgcatcgacgtgaacgagtgcgacctgaacagcaacatctgcatgttcggcgagtgcgagaacaccaagggcagcttcatctgccactgccagctgggctacagcgtgaagaagggcaccaccggctgcaccgacgtggacgagtgcgagatcggcgcccacaactgcgacatgcacgccagctgcctgaacatccccggcagcttcaagtgcagctgcagagagggctggatcggcaacggcatcaagtgcatcgacctggacgagtgcagcaacggcacccaccagtgcagcatcaacgcccagtgcgtgaacacccccggcagctacagatgcgcctgcagcgagggcttcaccggcgacggcttcacctgcagcgacgtggacgagtgcgccgagaacatcaacctgtgcgagaacggccagtgcctgaacgtgcccggcgcctacagatgcgagtgcgagatgggcttcacccccgccagcgacagcagaagctgccaggacatcgacgagtgcagcttccagaacatctgcgtgttcggcacctgcaacaacctgcccggcatgttccactgcatctgcgacgacggctacgagctggacagaaccggcggcaactgcaccgacatcgacgagtgcgccgaccccatcaactgcgtgaacggcctgtgcgtgaacacccccggcagatacgagtgcaactgcccccccgacttccagctgaaccccaccggcgtgggctgcgtggacaacagagtgggcaactgctacctgaagttcggccccagaggcgacggcagcctgagctgcaacaccgagatcggcgtgggcgtgagcagaagcagctgctgctgcagcctgggcaaggcctggggcaacccctgcgagacctgcccccccgtgaacagcaccgagtactacaccctgtgccccggcggcgagggcttcagacccaaccccatcaccatcatcctggaggacatcgacgagtgccaggagctgcccggcctgtgccagggcggcaactgcatcaacaccttcggcagcttccagtgcgagtgcccccagggctactacctgagcgaggacaccagaatctgcgaggacatcgacgagtgcttcgcccaccccggcgtgtgcggccccggcacctgctacaacaccctgggcaactacacctgcatctgcccccccgagtacatgcaggtgaacggcggccacaactgcatggacatgagaaagagcttctgctacagaagctacaacggcaccacctgcgagaacgagctgcccttcaacgtgaccaagagaatgtgctgctgcacctacaacgtgggcaaggcctggaacaagccctgcgagccctgccccacccccggcaccgccgacttcaagaccatctgcggcaacatccccggcttcaccttcgacatccacaccggcaaggccgtggacatcgacgagtgcaaggagatccccggcatctgcgccaacggcgtgtgcatcaaccagatcggcagcttcagatgcgagtgccccaccggcttcagctacaacgacctgctgctggtgtgcgaggacatcgacgagtgcagcaacggcgacaacctgtgccagagaaacgccgactgcatcaacagccccggcagctacagatgcgagtgcgccgccggcttcaagctgagccccaacggcgcctgcgtggacagaaacgagtgcctggagatccccaacgtgtgcagccacggcctgtgcgtggacctgcagggcagctaccagtgcatctgccacaacggcttcaaggccagccaggaccagaccatgtgcatggacgtggacgagtgcgagagacacccctgcggcaacggcacctgcaagaacaccgtgggcagctacaactgcctgtgctaccccggcttcgagctgacccacaacaacgactgcctggacatcgacgagtgcagcagcttcttcggccaggtgtgcagaaacggcagatgcttcaacgagatcggcagcttcaagtgcctgtgcaacgagggctacgagctgacccccgacggcaagaactgcatcgacaccaacgagtgcgtggccctgcccggcagctgcagccccggcacctgccagaacctggagggcagcttcagatgcatctgcccccccggctacgaggtgaagagcgagaactgcatcgacatcaacgagtgcgacgaggaccccaacatctgcctgttcggcagctgcaccaacacccccggcggcttccagtgcctgtgcccccccggcttcgtgctgagcgacaacggcagaagatgcttcgacaccagacagagcttctgcttcaccaacttcgagaacggcaagtgcagcgtgcccaaggccttcaacaccaccaaggccaagtgctgctgcagcaagatgcccggcgagggctggggcgacccctgcgagctgtgccccaaggacgacgaggtggccttccaggacctgtgcccctacggccacggcaccgtgcccagcctgcacgacaccagagaggacgtgaacgagtgcctggagagccccggcatctgcagcaacggccagtgcatcaacaccgacggcagcttcagatgcgagtgccccatgggctacaacctggactacaccggcgtgagatgcgtggacaccgacgagtgcagcatcggcaacccctgcggcaacggcacctgcaccaacgtgatcggcagcttcgagtgcaactgcaacgagggcttcgagcccggccccatgatgaactgcgaggacatcaacgagtgcgcccagaaccccctgctgtgcgccttcagatgcatgaacaccttcggcagctacgagtgcacctgccccatcggctacgccctgagagaggaccagaagatgtgcaaggacctggacgagtgcgccgagggcctgcacgactgcgagagcagaggcatgatgtgcaagaacctgatcggcaccttcatgtgcatctgcccccccggcatggccagaagacccgacggcgagggctgcgtggacgagaacgagtgcagaaccaagcccggcatctgcgagaacggcagatgcgtgaacatcatcggcagctacagatgcgagtgcaacgagggcttccagagcagcagcagcggcaccgagtgcctggacaacagacagggcctgtgcttcgccgaggtgctgcagaccatctgccagatggccagcagcagcagaaacctggtgaccaagagcgagtgctgctgcgacggcggcagaggctggggccaccagtgcgagctgtgccccctgcccggcaccgcccagtacaagaagatctgcccccacggccccggctacaccaccgacggcagagacatcgacgagtgcaaggtgatgcccaacctgtgcaccaacggccagtgcatcaacaccatgggcagcttcagatgcttctgcaaggtgggctacaccaccgacatcagcggcaccagctgcatcgacctggacgagtgcagccagagccccaagccctgcaactacatctgcaagaacaccgagggcagctaccagtgcagctgccccagaggctacgtgctgcaggaggacggcaagacctgcaaggacctggacgagtgccagaccaagcagcacaactgccagttcctgtgcgtgaacaccctgggcggcttcacctgcaagtgcccccccggcttcacccagcaccacaccgcctgcatcgacaacaacgagtgcggcagccagcccagcctgtgcggcgccaagggcatctgccagaacacccccggcagcttcagctgcgagtgccagagaggcttcagcctggacgccaccggcctgaactgcgaggacgtggacgagtgcgacggcaaccacagatgccagcacggctgccagaacatcctgggcggctacagatgcggctgcccccagggctacatccagcactaccagtggaaccagtgcgtggacgagaacgagtgcagcaaccccaacgcctgcggcagcgccagctgctacaacaccctgggcagctacaagtgcgcctgccccagcggcttcagcttcgaccagttcagcagcgcctgccacgacgtgaacgagtgcagcagcagcaagaacccctgcaactacggctgcagcaacaccgagggcggctacctgtgcggctgcccccccggctactacagagtgggccagggccactgcgtgagcggcatgggcttcaacaagggccagtacctgagcctggacaccgaggtggacgaggagaacgccctgagccccgaggcctgctacgagtgcaagatcaacggctacagcaagaaggacagcagacagaagagaagcatccacgagcccgaccccaccgccgtggagcagatcagcctggagagcgtggacatggacagccccgtgaacatgaagttcaacctgagccacctgggcagcaaggagcacatcctggagctgagacccgccatccagcccctgaacaaccacatcagatacgtgatcagccagggcaacgacgacagcgtgttcagaatccaccagagaaacggcctgagctacctgcacaccgccaagaagaagctgatgcccggcacctacaccctggagatcaccagcatccccctgtacaagaagaaggagctgaagaagctggaggagagcaacgaggacgactacctgctgggcgagctgggcgaggccctgagaatgagactgcagatccagctgtactag

SEQ ID NO: 81604 - DNA, 8739 bp, Artificial Sequence; identical to SEQ ID NO: 81603
  Description of Artificial Sequence: Synthetic coding sequence

SEQ ID NO: 81605 - DNA, 597 bp, Artificial Sequence
  Description of Artificial Sequence: Synthetic coding sequence
atgggcctgagaaagggccacggcaccctgggccagggcctgagcgccctgcagagcgagcagggcagactgatccagctgctgagcgagagccagggccacatggcccacctggtgaacagcgtgagcgacatcctggacgccctgcagagagacagaggcctgggcagacccagaaacaaggccgacctgcagagagcccccgccagaggcaccagacccagaggctgcgccaccggcagcagacccagagactgcctggacgtgctgctgagcggccagcaggacgacggcgtgtacagcgtgttccccacccactaccccgccggcttccaggtgtactgcgacatgagaaccgacggcggcggctggaccgtgttccagagaagagaggacggcagcgtgaacttcttcagaggctgggacgcctacagagacggcttcggcagactgaccggcgagcactggctgggccccctggactggtgcaccctgagcctggccctgctggtgcccgtggcccccagccccacccccccccacagcttcgtgaacgtgctgcacccccccgtgcccggcggccccaccctgcagtag

SEQ ID NO: 81606 - DNA, 912 bp, Artificial Sequence
  Description of Artificial Sequence: Synthetic coding sequence
atgggcctgagaaagggccacggcaccctgggccagggcctgagcgccctgcagagcgagcagggcagactgatccagctgctgagcgagagccagggccacatggcccacctggtgaacagcgtgagcgacatcctggacgccctgcagagagacagaggcctgggcagacccagaaacaaggccgacctgcagagagcccccgccagaggcaccagacccagaggctgcgccaccggcagcagacccagagactgcctggacgtgctgctgagcggccagcaggacgacggcgtgtacagcgtgttccccacccactaccccgccggcttccaggtgtactgcgacatgagaaccgacggcggcggctggaccgtgttccagagaagagaggacggcagcgtgaacttcttcagaggctgggacgcctacagagacggcttcggcagactgaccggcgagcactggctgggcctgaagagaatccacgccctgaccacccaggccgcctacgagctgcacgtggacctggaggacttcgagaacggcaccgcctacgccagatacggcagcttcggcgtgggcctgttcagcgtggaccccgaggaggacggctaccccctgaccgtggccgactacagcggcaccgccggcgacagcctgctgaagcacagcggcatgagattcaccaccaaggacagagacagcgaccacagcgagaacaactgcgccgccttctacagaggcgcctggtggtacagaaactgccacaccagcaacctgaacggccagtacctgagaggcgcccacgccagctacgccgacggcgtggagtggagcagctggaccggctggcagtacagcctgaagttcagcgagatgaagatcagacccgtgagagaggacagatag

SEQ ID NO: 81607 - DNA, 1386 bp, Artificial Sequence
  Description of Artificial Sequence: Synthetic coding sequence
atggtgaacgacagatggaagaccatgggcggcgccgcccagctggaggacagacccagagacaagccccagagacccagctgcggctacgtgctgtgcaccgtgctgctggccctggccgtgctgctggccgtggccgtgaccggcgccgtgctgttcctgaaccacgcccacgcccccggcaccgcccccccccccgtggtgagcaccggcgccgccagcgccaacagcgccctggtgaccgtggagagagccgacagcagccacctgagcatcctgatcgaccccagatgccccgacctgaccgacagcttcgccagactggagagcgcccaggccagcgtgctgcaggccctgaccgagcaccaggcccagcccagactggtgggcgaccaggagcaggagctgctggacaccctggccgaccagctgcccagactgctggccagagccagcgagctgcagaccgagtgcatgggcctgagaaagggccacggcaccctgggccagggcctgagcgccctgcagagcgagcagggcagactgatccagctgctgagcgagagccagggccacatggcccacctggtgaacagcgtgagcgacatcctggacgccctgcagagagacagaggcctgggcagacccagaaacaaggccgacctgcagagagcccccgccagaggcaccagacccagaggctgcgccaccggcagcagacccagagactgcctggacgtgctgctgagcggccagcaggacgacggcgtgtacagcgtgttccccacccactaccccgccggcttccaggtgtactgcgacatgagaaccgacggcggcggctggaccgtgttccagagaagagaggacggcagcgtgaacttcttcagaggctgggacgcctacagagacggcttcggcagactgaccggcgagcactggctgggcctgaagagaatccacgccctgaccacccaggccgcctacgagctgcacgtggacctggaggacttcgagaacggcaccgcctacgccagatacggcagcttcggcgtgggcctgttcagcgtggaccccgaggaggacggctaccccctgaccgtggccgactacagcggcaccgccggcgacagcctgctgaagcacagcggcatgagattcaccaccaaggacagagacagcgaccacagcgagaacaactgcgccgccttctacagaggcgcctggtggtacagaaactgccacaccagcaacctgaacggccagtacctgagaggcgcccacgccagctacgccgacggcgtggagtggagcagctggaccggctggcagtacagcctgaagttcagcgagatgaagatcagacccgtgagagaggacagatag

SEQ ID NO: 81608 - DNA, 933 bp, Artificial Sequence
  Description of Artificial Sequence: Synthetic coding sequence
tgaaccggcgccgtgctgttcctgaaccacgcccacgcccccggcaccgcccccccccccgtggtgagcaccggcgccgccagcgccaacagcgccctggtgaccgtggagagagccgacagcagccacctgagcatcctgatcgaccccagatgccccgacctgaccgacagcttcgccagactggagagcgcccaggccagcgtgctgcaggccctgaccgagcaccaggcccagcccagactggtgggcgaccaggagcaggagctgctggacaccctggccgaccagctgcccagactgctggccagagccagcgagctgcagaccgagtgcatgggcctgagaaagggccacggcaccctgggccagggcctgagcgccctgcagagcgagcagggcagactgatccagctgctgagcgagagccagggccacatggcccacctggtgaacagcgtgagcgacatcctggacgccctgcagagagacagaggcctgggcagacccagaaacaaggccgacctgcagagagcccccgccagaggcaccagacccagaggctgcgccaccggcagcagacccagagactgcctggacgtgctgctgagcggccagcaggacgacggcgtgtacagcgtgttccccacccactaccccgccggcttccaggtgtactgcgacatgagaaccgacggcggcggctggaccgtgttccagagaagagaggacggcagcgtgaacttcttcagaggctgggacgcctacagagacggcttcggcagactgaccggcgagcactggctgggccccctggactggtgcaccctgagcctggccctgctggtgcccgtggcccccagccccacccccccccacagcttcgtgaacgtgctgcacccccccgtgcccggcggccccaccctgcagtag

SEQ ID NO: 81609 - DNA, 1386 bp, Artificial Sequence; identical to SEQ ID NO: 81607
  Description of Artificial Sequence: Synthetic coding sequence

SEQ ID NO: 81610 - DNA, 870 bp, Artificial Sequence
  Description of Artificial Sequence: Synthetic coding sequence
atggtgaacgacagatggaagaccatgggcggcgccgcccagctggaggacagacccagagacaagccccagagacccagctgcggctacgtgctgtgcaccgtgctgctggccctggccgtgctgctggccgtggccgtgaccggcgccgtgctgttcctgaaccacgcccacgcccccggcaccgcccccccccccgtggtgagcaccggcgccgccagcgccaacagcgccctggtgaccgtggagagagccgacagcagccacctgagcatcctgatcgaccccagatgccccgacctgaccgacagcttcgccagactggagagcgcccaggccagcgtgctgcaggccctgaccgagcaccaggcccagcccagactggtgggcgaccaggagcaggagctgctggacaccctggccgaccagctgcccagactgctggccagagccagcgagctgcagaccgagtgcatgggcctgagaaagggccacggcaccctgggccagggcctgagcgccctgcagagcgagcagggcagactgatccagctgctgagcgagagccagggccacatggcccacctggtgaacagcgtgagcgacatcctggacgccctgcagagagacagaggcctgggcagacccagaaacaaggccgacctgcagagagcccccgccagaggcaccagacccagaggctgcgccaccggcagcagacccagagactgcctggacgtgctgctgagcggccagcaggacgacggcgtgtacagcgtgttccccacccactaccccgccggcttccaggtgtactgcgacatgagaaccgacggcggcggctggaccgtgttccagagaagagagtag

SEQ ID NO: 81611 - DNA, 540 bp, Artificial Sequence
  Description of Artificial Sequence: Synthetic coding sequence
atggtgaacgacagatggaagaccatgggcggcgccgcccagctggaggacagacccagagacaagccccaggccagaaagctgagactgagagagagacccagctgcggctacgtgctgtgcaccgtgctgctggccctggccgtgctgctggccgtggccgtgaccggcgccgtgctgttcctgaaccacgcccacgcccccggcaccgcccccccccccgtggtgagcaccggcgccgccagcgccaacagcgccctggtgaccgtggagagagccgacagcagccacctgagcatcctgatcgaccccagatgccccgacctgaccgacagcttcgccagactggagagcgcccaggccagcgtgctgcaggccctgaccgagcaccaggcccagcccagactggtgggcgaccaggagcaggagctgctggacaccctggccgaccagctgcccagactgctggccagagccagcgagctgcagaccgagtgcatgggcctgagaaagggccacggcaccctgggccagggctag

SEQ ID NO: 81612 - DNA, 1170 bp, Artificial Sequence
  Description of Artificial Sequence: Synthetic coding sequence
atgagaagagtgaccctgttcctgaacggcagccccaagaacggcaaggtggtggccgtgtacggcaccctgagcgacctgctgagcgtggccagcagcaagctgggcatcaaggccaccagcgtgtacaacggcaagggcggcctgatcgacgacatcgccctgatcagagacgacgacgtgctgttcgtgtgcgagggcgagcccttcatcgacccccagaccgacagcaagccccccgagggcctgctgggcttccacaccgactggctgaccctgaacgtgggcggcagatacttcaccaccaccagaagcaccctggtgaacaaggagcccgacagcatgctggcccacatgttcaaggacaagggcgtgtggggcaacaagcaggaccacagaggcgccttcctgatcgacagaagccccgagtacttcgagcccatcctgaactacctgagacacggccagctgatcgtgaacgacggcatcaacctgctgggcgtgctggaggaggccagattcttcggcatcgacagcctgatcgagcacctggaggtggccatcaagaacagccagccccccgaggaccacagccccatcagcagaaaggagttcgtgagattcctgctggccacccccaccaagagcgagctgagatgccagggcctgaacttcagcggcgccgacctgagcagactggacctgagatacatcaacttcaagatggccaacctgagcagatgcaacctggcccacgccaacctgtgctgcgccaacctggagagagccgacctgagcggcagcgtgctggactgcgccaacctgcagggcgtgaagatgctgtgcagcaacgccgagggcgccagcctgaagctgtgcaacttcgaggaccccagcggcctgaaggccaacctggagggcgccaacctgaagggcgtggacatggagggcagccagatgaccggcatcaacctgagagtggccaccctgaagaacgccaagctgaagaactgcaacctgagaggcgccaccctggccggcaccgacctggagaactgcgacctgagcggctgcgacctgcaggaggccaacctgagaggcagcaacgtgaagggcgccatcttcgaggagatgctgacccccctgcacatgagccagagcgtgagatag

SEQ ID NO: 81613 - DNA, 939 bp, Artificial Sequence
  Description of Artificial Sequence: Synthetic coding sequence
atggccaaggtgttcagcttcatcctggtgaccaccgccctgaccatgggcagagagatcagcgccctggaggactgcgcccaggagcagatgagactgagagcccaggtgagactgctggagaccagagtgaagcagcagcaggtgaagatcaagcagctgctgcaggagaacgaggtgcagttcctggacaagggcgacgagaacaccgtgatcgacctgggcagcaagagacagtacgccgactgcagcgagatcttcaacgacggctacaagctgagcggcttctacaagatcaagcccctgcagagccccgccgagttcagcgtgtactgcgacatgagcgacggcggcggctggaccgtgatccagagaagaagcgacggcagcgagaacttcaacagaggctggaaggactacgagaacggcttcggcaacttcgtgcagaagcacggcgagtactggctgggcaacaagaacctgcacttcctgaccacccaggaggactacaccctgaagatcgacctggccgacttcgagaagaacagcagatacgcccagtacaagaacttcaaggtgggcgacgagaagaacttctacgagctgaacatcggcgagtacagcggcaccgccggcgacagcctggccggcaacttccaccccgaggtgcagtggtgggccagccaccagagaatgaagttcagcacctgggacagagaccacgacaactacgagggcaactgcgccgaggaggaccagagcggctggtggttcaacagatgccacagcgccaacctgaacggcgtgtactacagcggcccctacaccgccaagaccgacaacggcatcgtgtggtacacctggcacggctggtggtacagcctgaagagcgtggtgatgaagatcagacccaacgacttcatccccaacgtgatctag

SEQ ID NO: 81614 - DNA, 939 bp, Artificial Sequence; identical to SEQ ID NO: 81613
  Description of Artificial Sequence: Synthetic coding sequence

SEQ ID NO: 81615 - DNA, 939 bp, Artificial Sequence; identical to SEQ ID NO: 81613
  Description of Artificial Sequence: Synthetic coding sequence

SEQ ID NO: 81616 - DNA, 939 bp, Artificial Sequence; identical to SEQ ID NO: 81613
  Description of Artificial Sequence: Synthetic coding sequence

SEQ ID NO: 81617 - DNA, 939 bp, Artificial Sequence; identical to SEQ ID NO: 81613
  Description of Artificial Sequence: Synthetic coding sequence

SEQ ID NO: 81618 - DNA, 939 bp, Artificial Sequence; identical to SEQ ID NO: 81613
  Description of Artificial Sequence: Synthetic coding sequence

SEQ ID NO: 81619 - DNA, 849 bp, Artificial Sequence
  Description of Artificial Sequence: Synthetic coding sequence
atgagactgagagcccaggtgagactgctggagaccagagtgaagcagcagcaggtgaagatcaagcagctgctgcaggagaacgaggtgcagttcctggacaagggcgacgagaacaccgtgatcgacctgggcagcaagagacagtacgccgactgcagcgagatcttcaacgacggctacaagctgagcggcttctacaagatcaagcccctgcagagccccgccgagttcagcgtgtactgcgacatgagcgacggcggcggctggaccgtgatccagagaagaagcgacggcagcgagaacttcaacagaggctggaaggactacgagaacggcttcggcaacttcgtgcagaagcacggcgagtactggctgggcaacaagaacctgcacttcctgaccacccaggaggactacaccctgaagatcgacctggccgacttcgagaagaacagcagatacgcccagtacaagaacttcaaggtgggcgacgagaagaacttctacgagctgaacatcggcgagtacagcggcaccgccggcgacagcctggccggcaacttccaccccgaggtgcagtggtgggccagccaccagagaatgaagttcagcacctgggacagagaccacgacaactacgagggcaactgcgccgaggaggaccagagcggctggtggttcaacagatgccacagcgccaacctgaacggcgtgtactacagcggcccctacaccgccaagaccgacaacggcatcgtgtggtacacctggcacggctggtggtacagcctgaagagcgtggtgatgaagatcagacccaacgacttcatccccaacgtgatctag

SEQ ID NO: 81620 - DNA, 939 bp, Artificial Sequence; identical to SEQ ID NO: 81613
  Description of Artificial Sequence: Synthetic coding sequence

SEQ ID NO: 81621 - DNA, 1320 bp, Artificial Sequence
  Description of Artificial Sequence: Synthetic coding sequence
atgaagctggccaactggtactggctgagcagcgccgtgctggccacctacggcttcctggtggtggccaacaacgagaccgaggagatcaaggacgagagagccaaggacgtgtgccccgtgagactggagagcagaggcaagtgcgaggaggccggcgagtgcccctaccaggtgagcctgccccccctgaccatccagctgcccaagcagttcagcagaatcgaggaggtgttcaaggaggtgcagaacctgaaggagatcgtgaacagcctgaagaagagctgccaggactgcaagctgcaggccgacgacaacggcgaccccggcagaaacggcctgctgctgcccagcaccggcgcccccggcgaggtgggcgacaacagagtgagagagctggagagcgaggtgaacaagctgagcagcgagctgaagaacgccaaggaggagatcaacgtgctgcacggcagactggagaagctgaacctggtgaacatgaacaacatcgagaactacgtggacagcaaggtggccaacctgaccttcgtggtgaacagcctggacggcaagtgcagcaagtgccccagccaggagcagatccagagcagacccgtgcagcacctgatctacaaggactgcagcgactactacgccatcggcaagagaagcagcgagacctacagagtgacccccgaccccaagaacagcagcttcgaggtgtactgcgacatggagaccatgggcggcggctggaccgtgctgcaggccagactggacggcagcaccaacttcaccagaacctggcaggactacaaggccggcttcggcaacctgagaagagagttctggctgggcaacgacaagatccacctgctgaccaagagcaaggagatgatcctgagaatcgacctggaggacttcaacggcgtggagctgtacgccctgtacgaccagttctacgtggccaacgagttcctgaagtacagactgcacgtgggcaactacaacggcaccgccggcgacgccctgagattcaacaagcactacaaccacgacctgaagttcttcaccacccccgacaaggacaacgacagataccccagcggcaactgcggcctgtactacagcagcggctggtggttcgacgcctgcctgagcgccaacctgaacggcaagtactaccaccagaagtacagaggcgtgagaaacggcatcttctggggcacctggcccggcgtgagcgaggcccaccccggcggctacaagagcagcttcaaggaggccaagatgatgatcagacccaagcacttcaagccctag

SEQ ID NO: 81622 - DNA, 1095 bp, Artificial Sequence
  Description of Artificial Sequence: Synthetic coding sequence
atgaccagcgagctggacatcttcgtgggcaacaccaccctgatcgacgaggacgtgtacagactgtggctggacggctacagcgtgaccgacgccgtggccctgagagtgagaagcggcatcctggagcagaccggcgccaccgccgccgtgctgcagagcgacaccatggaccactacagaaccttccacatgctggagagactgctgcacgccccccccaagctgctgcaccagctgatcttccagatcccccccagcagacaggccctgctgatcgagagatactacgccttcgacgaggccttcgtgagagaggtgctgggcaagaagctgagcaagggcaccaagaaggacctggacgacatcagcaccaagaccggcatcaccctgaagagctgcagaagacagttcgacaacttcaagagagtgttcaaggtggtggaggagatgagaggcagcctggtggacaacatccagcagcacttcctgctgagcgacagactggccagagactacgccgccatcgtgttcttcgccaacaacagattcgagaccggcaagaagaagctgcagtacctgagcttcggcgacttcgccttctgcgccgagctgatgatccagaactggaccctgggcgccgtgggcgaggcccccaccgaccccgacagccagatggacgacatggacatggacctggacaaggagttcctgcaggacctgaaggagctgaaggtgctggtggccgacaaggacctgctggacctgcacaagagcctggtgtgcaccgccctgagaggcaagctgggcgtgttcagcgagatggaggccaacttcaagaacctgagcagaggcctggtgaacgtggccgccaagctgacccacaacaaggacgtgagagacctgttcgtggacctggtggagaagttcgtggagccctgcagaagcgaccactggcccctgagcgacgtgagattcttcctgaaccagtacagcgccagcgtgcacagcctggacggcttcagacaccaggccctgtgggacagatacatgggcaccctgagaggctgcctgctgagactgtaccacgactag

SEQ ID NO: 81623 - DNA, 1074 bp, Artificial Sequence
  Description of Artificial Sequence: Synthetic coding sequence
atgaccagcgagctggacatcttcgtgggcaacaccaccctgatcgacgaggacgtgtacagactgtggctggacggctacagcgtgaccgacgccgtggccctgagagtgagaagcggcatcctggagcagaccggcgccaccgccgccgtgctgcagagcgacaccatggaccactacagaaccttccacatgctggagagactgctgcacgccccccccaagctgctgcaccagctgatcttccagatcccccccagcagacaggccctgctgatcgagagatactacgccttcgacgaggccttcgtgagagaggtgctgggcaagaagctgagcaagggcaccaagaaggacctggacgacatcagcaccaagaccggcatcaccctgaagagctgcagaagacagttcgacaacttcaagagagtgttcaaggtggtggaggagatgagaggcagcctggtggacaacatccagcagcacttcctgctgagcgacagactggccagagactacgccgccatcgtgttcttcgccaacaacagattcgagaccggcaagaagaagctgcagtacctgagcttcggcgacttcgccttctgcgccgagctgatgatccagaactggaccctgggcgccgtggacagccagatggacgacatggacatggacctggacaaggagttcctgcaggacctgaaggagctgaaggtgctggtggccgacaaggacctgctggacctgcacaagagcctggtgtgcaccgccctgagaggcaagctgggcgtgttcagcgagatggaggccaacttcaagaacctgagcagaggcctggtgaacgtggccgccaagctgacccacaacaaggacgtgagagacctgttcgtggacctggtggagaagttcgtggagccctgcagaagcgaccactggcccctgagcgacgtgagattcttcctgaaccagtacagcgccagcgtgcacagcctggacggcttcagacaccaggccctgtgggacagatacatgggcaccctgagaggctgcctgctgagactgtaccacgactag

SEQ ID NO: 81624 - DNA, 1989 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgacgccctgcccagcagcgaggacgacgacgacgacgacgacagcagcagcgaggagaaggagaccgacaacaccaagcccaacagaatgcccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagaccgccggcgtgaacaccaccgacaaggagatggaggtgctgcacctgagaaacgtgagcttcgaggacgccggcgagtacacctgcctggccggcaacagcatcggcctgagccaccacagcgcctggctgaccgtgctggaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgaccgtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaaggtgtggaacctgaaggcccccctggtgcacacccccagacccggcagccaggagtgccccggcgacagaggccagtgcgacgaggacagcagactgtggcccagaaccggccacagcccccacagactgctgtag

SEQ ID NO: 81625 - DNA, 1104 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgtgcccatcgacgccctgcccagcagcgaggacgacgacgacgacgacgacagcagcagcgaggagaaggagaccgacaacaccaagcccaaccccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagcacagcggcatcaacagcagcgacgccgaggtgctgaccctgttcaacgtgaccgaggcccagagcggcgagtacgtgtgcaaggtgagcaactacatcggcgaggccaaccagagcgcctggctgaccgtgaccagacccgtggccaaggactgctggagctag

SEQ ID NO: 81626 - DNA, 2196 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggacgccctgcccagcagcgaggacgacgacgacgacgacgacagcagcagcgaggagaaggagaccgacaacaccaagcccaaccccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagaccgccggcgtgaacaccaccgacaaggagatggaggtgctgcacctgagaaacgtgagcttcgaggacgccggcgagtacacctgcctggccggcaacagcatcggcctgagccaccacagcgcctggctgaccgtgctggaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgaccgtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81627 - DNA, 2439 bp, Artificial Sequence
  Description of Artificial Sequence: Synthetic coding sequence
atggccgccgtgaccagagacttcggcgagatgctgctgcacagcggcagagtgctgcccgccgaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgacgccctgcccagcagcgaggacgacgacgacgacgacgacagcagcagcgaggagaaggagaccgacaacaccaagcccaacagaatgcccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagaccgccggcgtgaacaccaccgacaaggagatggaggtgctgcacctgagaaacgtgagcttcgaggacgccggcgagtacacctgcctggccggcaacagcatcggcctgagccaccacagcgcctggctgaccgtgctggaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81628 - DNA, 2469 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgtgcccatcgacgccctgcccagcagcgaggacgacgacgacgacgacgacagcagcagcgaggagaaggagaccgacaacaccaagcccaaccccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagcacagcggcatcaacagcagcgacgccgaggtgctgaccctgttcaacgtgaccgaggcccagagcggcgagtacgtgtgcaaggtgagcaactacatcggcgaggccaaccagagcgcctggctgaccgtgaccagacccgtgctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgaccgtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81629 - DNA, 2202 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggacgccctgcccagcagcgaggacgacgacgacgacgacgacagcagcagcgaggagaaggagaccgacaacaccaagcccaacagaatgcccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagaccgccggcgtgaacaccaccgacaaggagatggaggtgctgcacctgagaaacgtgagcttcgaggacgccggcgagtacacctgcctggccggcaacagcatcggcctgagccaccacagcgcctggctgaccgtgctggaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgaccgtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81630 - DNA, 2463 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgacgccctgcccagcagcgaggacgacgacgacgacgacgacagcagcagcgaggagaaggagaccgacaacaccaagcccaaccccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagaccgccggcgtgaacaccaccgacaaggagatggaggtgctgcacctgagaaacgtgagcttcgaggacgccggcgagtacacctgcctggccggcaacagcatcggcctgagccaccacagcgcctggctgaccgtgctggaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgaccgtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81631 - DNA, 2202 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggacgccctgcccagcagcgaggacgacgacgacgacgacgacagcagcagcgaggagaaggagaccgacaacaccaagcccaaccccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagcacagcggcatcaacagcagcgacgccgaggtgctgaccctgttcaacgtgaccgaggcccagagcggcgagtacgtgtgcaaggtgagcaactacatcggcgaggccaaccagagcgcctggctgaccgtgaccagacccgtggccaaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgaccgtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81632 - DNA, 2463 bp, Artificial Sequence; identical to SEQ ID NO: 81630
  Description of Artificial Sequence: Synthetic coding sequence

SEQ ID NO: 81633 - DNA, 2463 bp, Artificial Sequence; identical to SEQ ID NO: 81630
  Description of Artificial Sequence: Synthetic coding sequence

SEQ ID NO: 81634 - DNA, 324 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagctag

SEQ ID NO: 81635 - DNA, 2562 bp, Artificial Sequence
  Description of Artificial Sequence: Synthetic coding sequence
atggaggccagagtgagcctgaagagaagaatcgagctgaccgtggagtacccctggagatgcggcgccctgagccccaccagcaactgcagaaccggcatgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgacgccctgcccagcagcgaggacgacgacgacgacgacgacagcagcagcgaggagaaggagaccgacaacaccaagcccaaccccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagaccgccggcgtgaacaccaccgacaaggagatggaggtgctgcacctgagaaacgtgagcttcgaggacgccggcgagtacacctgcctggccggcaacagcatcggcctgagccaccacagcgcctggctgaccgtgctggaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgaccgtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81636 - DNA, 168 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggacgccctgcccagcagcgaggacgacgacgacgacgacgacagcagcagcgaggagaaggagaccgacaacacctag

SEQ ID NO: 81637 - DNA, 6 bp, Artificial Sequence
  Description of Artificial Sequence: Synthetic coding sequence
atgtag

SEQ ID NO: 81638 - DNA, 2469 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgacgccctgcccagcagcgaggacgacgacgacgacgacgacagcagcagcgaggagaaggagaccgacaacaccaagcccaacagaatgcccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagaccgccggcgtgaacaccaccgacaaggagatggaggtgctgcacctgagaaacgtgagcttcgaggacgccggcgagtacacctgcctggccggcaacagcatcggcctgagccaccacagcgcctggctgaccgtgctggaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgaccgtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81639 - DNA, 897 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgacgccctgcccagcagcgaggacgacgacgacgacgacgacagcagcagcgaggagaaggagaccgacaacaccaagcccaacagaatgcccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagctag

SEQ ID NO: 81640 - DNA, 438 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggacgccctgcccagcagcgaggacgacgacgacgacgacgacagcagcagcgaggagaaggagaccgacaacaccaagcccaaccccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtactag

SEQ ID NO: 81641 - DNA, 429 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggacgccctgcccagcagcgaggacgacgacgacgacgacgacagcagcagcgaggagaaggagaccgacaacaccaagcccaacagaatgcccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatctag

SEQ ID NO: 81642 - DNA, 258 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggacgccctgcccagcagcgaggacgacgacgacgacgacgacagcagcagcgaggagaaggagaccgacaacaccaagcccaaccccgtggccccctactggaccagccccgagaagatggagaagaagctgcacgccgtgcccgccgccaagaccgtgaagttctag

SEQ ID NO: 81643 - DNA, 2463 bp, Artificial Sequence
  Description of Artificial Sequence: Synthetic coding sequence
atgtggagctggaagtgcctgctgttctgggccgtgctggtgaccgccaccctgtgcaccgccagacccagccccaccctgcccgagcaggcccagccctggggcgcccccgtggaggtggagagcttcctggtgcaccccggcgacctgctgcagctgagatgcagactgagagacgacgtgcagagcatcaactggctgagagacggcgtgcagctggccgagagcaacagaaccagaatcaccggcgaggaggtggaggtgcaggacagcgtgcccgccgacagcggcctgtacgcctgcgtgaccagcagccccagcggcagcgacaccacctacttcagcgtgaacgtgagcgacgccctgcccagcagcgaggacgacgacgacgacgacgacagcagcagcgaggagaaggagaccgacaacaccaagcccaacagaatgcccgtggccccctactggaccagccccgagaagatggagaagaagctgcacgccgtgcccgccgccaagaccgtgaagttcaagtgccccagcagcggcacccccaaccccaccctgagatggctgaagaacggcaaggagttcaagcccgaccacagaatcggcggctacaaggtgagatacgccacctggagcatcatcatggacagcgtggtgcccagcgacaagggcaactacacctgcatcgtggagaacgagtacggcagcatcaaccacacctaccagctggacgtggtggagagaagcccccacagacccatcctgcaggccggcctgcccgccaacaagaccgtggccctgggcagcaacgtggagttcatgtgcaaggtgtacagcgacccccagccccacatccagtggctgaagcacatcgaggtgaacggcagcaagatcggccccgacaacctgccctacgtgcagatcctgaagaccgccggcgtgaacaccaccgacaaggagatggaggtgctgcacctgagaaacgtgagcttcgaggacgccggcgagtacacctgcctggccggcaacagcatcggcctgagccaccacagcgcctggctgaccgtgctggaggccctggaggagagacccgccgtgatgaccagccccctgtacctggagatcatcatctactgcaccggcgccttcctgatcagctgcatggtgggcagcgtgatcgtgtacaagatgaagagcggcaccaagaagagcgacttccacagccagatggccgtgcacaagctggccaagagcatccccctgagaagacaggtgagcgccgacagcagcgccagcatgaacagcggcgtgctgctggtgagacccagcagactgagcagcagcggcacccccatgctggccggcgtgagcgagtacgagctgcccgaggaccccagatgggagctgcccagagacagactggtgctgggcaagcccctgggcgagggctgcttcggccaggtggtgctggccgaggccatcggcctggacaaggacaagcccaacagagtgaccaaggtggccgtgaagatgctgaagagcgacgccaccgagaaggacctgagcgacctgatcagcgagatggagatgatgaagatgatcggcaagcacaagaacatcatcaacctgctgggcgcctgcacccaggacggccccctgtacgtgatcgtggagtacgccagcaagggcaacctgagagagtacctgcaggccagaagaccccccggcctggagtactgctacaaccccagccacaaccccgaggagcagctgagcagcaaggacctggtgagctgcgcctaccaggtggccagaggcatggagtacctggccagcaagaagtgcatccacagagacctggccgccagaaacgtgctggtgaccgaggacaacgtgatgaagatcgccgacttcggcctggccagagacatccaccacatcgactactacaagaagaccaccaacggcagactgcccgtgaagtggatggcccccgaggccctgttcgacagaatctacacccaccagagcgacgtgtggagcttcggcgtgctgctgtgggagatcttcaccctgggcggcagcccctaccccggcgtgcccgtggaggagctgttcaagctgctgaaggagggccacagaatggacaagcccagcaactgcaccaacgagctgtacatgatgatgagagactgctggcacgccgtgcccagccagagacccaccttcaagcagctggtggaggacctggacagaatcgtggccctgaccagcaaccaggagtacctggacctgagcatgcccctggaccagtacagccccagcttccccgacaccagaagcagcacctgcagcagcggcgaggacagcgtgttcagccacgagcccctgcccgaggagccctgcctgcccagacaccccgcccagctggccaacggcggcctgaagagaagatag

SEQ ID NO: 81644 - DNA, 2010 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaaggccgccggcgtgaacaccaccgacaaggagatcgaggtgctgtacatcagaaacgtgaccttcgaggacgccggcgagtacacctgcctggccggcaacagcatcggcatcagcttccacagcgcctggctgaccgtgctgcccgcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatctag

SEQ ID NO: 81645 - DNA, 2460 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaaggccgccggcgtgaacaccaccgacaaggagatcgaggtgctgtacatcagaaacgtgaccttcgaggacgccggcgagtacacctgcctggccggcaacagcatcggcatcagcttccacagcgcctggctgaccgtgctgcccgcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagcagtacagccccagctaccccgacaccagaagcagctgcagcagcggcgacgacagcgtgttcagccccgaccccatgccctacgagccctgcctgccccagtacccccacatcaacggcagcgtgaagacctag

SEQ ID NO: 81646 - DNA, 2358 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaaggccgccggcgtgaacaccaccgacaaggagatcgaggtgctgtacatcagaaacgtgaccttcgaggacgccggcgagtacacctgcctggccggcaacagcatcggcatcagcttccacagcgcctggctgaccgtgctgcccgcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagccctacagcccctgctaccccgaccccagatag

SEQ ID NO: 81647 - DNA, 2115 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgagggcgccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaaggccgccggcgtgaacaccaccgacaaggagatcgaggtgctgtacatcagaaacgtgaccttcgaggacgccggcgagtacacctgcctggccggcaacagcatcggcatcagcttccacagcgcctggctgaccgtgctgcccgcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagcagtacagccccagctaccccgacaccagaagcagctgcagcagcggcgacgacagcgtgttcagccccgaccccatgccctacgagccctgcctgccccagtacccccacatcaacggcagcgtgaagacctag

SEQ ID NO: 81648 - DNA, 2124 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaaggccgccggcgtgaacaccaccgacaaggagatcgaggtgctgtacatcagaaacgtgaccttcgaggacgccggcgagtacacctgcctggccggcaacagcatcggcatcagcttccacagcgcctggctgaccgtgctgcccgcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgaccgtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggaggagaagaaggtgagcggcgccgtggactgccacaagcccccctgcaaccccagccacctgccctgcgtgctggccgtggaccagtag

SEQ ID NO: 81649 - DNA, 2466 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaaggccgccggcgtgaacaccaccgacaaggagatcgaggtgctgtacatcagaaacgtgaccttcgaggacgccggcgagtacacctgcctggccggcaacagcatcggcatcagcttccacagcgcctggctgaccgtgctgcccgcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgaccgtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagcagtacagccccagctaccccgacaccagaagcagctgcagcagcggcgacgacagcgtgttcagccccgaccccatgccctacgagccctgcctgccccagtacccccacatcaacggcagcgtgaagacctag

SEQ ID NO: 81650 - DNA, 765 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtgggcagccagggcctgtag

SEQ ID NO: 81651 - DNA, 2043 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaagcacagcggcatcaacagcagcaacgccgaggtgctggccctgttcaacgtgaccgaggccgacgccggcgagtacatctgcaaggtgagcaactacatcggccaggccaaccagagcgcctggctgaccgtgctgcccaagcagcaggcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgaccgtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgagatctag

SEQ ID NO: 81652 - DNA, 2310 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaagcacagcggcatcaacagcagcaacgccgaggtgctggccctgttcaacgtgaccgaggccgacgccggcgagtacatctgcaaggtgagcaactacatcggccaggccaaccagagcgcctggctgaccgtgctgcccaagcagcaggcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgaccgtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgagatctag

SEQ ID NO: 81653 - DNA, 2307 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaagcacagcggcatcaacagcagcaacgccgaggtgctggccctgttcaacgtgaccgaggccgacgccggcgagtacatctgcaaggtgagcaactacatcggccaggccaaccagagcgcctggctgaccgtgctgcccaagcagcaggcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgaccgtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgagtag

SEQ ID NO: 81654 - DNA, 2124 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgagggcgccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaagcacagcggcatcaacagcagcaacgccgaggtgctggccctgttcaacgtgaccgaggccgacgccggcgagtacatctgcaaggtgagcaactacatcggccaggccaaccagagcgcctggctgaccgtgctgcccaagcagcaggcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgaccgtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagcagtacagccccagctaccccgacaccagaagcagctgcagcagcggcgacgacagcgtgttcagccccgaccccatgccctacgagccctgcctgccccagtacccccacatcaacggcagcgtgaagacctag

SEQ ID NO: 81655 - DNA, 2118 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaaggtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagcagtacagccccagctaccccgacaccagaagcagctgcagcagcggcgacgacagcgtgttcagccccgaccccatgccctacgagccctgcctgccccagtacccccacatcaacggcagcgtgaagacctag

SEQ ID NO: 81656 - DNA, 2130 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgaccgtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagcagtacagccccagctaccccgacaccagaagcagctgcagcagcggcgacgacagcgtgttcagccccgaccccatgccctacgagccctgcctgccccagtacccccacatcaacggcagcgtgaagacctag

SEQ ID NO: 81657 - DNA, 2469 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaaggtgaccaaggccgccggcgtgaacaccaccgacaaggagatcgaggtgctgtacatcagaaacgtgaccttcgaggacgccggcgagtacacctgcctggccggcaacagcatcggcatcagcttccacagcgcctggctgaccgtgctgcccgcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagcagtacagccccagctaccccgacaccagaagcagctgcagcagcggcgacgacagcgtgttcagccccgaccccatgccctacgagccctgcctgccccagtacccccacatcaacggcagcgtgaagacctag

SEQ ID NO: 81658 - DNA, 2469 bp, Artificial Sequence
  Description of Artificial Sequence: Synthetic coding sequence
atggtgagctggggcagattcatctgcctggtggtggtgaccatggccaccctgagcctggccagacccagcttcagcctggtggaggacaccaccctggagcccgaggagccccccaccaagtaccagatcagccagcccgaggtgtacgtggccgcccccggcgagagcctggaggtgagatgcctgctgaaggacgccgccgtgatcagctggaccaaggacggcgtgcacctgggccccaacaacagaaccgtgctgatcggcgagtacctgcagatcaagggcgccacccccagagacagcggcctgtacgcctgcaccgccagcagaaccgtggacagcgagacctggtacttcatggtgaacgtgaccgacgccatcagcagcggcgacgacgaggacgacaccgacggcgccgaggacttcgtgagcgagaacagcaacaacaagagagccccctactggaccaacaccgagaagatggagaagagactgcacgccgtgcccgccgccaacaccgtgaagttcagatgccccgccggcggcaaccccatgcccaccatgagatggctgaagaacggcaaggagttcaagcaggagcacagaatcggcggctacaaggtgagaaaccagcactggagcctgatcatggagagcgtggtgcccagcgacaagggcaactacacctgcgtggtggagaacgagtacggcagcatcaaccacacctaccacctggacgtggtggagagaagcccccacagacccatcctgcaggccggcctgcccgccaacgccagcaccgtggtgggcggcgacgtggagttcgtgtgcaaggtgtacagcgacgcccagccccacatccagtggatcaagcacgtggagaagaacggcagcaagtacggccccgacggcctgccctacctgaaggtgctgaagcacagcggcatcaacagcagcaacgccgaggtgctggccctgttcaacgtgaccgaggccgacgccggcgagtacatctgcaaggtgagcaactacatcggccaggccaaccagagcgcctggctgaccgtgctgcccaagcagcaggcccccggcagagagaaggagatcaccgccagccccgactacctggagatcgccatctactgcatcggcgtgttcctgatcgcctgcatggtggtgaccgtgatcctgtgcagaatgaagaacaccaccaagaagcccgacttcagcagccagcccgccgtgcacaagctgaccaagagaatccccctgagaagacaggtgaccgtgagcgccgagagcagcagcagcatgaacagcaacacccccctggtgagaatcaccaccagactgagcagcaccgccgacacccccatgctggccggcgtgagcgagtacgagctgcccgaggaccccaagtgggagttccccagagacaagctgaccctgggcaagcccctgggcgagggctgcttcggccaggtggtgatggccgaggccgtgggcatcgacaaggacaagcccaaggaggccgtgaccgtggccgtgaagatgctgaaggacgacgccaccgagaaggacctgagcgacctggtgagcgagatggagatgatgaagatgatcggcaagcacaagaacatcatcaacctgctgggcgcctgcacccaggacggccccctgtacgtgatcgtggagtacgccagcaagggcaacctgagagagtacctgagagccagaagaccccccggcatggagtacagctacgacatcaacagagtgcccgaggagcagatgaccttcaaggacctggtgagctgcacctaccagctggccagaggcatggagtacctggccagccagaagtgcatccacagagacctggccgccagaaacgtgctggtgaccgagaacaacgtgatgaagatcgccgacttcggcctggccagagacatcaacaacatcgactactacaagaagaccaccaacggcagactgcccgtgaagtggatggcccccgaggccctgttcgacagagtgtacacccaccagagcgacgtgtggagcttcggcgtgctgatgtgggagatcttcaccctgggcggcagcccctaccccggcatccccgtggaggagctgttcaagctgctgaaggagggccacagaatggacaagcccgccaactgcaccaacgagctgtacatgatgatgagagactgctggcacgccgtgcccagccagagacccaccttcaagcagctggtggaggacctggacagaatcctgaccctgaccaccaacgaggagtacctggacctgagccagcccctggagcagtacagccccagctaccccgacaccagaagcagctgcagcagcggcgacgacagcgtgttcagccccgaccccatgccctacgagccctgcctgccccagtacccccacatcaacggcagcgtgaagacctag

SEQ ID NO: 81659 - DNA, 1515 bp, Artificial Sequence
  Description of Artificial Sequence: Synthetic coding sequence
atgacccccagccccctgctgctgctgctgctgccccccctgctgctgggcgccttcccccccgccgccgccgccagaggcccccccaagatggccgacaaggtggtgcccagacaggtggccagactgggcagaaccgtgagactgcagtgccccgtggagggcgaccccccccccctgaccatgtggaccaaggacggcagaaccatccacagcggctggagcagattcagagtgctgccccagggcctgaaggtgaagcaggtggagagagaggacgccggcgtgtacgtgtgcaaggccaccaacggcttcggcagcctgagcgtgaactacaccctggtggtgctggacgacatcagccccggcaaggagagcctgggccccgacagcagcagcggcggccaggaggaccccgccagccagcagtgggccagacccagattcacccagcccagcaagatgagaagaagagtgatcgccagacccgtgggcagcagcgtgagactgaagtgcgtggccagcggccaccccagacccgacatcacctggatgaaggacgaccaggccctgaccagacccgaggccgccgagcccagaaagaagaagtggaccctgagcctgaagaacctgagacccgaggacagcggcaagtacacctgcagagtgagcaacagagccggcgccatcaacgccacctacaaggtggacgtgatccagagaaccagaagcaagcccgtgctgaccggcacccaccccgtgaacaccaccgtggacttcggcggcaccaccagcttccagtgcaaggtgagaagcgacgtgaagcccgtgatccagtggctgaagagagtggagtacggcgccgagggcagacacaacagcaccatcgacgtgggcggccagaagttcgtggtgctgcccaccggcgacgtgtggagcagacccgacggcagctacctgaacaagctgctgatcaccagagccagacaggacgacgccggcatgtacatctgcctgggcgccaacaccatgggctacagcttcagaagcgccttcctgaccgtgctgcccgaccccaagccccccggcccccccgtggccagcagcagcagcgccaccagcctgccctggcccgtggtgatcggcatccccgccggcgccgtgttcatcctgggcaccctgctgctgtggctgtgccaggcccagaagaagccctgcacccccgcccccgccccccccctgcccggccacagaccccccggcaccgccagagacagaagcggcgacaaggacctgcccagcctggccgccctgagcgccggccccggcgtgggcctgtgcgaggagcacggcagccccgccgccccccagcacctgctgggccccggccccgtggccggccccaagctgtaccccaagctgtacaccgacatccacacccacacccacacccacagccacacccacagccacgtggagggcaaggtgcaccagcacatccactaccagtgctag

SEQ ID NO: 81660 - DNA, 1515 bp, Artificial Sequence; identical to SEQ ID NO: 81659
  Description of Artificial Sequence: Synthetic coding sequence

SEQ ID NO: 81661 - DNA, 1515 bp, Artificial Sequence; identical to SEQ ID NO: 81659
  Description of Artificial Sequence: Synthetic coding sequence

SEQ ID NO: 81662 - DNA, 459 bp, Artificial Sequence
  Description of Artificial Sequence: Synthetic coding sequence
atgacccccagccccctgctgctgctgctgctgccccccctgctgctgggcgccttcccccccgccgccgccgccagaggcccccccaagatggccgacaaggtggtgcccagacaggtggccagactgggcagaaccgtgagactgcagtgccccgtggagggcgaccccccccccctgaccatgtggaccaaggacggcagaaccatccacagcggctggagcagattcagagtgctgccccagggcctgaaggtgaagcaggtggagagagaggacgccggcgtgtacgtgtgcaaggccaccaacggcttcggcagcctgagcgtgaactacaccctggtggtgctggacgacatcagccccggcaaggagagcctgggccccgacagcagcagcggcggccaggaggaccccgccagccagcagtgggccagacccagattcacccagccctag

SEQ ID NO: 81663 - DNA, 1515 bp, Artificial Sequence; identical to SEQ ID NO: 81659
  Description of Artificial Sequence: Synthetic coding sequence

SEQ ID NO: 81664 - DNA, 243 bp, Artificial Sequence
  Description of Artificial Sequence: Synthetic coding sequence
atgacccccagccccctgctgctgctgctgctgccccccctgctgctgggcgccttcccccccgccgccgccgccagaggcccccccaagatggccgacaaggtggtgcccagacaggtggccagactgggcagaaccgtgagactgcagtgccccgtggagggcgaccccccccccctgaccatgtggaccaaggacggcagaaccatccacagcggctggagcagattcagagtgctgtag

SEQ ID NO: 81665 - DNA, 1326 bp, Artificial Sequence
  Description of Artificial Sequence: Synthetic coding sequence
atggccgacaaggtggtgcccagacaggtggccagactgggcagaaccgtgagactgcagtgccccgtggagggcgaccccccccccctgaccatgtggaccaaggacggcagaaccatccacagcggctggagcagattcagagtgctgccccagggcctgaaggtgaagcaggtggagagagaggacgccggcgtgtacgtgtgcaaggccaccaacggcttcggcagcctgagcgtgaactacaccctggtggtgctggacgacatcagccccggcaaggagagcctgggccccgacagcagcagcggcggccaggaggaccccgccagccagcagtgggccagacccagattcacccagcccagcaagatgagaagaagagtgatcgccagacccgtgggcagcagcgtgagactgaagtgcgtggccagcggccaccccagacccgacatcacctggatgaaggacgaccaggccctgaccagacccgaggccgccgagcccagaaagaagaagtggaccctgagcctgaagaacctgagacccgaggacagcggcaagtacacctgcagagtgagcaacagagccggcgccatcaacgccacctacaaggtggacgtgatccagagaaccagaagcaagcccgtgctgaccggcacccaccccgtgaacaccaccgtggacttcggcggcaccaccagcttccagtgcaaggtgagaagcgacgtgaagcccgtgatccagtggctgaagagagtggagtacggcgccgagggcagacacaacagcaccatcgacgtgggcggccagaagttcgtggtgctgcccaccggcgacgtgtggagcagacccgacggcagctacctgaacaagctgctgatcaccagagccagacaggacgacgccggcatgtacatctgcctgggcgccaacaccatgggctacagcttcagaagcgccttcctgaccgtgctgcccgaccccaagccccccggcccccccgtggccagcagcagcagcgccaccagcctgccctggcccgtggtgatcggcatccccgccggcgccgtgttcatcctgggcaccctgctgctgtggctgtgccaggcccagaagaagccctgcacccccgcccccgccccccccctgcccggccacagaccccccggcaccgccagagacagaagcggcgacaaggacctgcccagcctggccgccctgagcgccggccccggcgtgggcctgtgcgaggagcacggcagccccgccgccccccagcaccccaccgtggtggtggcccccgacctgtgcaacttcatgtag

SEQ ID NO: 81666 - DNA, 1131 bp, Artificial Sequence
  Description of Artificial Sequence: Synthetic coding sequence
atgcagtggaccagcctgctgctgctggccggcctgttcagcctgagccaggcccagtacgaggacgacccccactggtggttccactacctgagaagccagcagagcacctactacgacccctacgacccctacccctacgagacctacgagccctacccctacggcgtggacgagggccccgcctacacctacggcagccccagcccccccgaccccagagactgcccccaggagtgcgactgcccccccaacttccccaccgccatgtactgcgacaacagaaacctgaagtacctgcccttcgtgcccagcagaatgaagtacgtgtacttccagaacaaccagatcaccagcatccaggagggcgtgttcgacaacgccaccggcctgctgtggatcgccctgcacggcaaccagatcaccagcgacaaggtgggcagaaaggtgttcagcaagctgagacacctggagagactgtacctggaccacaacaacctgaccagaatgcccggccccctgcccagaagcctgagagagctgcacctggaccacaaccagatcagcagagtgcccaacaacgccctggagggcctggagaacctgaccgccctgtacctgcagcacaacgagatccaggaggtgggcagcagcatgagaggcctgagaagcctgatcctgctggacctgagctacaaccacctgagaaaggtgcccgacggcctgcccagcgccctggagcagctgtacatggagcacaacaacgtgtacaccgtgcccgacagctacttcagaggcgcccccaagctgctgtacgtgagactgagccacaacagcctgaccaacaacggcctggccagcaacaccttcaacagcagcagcctgctggagctggacctgagctacaaccagctgcagaagatcccccccgtgaacaccaacctggagaacctgtacctgcagggcaacagaatcaacgagttcagcatcagcagcttctgcaccgtggtggacgtggtgaacttcagcaagctgcaggtgctgagactggacggcaacgagatcaagagaagcgccatgcccgccgacgcccccctgtgcctgagactggccagcctgatcgagatctag

SEQ ID NO: 81667 - DNA, 1092 bp, Artificial Sequence
  Description of Artificial Sequence: Synthetic coding sequence
atgcagtggaccagcctgctgctgctggccggcctgttcagcctgagccaggcccagtacgaggacgacccccactggtggttccactacctgagaagccagcagagcacctactacgacccctacgacccctacccctacgagacctacgagccctacccctacggcgtggacgagggccccgcctacacctacggcagccccagcccccccgaccccagagactgcccccaggagtgcgactgcccccccaacttcccccccttcgtgcccagcagaatgaagtacgtgtacttccagaacaaccagatcaccagcatccaggagggcgtgttcgacaacgccaccggcctgctgtggatcgccctgcacggcaaccagatcaccagcgacaaggtgggcagaaaggtgttcagcaagctgagacacctggagagactgtacctggaccacaacaacctgaccagaatgcccggccccctgcccagaagcctgagagagctgcacctggaccacaaccagatcagcagagtgcccaacaacgccctggagggcctggagaacctgaccgccctgtacctgcagcacaacgagatccaggaggtgggcagcagcatgagaggcctgagaagcctgatcctgctggacctgagctacaaccacctgagaaaggtgcccgacggcctgcccagcgccctggagcagctgtacatggagcacaacaacgtgtacaccgtgcccgacagctacttcagaggcgcccccaagctgctgtacgtgagactgagccacaacagcctgaccaacaacggcctggccagcaacaccttcaacagcagcagcctgctggagctggacctgagctacaaccagctgcagaagatcccccccgtgaacaccaacctggagaacctgtacctgcagggcaacagaatcaacgagttcagcatcagcagcttctgcaccgtggtggacgtggtgaacttcagcaagctgcaggtgctgagactggacggcaacgagatcaagagaagcgccatgcccgccgacgcccccctgtgcctgagactggccagcctgatcgagatctag

SEQ ID NO: 81668 - DNA, 594 bp, Artificial Sequence
  Description of Artificial Sequence: Synthetic coding sequence
atgaagatgaccctgatcggcggcagcaccaccagcgccgccagcagcccccccaccaccatccccatgaccctgaccagaatgagacccaccagcctgacccccatgggctggatgaagggccagcccacccccaccgccctgcaccccctgcagatccccgccaccgcccccagaagcgccaccgcccaccccaccagcaccgccatgtactgcgacaacagaaacctgaagtacctgcccttcgtgcccagcagaatgaagtacgtgtacttccagaacaaccagatcaccagcatccaggagggcgtgttcgacaacgccaccggcctgctgtggatcgccctgcacggcaaccagatcaccagcgacaaggtgggcagaaaggtgttcagcaagctgagacacctggagagactgtacctggaccacaacaacctgaccagaatgcccggccccctgcccagaagcctgagagagctgcacctggaccacaaccagatcagcagagtgcccaacaacgccctggagggcagaaccagcagaccctgcaccagcaacaccatgagaagcagaaagtgggccgtgccctag

SEQ ID NO: 81669 - DNA, 2025 bp, Artificial Sequence
  Description of Artificial Sequence: Synthetic coding sequence
atggtggtggcccaccccaccgccaccgccaccaccacccccaccgccaccgtgaccgccaccgtggtgatgaccaccgccaccatggacctgagagactggctgttcctgtgctacggcctgatcgccttcctgaccgaggtgatcgacagcaccacctgccccagcgtgtgcagatgcgacaacggcttcatctactgcaacgacagaggcctgaccagcatccccgccgacatccccgacgacgccaccaccctgtacctgcagaacaaccagatcaacaacgccggcatcccccaggacctgaagaccaaggtgaacgtgcaggtgatctacctgtacgagaacgacctggacgagttccccatcaacctgcccagaagcctgagagagctgcacctgcaggacaacaacgtgagaaccatcgccagagacagcctggccagaatccccctgctggagaagctgcacctggacgacaacagcgtgagcaccgtgagcatcgaggaggacgccttcgccgacagcaagcagctgaagctgctgttcctgagcagaaaccacctgagcagcatccccagcggcctgccccacaccctggaggagctgagactggacgacaacagaatcagcaccatccccctgcacgccttcaagggcctgaacagcctgagaagactggtgctggacggcaacctgctggccaaccagagaatcgccgacgacaccttcagcagactgcagaacctgaccgagctgagcctggtgagaaacagcctggccgccccccccctgaacctgcccagcgcccacctgcagaagctgtacctgcaggacaacgccatcagccacatcccctacaacaccctggccaagatgagagagctggagagactggacctgagcaacaacaacctgaccaccctgcccagaggcctgttcgacgacctgggcaacctggcccagctgctgctgagaaacaacccctggttctgcggctgcaacctgatgtggctgagagactgggtgaaggccagagccgccgtggtgaacgtgagaggcctgatgtgccagggccccgagaaggtgagaggcatggccatcaaggacatcaccagcgagatggacgagtgcttcgagaccggcccccagggcggcgtggccaacgccgccgccaagaccaccgccagcaaccacgccagcgccaccaccccccagggcagcctgttcaccctgaaggccaagagacccggcctgagactgcccgacagcaacatcgactaccccatggccaccggcgacggcgccaagaccctggccatccacgtgaaggccctgaccgccgacagcatcagaatcacctggaaggccaccctgcccgccagcagcttcagactgagctggctgagactgggccacagccccgccgtgggcagcatcaccgagaccctggtgcagggcgacaagaccgagtacctgctgaccgccctggagcccaagagcacctacatcatctgcatggtgaccatggagaccagcaacgcctacgtggccgacgagacccccgtgtgcgccaaggccgagaccgccgacagctacggccccaccaccaccctgaaccaggagcagaacgccggccccatggccagcctgcccctggccggcatcatcggcggcgccgtggccctggtgttcctgttcctggtgctgggcgccatctgctggtacgtgcaccaggccggcgagctgctgaccagagagagagcctacaacagaggcagcagaaagaaggacgactacatggagagcggcaccaagaaggacaacagcatcctggagatcagaggccccggcctgcagatgctgcccatcaacccctacagagccaaggaggagtacgtggtgcacaccatcttccccagcaacggcagcagcctgtgcaaggccacccacaccatcggctacggcaccaccagaggctacagagacggcggcatccccgacatcgactacagctacacctag

SEQ ID NO: 81670 - DNA, 1983 bp, Artificial Sequence
  Description of Artificial Sequence: Synthetic coding sequence
atgggcctgcagaccaccaagtggcccagccacggcgccttcttcctgaagagctggctgatcatcagcctgggcctgtacagccaggtgagcaagctgctggcctgccccagcgtgtgcagatgcgacagaaacttcgtgtactgcaacgagagaagcctgaccagcgtgcccctgggcatccccgagggcgtgaccgtgctgtacctgcacaacaaccagatcaacaacgccggcttccccgccgagctgcacaacgtgcagagcgtgcacaccgtgtacctgtacggcaaccagctggacgagttccccatgaacctgcccaagaacgtgagagtgctgcacctgcaggagaacaacatccagaccatcagcagagccgccctggcccagctgctgaagctggaggagctgcacctggacgacaacagcatcagcaccgtgggcgtggaggacggcgccttcagagaggccatcagcctgaagctgctgttcctgagcaagaaccacctgagcagcgtgcccgtgggcctgcccgtggacctgcaggagctgagagtggacgagaacagaatcgccgtgatcagcgacatggccttccagaacctgaccagcctggagagactgatcgtggacggcaacctgctgaccaacaagggcatcgccgagggcaccttcagccacctgaccaagctgaaggagttcagcatcgtgagaaacagcctgagccaccccccccccgacctgcccggcacccacctgatcagactgtacctgcaggacaaccagatcaaccacatccccctgaccgccttcagcaacctgagaaagctggagagactggacatcagcaacaaccagctgagaatgctgacccagggcgtgttcgacaacctgagcaacctgaagcagctgaccgccagaaacaacccctggttctgcgactgcagcatcaagtgggtgaccgagtggctgaagtacatccccagcagcctgaacgtgagaggcttcatgtgccagggccccgagcaggtgagaggcatggccgtgagagagctgaacatgaacctgctgagctgccccaccaccacccccggcctgcccctgttcacccccgcccccagcaccgccagccccaccacccagccccccaccctgagcatccccaaccccagcagaagctacaccccccccacccccaccaccagcaagctgcccaccatccccgactgggacggcagagagagagtgaccccccccatcagcgagagaatccagctgagcatccacttcgtgaacgacaccagcatccaggtgagctggctgagcctgttcaccgtgatggcctacaagctgacctgggtgaagatgggccacagcctggtgggcggcatcgtgcaggagagaatcgtgagcggcgagaagcagcacctgagcctggtgaacctggagcccagaagcacctacagaatctgcctggtgcccctggacgccttcaactacagagccgtggaggacaccatctgcagcgaggccaccacccacgccagctacctgaacaacggcagcaacaccgccagcagccacgagcagaccaccagccacagcatgggcagccccttcctgctggccggcctgatcggcggcgccgtgatcttcgtgctggtggtgctgctgagcgtgttctgctggcacatgcacaagaagggcagatacaccagccagaagtggaagtacaacagaggcagaagaaaggacgactactgcgaggccggcaccaagaaggacaacagcatcctggagatgaccgagaccagcttccagatcgtgagcctgaacaacgaccagctgctgaagggcgacttcagactgcagcccatctacacccccaacggcggcatcaactacaccgactgccacatccccaacaacatgagatactgcaacagcagcgtgcccgacctggagcactgccacacctag

SEQ ID NO: 81671 - DNA, 942 bp, Artificial Sequence
  Description of Artificial Sequence: Synthetic coding sequence
atggccgtgagagagctgaacatgaacctgctgagctgccccaccaccacccccggcctgcccctgttcacccccgcccccagcaccgccagccccaccacccagccccccaccctgagcatccccaaccccagcagaagctacaccccccccacccccaccaccagcaagctgcccaccatccccgactgggacggcagagagagagtgaccccccccatcagcgagagaatccagctgagcatccacttcgtgaacgacaccagcatccaggtgagctggctgagcctgttcaccgtgatggcctacaagctgacctgggtgaagatgggccacagcctggtgggcggcatcgtgcaggagagaatcgtgagcggcgagaagcagcacctgagcctggtgaacctggagcccagaagcacctacagaatctgcctggtgcccctggacgccttcaactacagagccgtggaggacaccatctgcagcgaggccaccacccacgccagctacctgaacaacggcagcaacaccgccagcagccacgagcagaccaccagccacagcatgggcagccccttcctgctggccggcctgatcggcggcgccgtgatcttcgtgctggtggtgctgctgagcgtgttctgctggcacatgcacaagaagggcagatacaccagccagaagtggaagtacaacagaggcagaagaaaggacgactactgcgaggccggcaccaagaaggacaacagcatcctggagatgaccgagaccagcttccagatcgtgagcctgaacaacgaccagctgctgaagggcgacttcagactgcagcccatctacacccccaacggcggcatcaactacaccgactgccacatccccaacaacatgagatactgcaacagcagcgtgcccgacctggagcactgccacacctag

SEQ ID NO: 81672 - DNA, 1983 bp, Artificial Sequence; identical to SEQ ID NO: 81670
  Description of Artificial Sequence: Synthetic coding sequence

SEQ ID NO: 81673 - DNA, 1950 bp, Artificial Sequence
  Description of Artificial Sequence: Synthetic coding sequence
atgatcagcgccgcctggagcatcttcctgatcggcaccaagatcggcctgttcctgcaggtggcccccctgagcgtgatggccaagagctgccccagcgtgtgcagatgcgacgccggcttcatctactgcaacgacagattcctgaccagcatccccaccggcatccccgaggacgccaccaccctgtacctgcagaacaaccagatcaacaacgccggcatccccagcgacctgaagaacctgctgaaggtggagagaatctacctgtaccacaacagcctggacgagttccccaccaacctgcccaagtacgtgaaggagctgcacctgcaggagaacaacatcagaaccatcacctacgacagcctgagcaagatcccctacctggaggagctgcacctggacgacaacagcgtgagcgccgtgagcatcgaggagggcgccttcagagacagcaactacctgagactgctgttcctgagcagaaaccacctgagcaccatcccctggggcctgcccagaaccatcgaggagctgagactggacgacaacagaatcagcaccatcagcagccccagcctgcagggcctgaccagcctgaagagactggtgctggacggcaacctgctgaacaaccacggcctgggcgacaaggtgttcttcaacctggtgaacctgaccgagctgagcctggtgagaaacagcctgaccgccgcccccgtgaacctgcccggcaccaacctgagaaagctgtacctgcaggacaaccacatcaacagagtgccccccaacgccttcagctacctgagacagctgtacagactggacatgagcaacaacaacctgagcaacctgccccagggcatcttcgacgacctggacaacatcacccagctgatcctgagaaacaacccctggtactgcggctgcaagatgaagtgggtgagagactggctgcagagcctgcccgtgaaggtgaacgtgagaggcctgatgtgccaggcccccgagaaggtgagaggcatggccatcaaggacctgaacgccgagctgttcgactgcaaggacagcggcatcgtgagcaccatccagatcaccaccgccatccccaacaccgtgtaccccgcccagggccagtggcccgcccccgtgaccaagcagcccgacatcaagaaccccaagctgaccaaggaccaccagaccaccggcagccccagcagaaagaccatcaccatcaccgtgaagagcgtgaccagcgacaccatccacatcagctggaagctggccctgcccatgaccgccctgagactgagctggctgaagctgggccacagccccgccttcggcagcatcaccgagaccatcgtgaccggcgagagaagcgagtacctggtgaccgccctggagcccgacagcccctacaaggtgtgcatggtgcccatggagaccagcaacctgtacctgttcgacgagacccccgtgtgcatcgagaccgagaccgcccccctgagaatgtacaaccccaccaccaccctgaacagagagcaggagaaggagccctacaagaaccccaacctgcccctggccgccatcatcggcggcgccgtggccctggtgaccatcgccctgctggccctggtgtgctggtacgtgcacagaaacggcagcctgttcagcagaaactgcgcctacagcaagggcagaagaagaaaggacgactacgccgaggccggcaccaagaaggacaacagcatcctggagatcagagagaccagcttccagatgctgcccatcagcaacgagcccatcagcaaggaggagttcgtgatccacaccatcttcccccccaacggcatgaacctgtacaagaacaaccacagcgagagcagcagcaacagaagctacagagacagcggcatccccgacagcgaccacagccacagctag

SEQ ID NO: 81674 - DNA, 1950 bp, Artificial Sequence; identical to SEQ ID NO: 81673
  Description of Artificial Sequence: Synthetic coding sequence

SEQ ID NO: 81675 - DNA, 1884 bp, Artificial Sequence
  Description of Artificial Sequence: Synthetic coding sequence
atgatcagcgccgcctggagcatcttcctgatcggcaccaagatcggcctgttcctgcaggtggcccccctgagcgtgatggccaagagctgccccagcgtgtgcagatgcgacgccggcttcatctactgcaacgacagattcctgaccagcatccccaccggcatccccgaggacgccaccaccctgtacctgcagaacaaccagatcaacaacgccggcatccccagcgacctgaagaacctgctgaaggtggagagaatctacctgtaccacaacagcctggacgagttccccaccaacctgcccaagtacgtgaaggagctgcacctgcaggagaacaacatcagaaccatcacctacgacagcctgagcaagatcccctacctggaggagctgcacctggacgacaacagcgtgagcgccgtgagcatcgaggagggcgccttcagagacagcaactacctgagactgctgttcctgagcagaaaccacctgagcaccatcccctggggcctgcccagaaccatcgaggagctgagactggacgacaacagaatcagcaccatcagcagccccagcctgcagggcctgaccagcctgaagagactggtgctggacggcaacctgctgaacaaccacggcctgggcgacaaggtgttcttcaacctggtgaacctgaccgagctgagcctggtgagaaacagcctgaccgccgcccccgtgaacctgcccggcaccaacctgagaaagctgtacctgcaggacaaccacatcaacagagtgccccccaacgccttcagctacctgagacagctgtacagactggacatgagcaacaacaacctgagcaacctgccccagggcatcttcgacgacctggacaacatcacccagctgatcctgagaaacaacccctggtactgcggctgcaagatgaagtgggtgagagactggctgcagagcctgcccgtgaaggtgaacgtgagaggcctgatgtgccaggcccccgagaaggtgagaggcatggccatcaaggacctgaacgccgagctgttcgactgcaaggacagcggcatcgtgagcaccatccagatcaccaccgccatccccaacaccgtgtaccccgcccagggccagtggcccgcccccgtgaccaagcagcccgacatcaagaaccccaagctgaccaaggaccaccagaccaccggcagccccagcagaaagaccatcaccatcaccgtgaagagcgtgaccagcgacaccatccacatcagctggaagctggccctgcccatgaccgccctgagactgagctggctgaagctgggccacagccccgccttcggcagcatcaccgagaccatcgtgaccggcgagagaagcgagtacctggtgaccgccctggagcccgacagcccctacaaggtgtgcatggtgcccatggagaccagcaacctgtacctgttcgacgagacccccgtgtgcatcgagaccgagaccgcccccctgagaatgtacaaccccaccaccaccctgaacagagagcaggagaaggagccctacaagaaccccaacctgcccctggccgccatcatcggcggcgccgtggccctggtgaccatcgccctgctggccctggtgtgctggtacgtgcacagaaacggcagcctgttcagcagaaactgcgcctacagcaagggcagaagaagaaaggacgactacgccgaggccggcaccaagaaggacaacagcatcctggagatcagagagaccagcttccagatgctgcccatcagcaacgagcccatcagcaaggaggagttcgtgatccacaccatcttcccccccaacggcatgaacctgtacaagcagagccagtag

SEQ ID NO: 81676 - DNA, 402 bp, Artificial Sequence
  Description of Artificial Sequence: Synthetic coding sequence
atgccccccagcaagccccacccccccgtggtgggcaaggtgacccaccacagcatcgagctgtactgggacctggagaagaaggccaagagacagggcccccaggagcagtggttcagattcagcatcgaggaggaggaccccaagatgcacacctacggcatcatctacaccggctacgccaccaagcacgtggtggagggcctggagcccagaaccctgtacagattcagactgaaggtgaccagccccagcggcgagtgcgagtacagccccctggtgagcgtgagcaccaccagcagcatctggctgggcggcgagcccatcagcagcgagcacctgcacagagccgtgagcgtgaacgacgaggacctgctggtgagaatcctgcagggcggctag

SEQ ID NO: 81677 - DNA, 849 bp, Artificial Sequence
  Description of Artificial Sequence: Synthetic coding sequence
atgccccccagcaagccccacccccccgtggtgggcaaggtgacccaccacagcatcgagctgtactgggacctggagaagaaggccaagagacagggcccccaggagcagtggttcagattcagcatcgaggaggaggaccccaagatgcacacctacggcatcatctacaccggctacgccaccaagcacgtggtggagggcctggagcccagaaccctgtacagattcagactgaaggtgaccagccccagcggcgagtgcgagtacagccccctggtgagcgtgagcaccaccagcagcatctggctgggcggcgagcccatcagcagcgagcacctgcacagagccgtgagcgtgaacgacgaggacctgctggtgagaatcctgcagggcggcagagtgaaggtggacgtgcccaacaagttcggcttcaccgccctgatggtggccgcccagaagggctacaccagcctgatgctggcctgctacgccggccacctggacgtggtgaagtacctgagaagacacggcgccagctggcaggccagagacctgggcggctgcaccgccctgcactgggccgccgacggcggccactgcagcgtgatcgagtggatgatcaaggacggctgcgaggtggacgtggtggacaccggcagcggctggacccccctgatgagagtgagcgccgtgagcggcaaccagagagtggccagcctgctgatcgacgccggcgccaacgtgaacgtgaaggacagaaacggcaagacccccctgatgagcgtggtgagcctgctggaggagagaaagaagaagcagagacccaagaagagctgcgtgtgctag

SEQ ID NO: 81678 - DNA, 1116 bp, Artificial Sequence
  Description of Artificial Sequence: Synthetic coding sequence
ctgcagaagcagaagatcatgccccccagcaagccccacccccccgtggtgggcaaggtgacccaccacagcatcgagctgtactgggacctggagaagaaggccaagagacagggcccccaggagcagtggttcagattcagcatcgaggaggaggaccccaagatgcacacctacggcatcatctacaccggctacgccaccaagcacgtggtggagggcctggagcccagaaccctgtacagattcagactgaaggtgaccagccccagcggcgagtgcgagtacagccccctggtgagcgtgagcaccaccagacccagcctgagcaagagcctggtgaagatcagaatggtgaccagcgtgctgcacggcccccccaccgagaacaccggcgagcccatcagcagcgagcacctgcacagagccgtgagcgtgaacgacgaggacctgctggtgagaatcctgcagggcggcagagtgaaggtggacgtgcccaacaagttcggcttcaccgccctgatggtggccgcccagaagggctacaccagactggtgaagatcctggtgagcaacggcaccgacgtgaacctgaagaacggcagcggcaaggacagcctgatgctggcctgctacgccggccacctggacgtggtgaagtacctgagaagacacggcgccagctggcaggccagagacctgggcggctgcaccgccctgcactgggccgccgacggcggccactgcagcgtgatcgagtggatgatcaaggacggctgcgaggtggacgtggtggacaccggcagcggctggacccccctgatgagagtgagcgccgtgagcggcaaccagagagtggccagcctgctgatcgacgccggcgccaacgtgaacgtgaaggacagaaacggcaagacccccctgatggtggccgtgctgaacaaccacgaggagctggtgcagctgctgctggacaagggcgccgacgccagcgtgaagaacgagttcggcaagggcgtgctggagatggccagagtgttcgacagacagagcgtggtgagcctgctggaggagagaaagaagaagcagagacccaagaagagctgcgtgtgctag

SEQ ID NO: 81679 - DNA, 1038 bp, Artificial Sequence
  Description of Artificial Sequence: Synthetic coding sequence
atggagccccagaagatcatgccccccagcaagccccacccccccgtggtgggcaaggtgacccaccacagcatcgagctgtactgggacctggagaagaaggccaagagacagggcccccaggagcagtggttcagattcagcatcgaggaggaggaccccaagatgcacacctacggcatcatctacaccggctacgccaccaagcacgtggtggagggcctggagcccagaaccctgtacagattcagactgaaggtgaccagccccagcggcgagtgcgagtacagccccctggtgagcgtgagcaccaccagagagcccatcagcagcgagcacctgcacagagccgtgagcgtgaacgacgaggacctgctggtgagaatcctgcagggcggcagagtgaaggtggacgtgcccaacaagttcggcttcaccgccctgatggtggccgcccagaagggctacaccagactggtgaagatcctggtgagcaacggcaccgacgtgaacctgaagaacggcagcggcaaggacagcctgatgctggcctgctacgccggccacctggacgtggtgaagtacctgagaagacacggcgccagctggcaggccagagacctgggcggctgcaccgccctgcactgggccgccgacggcggccactgcagcgtgatcgagtggatgatcaaggacggctgcgaggtggacgtggtggacaccggcagcggctggacccccctgatgagagtgagcgccgtgagcggcaaccagagagtggccagcctgctgatcgacgccggcgccaacgtgaacgtgaaggacagaaacggcaagacccccctgatggtggccgtgctgaacaaccacgaggagctggtgcagctgctgctggacaagggcgccgacgccagcgtgaagaacgagttcggcaagggcgtgctggagatggccagagtgttcgacagacagagcgtggtgagcctgctggaggagagaaagaagaagcagagacccaagaagagctgcgtgtgctag

SEQ ID NO: 81680 - DNA, 1020 bp, Artificial Sequence
  Description of Artificial Sequence: Synthetic coding sequence
atgccccccagcaagccccacccccccgtggtgggcaaggtgacccaccacagcatcgagctgtactgggacctggagaagaaggccaagagacagggcccccaggagcagtggttcagattcagcatcgaggaggaggaccccaagatgcacacctacggcatcatctacaccggctacgccaccaagcacgtggtggagggcctggagcccagaaccctgtacagattcagactgaaggtgaccagccccagcggcgagtgcgagtacagccccctggtgagcgtgagcaccaccagagagcccatcagcagcgagcacctgcacagagccgtgagcgtgaacgacgaggacctgctggtgagaatcctgcagggcggcagagtgaaggtggacgtgcccaacaagttcggcttcaccgccctgatggtggccgcccagaagggctacaccagactggtgaagatcctggtgagcaacggcaccgacgtgaacctgaagaacggcagcggcaaggacagcctgatgctggcctgctacgccggccacctggacgtggtgaagtacctgagaagacacggcgccagctggcaggccagagacctgggcggctgcaccgccctgcactgggccgccgacggcggccactgcagcgtgatcgagtggatgatcaaggacggctgcgaggtggacgtggtggacaccggcagcggctggacccccctgatgagagtgagcgccgtgagcggcaaccagagagtggccagcctgctgatcgacgccggcgccaacgtgaacgtgaaggacagaaacggcaagacccccctgatggtggccgtgctgaacaaccacgaggagctggtgcagctgctgctggacaagggcgccgacgccagcgtgaagaacgagttcggcaagggcgtgctggagatggccagagtgttcgacagacagagcgtggtgagcctgctggaggagagaaagaagaagcagagacccaagaagagctgcgtgtgctag

SEQ ID NO: 81681 - DNA, 375 bp, Artificial Sequence
  Description of Artificial Sequence: Synthetic coding sequence
atgccccccagcaagccccacccccccgtggtgggcaaggtgacccaccacagcatcgagctgtactgggacctggagaagaaggccaagagacagggcccccaggagcagtggttcagattcagcatcgaggaggaggaccccaagatgcacacctacggcatcatctacaccggctacgccaccaagcacgtggtggagggcctggagcccagaaccctgtacagattcagactgaaggtgaccagccccagcggcgagtgcgagtacagccccctggtgagcgtgagcaccaccagagagcccatcagcagcgagcacctgcacagagccgtgagcgtgaacgacgaggacctgctggtgagaatcctgtag

SEQ ID NO: 81682 - DNA, 402 bp, Artificial Sequence; identical to SEQ ID NO: 81676
  Description of Artificial Sequence: Synthetic coding sequence

SEQ ID NO: 81683 - DNA, 441 bp, Artificial Sequence
  Description of Artificial Sequence: Synthetic coding sequence
atgccccccagcaagccccacccccccgtggtgggcaaggtgacccaccacagcatcgagctgtactgggacctggagaagaaggccaagagacagggcccccaggagcagtggttcagattcagcatcgaggaggaggaccccaagatgcacacctacggcatcatctacaccggctacgccaccaagcacgtggtggagggcctggagcccagaaccctgtacagattcagactgaaggtgaccagccccagcggcgagtgcgagtacagccccctggtgagcgtgagcaccaccagcgagtacagcgacagaccccacagccccctgagcagaagcatggagatgaccagcaacctggagaagatcttctgcctgagcttcggcctgaccagaagcagaaacgacaccatcttcaagcactgcaacaacatctgctag

SEQ ID NO: 81684 - DNA, 600 bp, Artificial Sequence
  Description of Artificial Sequence: Synthetic coding sequence
tgagagcccatcagcagcgagcacctgcacagagccgtgagcgtgaacgacgaggacctgctggtgagaatcctgcagggcggcagagtgaaggtggacgtgcccaacaagttcggcttcaccgccctgatggtggccgcccagaagggctacaccagactggtgaagatcctggtgagcaacggcaccgacgtgaacctgaagaacggcagcggcaaggacagcctgatgctggcctgctacgccggccacctggacgtggtgaagtacctgagaagacacggcgccagctggcaggccagagacctgggcggctgcaccgccctgcactgggccgccgacggcggccactgcagcgtgatcgagtggatgatcaaggacggctgcgaggtggacgtggtggacaccggcagcggctggacccccctgatgagagtgagcgccgtgagcggcaaccagagagtggccagcctgctgatcgacgccggcgccaacgtgaacgtgaaggacagaaacggcaagacccccctgatgagcgtggtgagcctgctggaggagagaaagaagaagcagagacccaagaagagctgcgtgtgctag

SEQ ID NO: 81685 - DNA, 735 bp, Artificial Sequence
  Description of Artificial Sequence: Synthetic coding sequence
atggaggtgaccggcgtgagcgcccccaccgtgaccgtgttcatcagcagcagcctgaacaccttcagaagcgagaagagatacagcagaagcctgaccatcgccgagttcaagtgcaagctggagctgctggtgggcagccccgccagctgcatggagctggagctgtacggcgtggacgacaagttctacagcaagctggaccaggaggacgccctgctgggcagctaccccgtggacgacggctgcagaatccacgtgatcgaccacagcggcgccagactgggcgagtacgaggacgtgagcagagtggagaagtacaccatcagccaggaggcctacgaccagagacaggacaccgtgagaagcttcctgaagagaagcaagctgggcagatacaacgaggaggagagagcccagcaggaggccgaggccgcccagagactggccgaggagaaggcccaggccagcagcatccccgtgggcagcagatgcgaggtgagagccgccggccagagccccagaagaggcaccgtgatgtacgtgggcctgaccgacttcaagcccggctactggatcggcgtgagatacgacgagcccctgggcaagaacgacggcagcgtgaacggcaagagatacttcgagtgccaggccaagtacggcgccttcgtgaagcccgccgtggtgaccgtgggcgacttccccgaggaggactacggcctggacgagatctag

SEQ ID NO: 81686 - DNA, 1497 bp, Artificial Sequence
  Description of Artificial Sequence: Synthetic coding sequence
atggacagccagaaggaggccctgcagagaatcatcagcaccctggccaacaagaacgacgagatccagaacttcatcgacaccctgcaccacaccctgaagggcgtgcaggagaacagcagcaacatcctgagcgagctggacgaggagttcgacagcctgtacagcatcctggacgaggtgaaggagagcatgatcaactgcatcaagcaggagcaggccagaaagagccaggagctgcagagccagatcagccagtgcaacaacgccctggagaacagcgaggagctgctggagttcgccaccagaagcctggacatcaaggagcccgaggagttcagcaaggccgccagacagatcaaggacagagtgaccatggccagcgccttcagactgagcctgaagcccaaggtgagcgacaacatgacccacctgatggtggacttcagccaggagagacagatgctgcagaccctgaagttcctgcccgtgcccaaggcccccgagatcgaccccgtggagtgcctggtggccgacaacagcgtgaccgtggcctggagaatgcccgaggaggacaacaagatcgaccacttcatcctggagcacagaaagaccaacttcgacggcctgcccagagtgaaggacgagagatgctgggagatcatcgacaacatcaagggcaccgagtacaccctgagcggcctgaagttcgacagcaagtacatgaacttcagagtgagagcctgcaacaaggccgtggccggcgagtacagcgaccccgtgaccctggagaccaaggccctgaacttcaacctggacaacagcagcagccacctgaacctgaaggtggaggacacctgcgtggagtgggaccccaccggcggcaagggccaggagagcaagatcaagggcaaggagaacaagggcagaagcggcacccccagccccaagagaaccagcgtgggcagcagaccccccgccgtgagaggcagcagagacagattcaccggcgagagctacaccgtgctgggcgacaccgccatcgagagcggccagcactactgggaggtgaaggcccagaaggactgcaagagctacagcgtgggcgtggcctacaagaccctgggcaagttcgaccagctgggcaagaccaacaccagctggtgcatccacgtgaacaactggctgcagaacaccttcgccgccaagcacaacaacaaggtgaaggccctggacgtgaccgtgcccgagaagatcggcgtgttctgcgacttcgacggcggccagctgagcttctacgacgccaacagcaagcagctgctgtacagcttcaagaccaagttcacccagcccgtgctgcccggcttcatggtgtggtgcggcggcctgagcctgagcaccggcatgcaggtgcccagcgccgtgagaaccctgcagaagagcgagaacggcatgaccggcagcgccagcagcctgaacaacgtggtgacccagtag

SEQ ID NO: 81687 - DNA, 438 bp, Artificial Sequence
  Description of Artificial Sequence: Synthetic coding sequence
atggacagccagaaggaggccctgcagagaatcatcagcaccctggccaacaagaacgacgagatccagaacttcatcgacaccctgcaccacaccctgaagggcgtgcaggagaacagcagcaacatcctgagcgagctggacgaggagttcgacagcctgtacagcatcctggacgaggtgaaggagagcatgatcaactgcatcaagcaggagcaggccagaaagagccaggagctgcagagccagatcagccagtgcaacaacgccctggagaacagcgaggagctgctggagttcgccaccagaagcctggacatcaaggagcccgaggagttcagcaaggtgcacaagaactgcatcaacaccctgaacaagggcagctgcatcttcaagaaggccttcctgttcttcttcagcttcggcttcctgtactag

SEQ ID NO: 81688 - DNA, 1593 bp, Artificial Sequence
  Description of Artificial Sequence: Synthetic coding sequence
atggacagccagaagtactgcttcaaggagaacgagaacgtgaccgtggacaaggcctgcttcctgatcagcaacatcaccatcggccccgagagcatcaacctgcagcaggaggccctgcagagaatcatcagcaccctggccaacaagaacgacgagatccagaacttcatcgacaccctgcaccacaccctgaagggcgtgcaggagaacagcagcaacatcctgagcgagctggacgaggagttcgacagcctgtacagcatcctggacgaggtgaaggagagcatgatcaactgcatcaagcaggagcaggccagaaagagccaggagctgcagagccagatcagccagtgcaacaacgccctggagaacagcgaggagctgctggagttcgccaccagaagcctggacatcaaggagcccgaggagttcagcaaggccgccagacagatcaaggacagagtgaccatggccagcgccttcagactgagcctgaagcccaaggtgagcgacaacatgacccacctgatggtggacttcagccaggagagacagatgctgcagaccctgaagttcctgcccgtgcccaaggcccccgagatcgaccccgtggagtgcctggtggccgacaacagcgtgaccgtggcctggagaatgcccgaggaggacaacaagatcgaccacttcatcctggagcacagaaagaccaacttcgacggcctgcccagagtgaaggacgagagatgctgggagatcatcgacaacatcaagggcaccgagtacaccctgagcggcctgaagttcgacagcaagtacatgaacttcagagtgagagcctgcaacaaggccgtggccggcgagtacagcgaccccgtgaccctggagaccaaggccctgaacttcaacctggacaacagcagcagccacctgaacctgaaggtggaggacacctgcgtggagtgggaccccaccggcggcaagggccaggagagcaagatcaagggcaaggagaacaagggcagaagcggcacccccagccccaagagaaccagcgtgggcagcagaccccccgccgtgagaggcagcagagacagattcaccggcgagagctacaccgtgctgggcgacaccgccatcgagagcggccagcactactgggaggtgaaggcccagaaggactgcaagagctacagcgtgggcgtggcctacaagaccctgggcaagttcgaccagctgggcaagaccaacaccagctggtgcatccacgtgaacaactggctgcagaacaccttcgccgccaagcacaacaacaaggtgaaggccctggacgtgaccgtgcccgagaagatcggcgtgttctgcgacttcgacggcggccagctgagcttctacgacgccaacagcaagcagctgctgtacagcttcaagaccaagttcacccagcccgtgctgcccggcttcatggtgtggtgcggcggcctgagcctgagcaccggcatgcaggtgcccagcgccgtgagaaccctgcagaagagcgagaacggcatgaccggcagcgccagcagcctgaacaacgtggtgacccagtag

SEQ ID NO: 81689 - DNA, 1152 bp, Artificial Sequence
  Description of Artificial Sequence: Synthetic coding sequence
atggccagcgccttcagactgagcctgaagcccaaggtgagcgacaacatgacccacctgatggtggacttcagccaggagagacagatgctgcagaccctgaagttcctgcccgtgcccaaggcccccgagatcgaccccgtggagtgcctggtggccgacaacagcgtgaccgtggcctggagaatgcccgaggaggacaacaagatcgaccacttcatcctggagcacagaaagaccaacttcgacggcctgcccagagtgaaggacgagagatgctgggagatcatcgacaacatcaagggcaccgagtacaccctgagcggcctgaagttcgacagcaagtacatgaacttcagagtgagagcctgcaacaaggccgtggccggcgagtacagcgaccccgtgaccctggagaccaaggccctgaacttcaacctggacaacagcagcagccacctgaacctgaaggtggaggacacctgcgtggagtgggaccccaccggcggcaagggccaggagagcaagatcaagggcaaggagaacaagggcagcgtgcacgtgaccagcctgaagaagcacaccagcggcacccccagccccaagagaaccagcgtgggcagcagaccccccgccgtgagaggcagcagagacagattcaccggcgagagctacaccgtgctgggcgacaccgccatcgagagcggccagcactactgggaggtgaaggcccagaaggactgcaagagctacagcgtgggcgtggcctacaagaccctgggcaagttcgaccagctgggcaagaccaacaccagctggtgcatccacgtgaacaactggctgcagaacaccttcgccgccaagcacaacaacaaggtgaaggccctggacgtgaccgtgcccgagaagatcggcgtgttctgcgacttcgacggcggccagctgagcttctacgacgccaacagcaagcagctgctgtacagcttcaagaccaagttcacccagcccgtgctgcccggcttcatggtgtggtgcggcggcctgagcctgagcaccggcatgcaggtgcccagcgccgtgagaaccctgcagaagagcgagaacggcatgaccggcagcgccagcagcctgaacaacgtggtgacccagtag

SEQ ID NO: 81690 - DNA, 5685 bp, Artificial Sequence
  Description of Artificial Sequence: Synthetic coding sequence
atggcccccgaggccggcgccaccctgagagcccccagaagactgagctgggccgccctgctgctgctggccgccctgctgcccgtggccagcagcgccgccgccagcgtggaccaccccctgaagcccagacacgtgaagctgctgagcaccaagatgggcctgaaggtgacctgggacccccccaaggacgccaccagcagacccgtggagcactacaacatcgcctacggcaagagcctgaagagcctgaagtacatcaaggtgaacgccgagacctacagcttcctgatcgaggacgtggagcccggcgtggtgtacttcgtgctgctgaccgccgagaaccacagcggcgtgagcagacccgtgtacagagccgagagcccccccggcggcgagtggatcgagatcgacggcttccccatcaagggccccggccccttcaacgagaccgtgaccgagaaggaggtgcccaacaagcccctgagagtgagagtgagaagcagcgacgacagactgagcgtggcctggaaggcccccagactgagcggcgccaagagccccagaagaagcagaggcttcctgctgggctacggcgagagcggcagaaagatgaactacgtgcccctgaccagagacgagagaacccacgagatcaagaagctggccagcgagagcgtgtacgtggtgagcctgcagagcatgaacagccagggcagaagccagcccgtgtacagagccgccctgaccaagagaaagatcagcgaggaggacgagctggacgtgcccgacgacatcagcgtgagagtgatgagcagccagagcgtgctggtgagctgggtggaccccgtgctggagaagcagaagaaggtggtggccagcagacagtacaccgtgagatacagagagaagggcgagctggccagatgggactacaagcagatcgccaacagaagagtgctgatcgagaacctgatccccgacaccgtgtacgagttcgccgtgagaatcagccagggcgagagagacggcaagtggagcaccagcgtgttccagagaacccccgagagcgcccccaccaccgcccccgagaacctgaacgtgtggcccgtgaacggcaagcccaccgtggtggccgccagctgggacgccctgcccgagaccgagggcaaggtgaaggagtacatcctgagctacgcccccgccctgaagcccttcggcgccaagagcctgacctaccccggcgacaccaccagcgccctggtggacggcctgcagcccggcgagagatacctgttcaagatcagagccaccaacagaagaggcctgggcccccacagcaaggccttcatcgtggccatgcccaccaccagcaaggccgacgtggagcagaacaccgaggacaacggcaagcccgagaagcccgagcccagcagccccagccccagagcccccgccagcagccagcaccccagcgtgcccgccagcccccagggcagaaacgccaaggacctgctgctggacctgaagaacaagatcctggccaacggcggcgcccccagaaagccccagctgagagccaagaaggccgaggagctggacctgcagagcaccgagatcaccggcgaggaggagctgggcagcagagaggacagccccatgagccccagcgacacccaggaccagaagagaaccctgagaccccccagcagacacggccacagcgtggtggcccccggcagaaccgccgtgagagccagaatgcccgccctgcccagaagagagggcgtggacaagcccggcttcagcctggccacccagcccagacccggcgccccccccagcgccagcgccagccccgcccaccacgccagcacccagggcaccagccacagacccagcctgcccgccagcctgaacgacaacgacctggtggacagcgacgaggacgagagagccgtgggcagcctgcaccccaagggcgccttcgcccagcccagacccgccctgagccccagcagacagagccccagcagcgtgctgagagacagaagcagcgtgcaccccggcgccaagcccgccagccccgccagaagaaccccccacagcggcgccgccgaggaggacagcagcgccagcgccccccccagcagactgagccccccccacggcggcagcagcagactgctgcccacccagccccacctgagcagccccctgagcaagggcggcaaggacggcgaggacgcccccgccaccaacagcaacgcccccagcagaagcaccatgagcagcagcgtgagcagccacctgagcagcagaacccaggtgagcgagggcgccgaggccagcgacggcgagagccacggcgacggcgacagagaggacggcggcagacaggccgaggccaccgcccagaccctgagagccagacccgccagcggccacttccacctgctgagacacaagcccttcgccgccaacggcagaagccccagcagattcagcatcggcagaggccccagactgcagcccagcagcagcccccagagcaccgtgcccagcagagcccaccccagagtgcccagccacagcgacagccaccccaagctgagcagcggcatccacggcgacgaggaggacgagaagcccctgcccgccaccgtggtgaacgaccacgtgcccagcagcagcagacagcccatcagcagaggctgggaggacctgagaagaagcccccagagaggcgccagcctgcacagaaaggagcccatccccgagaaccccaagagcaccggcgccgacacccacccccagggcaagtacagcagcctggccagcaaggcccaggacgtgcagcagagcaccgacgccgacaccgagggccacagccccaaggcccagcccggcagcaccgacagacacgccagccccgccagaccccccgccgccagaagccagcagcaccccagcgtgcccagaagaatgacccccggcagagccccccagcagcagccccccccccccgtggccaccagccagcaccaccccggcccccagagcagagacgccggcagaagccccagccagcccagactgagcctgacccaggccggcagacccagacccaccagccagggcagaagccacagcagcagcgacccctacaccgccagcagcagaggcatgctgcccaccgccctgcagaaccaggacgaggacgcccagggcagctacgacgacgacagcaccgaggtggaggcccaggacgtgagagcccccgcccacgccgccagagccaaggaggccgccgccagcctgcccaagcaccagcaggtggagagccccaccggcgccggcgccggcggcgaccacagaagccagagaggccacgccgccagccccgccagacccagcagacccggcggcccccagagcagagccagagtgcccagcagagccgcccccggcaagagcgagccccccagcaagagacccctgagcagcaagagccagcagagcgtgagcgccgaggacgacgaggaggaggacgccggcttcttcaagggcggcaaggaggacctgctgagcagcagcgtgcccaagtggcccagcagcagcacccccagaggcggcaaggacgccgacggcagcctggccaaggaggagagagagcccgccatcgccctggcccccagaggcggcagcctggcccccgtgaagagacccctgccccccccccccggcagcagccccagagccagccacgtgcccagcagactgccccccagaagcgccgccaccgtgagccccgtggccggcacccacccctggccccagtacaccaccagagccccccccggccacttcagcaccacccccatgctgagcctgagacagagaatgatgcacgccagattcagaaaccccctgagcagacagcccgccagacccagctacagacagggctacaacggcagacccaacgtggagggcaaggtgctgcccggcagcaacggcaagcccaacggccagagaatcatcaacggcccccagggcaccaagtgggtggtggacctggacagaggcctggtgctgaacgccgagggcagatacctgcaggacagccacggcaaccccctgagaatcaagctgggcggcgacggcagaaccatcgtggacctggagggcacccccgtggtgagccccgacggcctgcccctgttcggccagggcagacacggcacccccctggccaacgcccaggacaagcccatcctgagcctgggcggcaagcccctggtgggcctggaggtgatcaagaagaccacccacccccccaccaccaccatgcagcccaccaccaccaccacccccctgcccaccaccaccacccccagacccaccaccgccaccaccagaagaaccaccaccaccagaagaaccaccaccagaagacccaccaccaccgtgagaaccaccaccagaaccaccaccaccaccacccccacccccaccacccccatccccacctgcccccccggcaccctggagagacacgacgacgacggcaacctgatcatgagcagcaacggcatccccgagtgctacgccgaggaggacgagttcagcggcctggagaccgacaccgccgtgcccaccgaggaggcctacgtgatctacgacgaggactacgagttcgagaccagcagaccccccaccaccaccgagcccagcaccaccgccaccacccccagagtgatccccgaggagggcgccatcagcagcttccccgaggaggagttcgacctggccggcagaaagagattcgtggccccctacgtgacctacctgaacaaggaccccagcgccccctgcagcctgaccgacgccctggaccacttccaggtggacagcctggacgagatcatccccaacgacctgaagaagagcgacctgcccccccagcacgcccccagaaacatcaccgtggtggccgtggagggctgccacagcttcgtgatcgtggactgggacaaggccacccccggcgacgtggtgaccggctacctggtgtacagcgccagctacgaggacttcatcagaaacaagtggagcacccaggccagcagcgtgacccacctgcccatcgagaacctgaagcccaacaccagatactacttcaaggtgcaggcccagaacccccacggctacggccccatcagccccagcgtgagcttcgtgaccgagagcgacaaccccctgctggtggtgagaccccccggcggcgagcccatctggatccccttcgccttcaagcacgaccccagctacaccgactgccacggcagacagtacgtgaagagaacctggtacagaaagttcgtgggcgtggtgctgtgcaacagcctgagatacaagatctacctgagcgacaacctgaaggacaccttctacagcatcggcgacagctggggcagaggcgaggaccactgccagttcgtggacagccacctggacggcagaaccggcccccagagctacgtggaggccctgcccaccatccagggctactacagacagtacagacaggagcccgtgagattcggcaacatcggcttcggcaccccctactactacgtgggctggtacgagtgcggcgtgagcatccccggcaagtggtag

SEQ ID NO: 81691 - DNA, 5496 bp, Artificial Sequence
  Description of Artificial Sequence: Synthetic coding sequence
atggcccccgaggccggcgccaccctgagagcccccagaagactgagctgggccgccctgctgctgctggccgccctgctgcccgtggccagcagcgccgccgccagcgtggaccaccccctgaagcccagacacgtgaagctgctgagcaccaagatgggcctgaaggtgacctgggacccccccaaggacgccaccagcagacccgtggagcactacaacatcgcctacggcaagagcctgaagagcctgaagtacatcaaggtgaacgccgagacctacagcttcctgatcgaggacgtggagcccggcgtggtgtacttcgtgctgctgaccgccgagaaccacagcggcgtgagcagacccgtgtacagagccgagagcccccccggcggcgagtggatcgagatcgacggcttccccatcaagggccccggccccttcaacgagaccgtgaccgagaaggaggtgcccaacaagcccctgagagtgagagtgagaagcagcgacgacagactgagcgtggcctggaaggcccccagactgagcggcgccaagagccccagaagaagcagaggcttcctgctgggctacggcgagagcggcagaaagatgaactacgtgcccctgaccagagacgagagaacccacgagatcaagaagctggccagcgagagcgtgtacgtggtgagcctgcagagcatgaacagccagggcagaagccagcccgtgtacagagccgccctgaccaagagaaagatcagcgaggaggacgagctggacgtgcccgacgacatcagcgtgagagtgatgagcagccagagcgtgctggtgagctgggtggaccccgtgctggagaagcagaagaaggtggtggccagcagacagtacaccgtgagatacagagagaagggcgagctggccagatgggactacaagcagatcgccaacagaagagtgctgatcgagaacctgatccccgacaccgtgtacgagttcgccgtgagaatcagccagggcgagagagacggcaagtggagcaccagcgtgttccagagaacccccgagagcgcccccaccaccgcccccgagaacctgaacgtgtggcccgtgaacggcaagcccaccgtggtggccgccagctgggacgccctgcccgagaccgagggcaaggtgaaggccagcaaggccgacgtggagcagaacaccgaggacaacggcaagcccgagaagcccgagcccagcagccccagccccagagcccccgccagcagccagcaccccagcgtgcccgccagcccccagggcagaaacgccaaggacctgctgctggacctgaagaacaagatcctggccaacggcggcgcccccagaaagccccagctgagagccaagaaggccgaggagctggacctgcagagcaccgagatcaccggcgaggaggagctgggcagcagagaggacagccccatgagccccagcgacacccaggaccagaagagaaccctgagaccccccagcagacacggccacagcgtggtggcccccggcagaaccgccgtgagagccagaatgcccgccctgcccagaagagagggcgtggacaagcccggcttcagcctggccacccagcccagacccggcgccccccccagcgccagcgccagccccgcccaccacgccagcacccagggcaccagccacagacccagcctgcccgccagcctgaacgacaacgacctggtggacagcgacgaggacgagagagccgtgggcagcctgcaccccaagggcgccttcgcccagcccagacccgccctgagccccagcagacagagccccagcagcgtgctgagagacagaagcagcgtgcaccccggcgccaagcccgccagccccgccagaagaaccccccacagcggcgccgccgaggaggacagcagcgccagcgccccccccagcagactgagccccccccacggcggcagcagcagactgctgcccacccagccccacctgagcagccccctgagcaagggcggcaaggacggcgaggacgcccccgccaccaacagcaacgcccccagcagaagcaccatgagcagcagcgtgagcagccacctgagcagcagaacccaggtgagcgagggcgccgaggccagcgacggcgagagccacggcgacggcgacagagaggacggcggcagacaggccgaggccaccgcccagaccctgagagccagacccgccagcggccacttccacctgctgagacacaagcccttcgccgccaacggcagaagccccagcagattcagcatcggcagaggccccagactgcagcccagcagcagcccccagagcaccgtgcccagcagagcccaccccagagtgcccagccacagcgacagccaccccaagctgagcagcggcatccacggcgacgaggaggacgagaagcccctgcccgccaccgtggtgaacgaccacgtgcccagcagcagcagacagcccatcagcagaggctgggaggacctgagaagaagcccccagagaggcgccagcctgcacagaaaggagcccatccccgagaaccccaagagcaccggcgccgacacccacccccagggcaagtacagcagcctggccagcaaggcccaggacgtgcagcagagcaccgacgccgacaccgagggccacagccccaaggcccagcccggcagcaccgacagacacgccagccccgccagaccccccgccgccagaagccagcagcaccccagcgtgcccagaagaatgacccccggcagagccccccagcagcagccccccccccccgtggccaccagccagcaccaccccggcccccagagcagagacgccggcagaagccccagccagcccagactgagcctgacccaggccggcagacccagacccaccagccagggcagaagccacagcagcagcgacccctacaccgccagcagcagaggcatgctgcccaccgccctgcagaaccaggacgaggacgcccagggcagctacgacgacgacagcaccgaggtggaggcccaggacgtgagagcccccgcccacgccgccagagccaaggaggccgccgccagcctgcccaagcaccagcaggtggagagccccaccggcgccggcgccggcggcgaccacagaagccagagaggccacgccgccagccccgccagacccagcagacccggcggcccccagagcagagccagagtgcccagcagagccgcccccggcaagagcgagccccccagcaagagacccctgagcagcaagagccagcagagcgtgagcgccgaggacgacgaggaggaggacgccggcttcttcaagggcggcaaggaggacctgctgagcagcagcgtgcccaagtggcccagcagcagcacccccagaggcggcaaggacgccgacggcagcctggccaaggaggagagagagcccgccatcgccctggcccccagaggcggcagcctggcccccgtgaagagacccctgccccccccccccggcagcagccccagagccagccacgtgcccagcagactgccccccagaagcgccgccaccgtgagccccgtggccggcacccacccctggccccagtacaccaccagagccccccccggccacttcagcaccacccccatgctgagcctgagacagagaatgatgcacgccagattcagaaaccccctgagcagacagcccgccagacccagctacagacagggctacaacggcagacccaacgtggagggcaaggtgctgcccggcagcaacggcaagcccaacggccagagaatcatcaacggcccccagggcaccaagtgggtggtggacctggacagaggcctggtgctgaacgccgagggcagatacctgcaggacagccacggcaaccccctgagaatcaagctgggcggcgacggcagaaccatcgtggacctggagggcacccccgtggtgagccccgacggcctgcccctgttcggccagggcagacacggcacccccctggccaacgcccaggacaagcccatcctgagcctgggcggcaagcccctggtgggcctggaggtgatcaagaagaccacccacccccccaccaccaccatgcagcccaccaccaccaccacccccctgcccaccaccaccacccccagacccaccaccgccaccaccagaagaaccaccaccaccagaagaaccaccaccagaagacccaccaccaccgtgagaaccaccaccagaaccaccaccaccaccacccccacccccaccacccccatccccacctgcccccccggcaccctggagagacacgacgacgacggcaacctgatcatgagcagcaacggcatccccgagtgctacgccgaggaggacgagttcagcggcctggagaccgacaccgccgtgcccaccgaggaggcctacgtgatctacgacgaggactacgagttcgagaccagcagaccccccaccaccaccgagcccagcaccaccgccaccacccccagagtgatccccgaggagggcgccatcagcagcttccccgaggaggagttcgacctggccggcagaaagagattcgtggccccctacgtgacctacctgaacaaggaccccagcgccccctgcagcctgaccgacgccctggaccacttccaggtggacagcctggacgagatcatccccaacgacctgaagaagagcgacctgcccccccagcacgcccccagaaacatcaccgtggtggccgtggagggctgccacagcttcgtgatcgtggactgggacaaggccacccccggcgacgtggtgaccggctacctggtgtacagcgccagctacgaggacttcatcagaaacaagtggagcacccaggccagcagcgtgacccacctgcccatcgagaacctgaagcccaacaccagatactacttcaaggtgcaggcccagaacccccacggctacggccccatcagccccagcgtgagcttcgtgaccgagagcgacaaccccctgctggtggtgagaccccccggcggcgagcccatctggatccccttcgccttcaagcacgaccccagctacaccgactgccacggcagacagtacgtgaagagaacctggtacagaaagttcgtgggcgtggtgctgtgcaacagcctgagatacaagatctacctgagcgacaacctgaaggacaccttctacagcatcggcgacagctggggcagaggcgaggaccactgccagttcgtggacagccacctggacggcagaaccggcccccagagctacgtggaggccctgcccaccatccagggctactacagacagtacagacaggagcccgtgagattcggcaacatcggcttcggcaccccctactactacgtgggctggtacgagtgcggcgtgagcatccccggcaagtggtag

SEQ ID NO: 81692 - DNA, 3615 bp, Artificial Sequence
  Description of Artificial Sequence: Synthetic coding sequence
atgtacgtgaccatgatgatgaccgaccagatccccctggagctgccccccctgctgaacggcgaggtggccatgatgccccacctggtgaacggcgacgccgcccagcaggtgatcctggtgcaggtgaaccccggcgagaccttcaccatcagagccgaggacggcaccctgcagtgcatccagggccccgccgaggtgcccatgatgagccccaacggcagcatcccccccatccacgtgccccccggctacatcagccaggtgatcgaggacagcaccggcgtgagaagagtggtggtgaccccccagagccccgagtgctacccccccagctaccccagcgccatgagccccacccaccacctgcccccctacctgacccaccacccccacttcatccacaacagccacaccgcctactacccccccgtgaccggccccggcgacatgcccccccagttcttcccccagcaccacctgccccacaccatctacggcgagcaggagatcatccccttctacggcatgagcacctacatcaccagagaggaccagtacagcaagcccccccacaagaagctgaaggacagacagatcgacagacagaacagactgaacagcccccccagcagcatctacaagagcagctgcaccaccgtgtacaacggctacggcaagggccacagcggcggcagcggcggcggcggcagcggcagcggccccggcatcaagaagaccgagagaagagccagaagcagccccaagagcaacgacagcgacctgcaggagtacgagctggaggtgaagagagtgcaggacatcctgagcggcatcgagaagccccaggtgagcaacatccaggccagagccgtggtgctgagctgggccccccccgtgggcctgagctgcggcccccacagcggcctgagcttcccctacagctacgaggtggccctgagcgacaagggcagagacggcaagtacaagatcatctacagcggcgaggagctggagtgcaacctgaaggacctgagacccgccaccgactaccacgtgagagtgtacgccatgtacaacagcgtgaagggcagctgcagcgagcccgtgagcttcaccacccacagctgcgcccccgagtgccccttcccccccaagctggcccacagaagcaagagcagcctgaccctgcagtggaaggcccccatcgacaacggcagcaagatcaccaactacctgctggagtgggacgagggcaagagaaacagcggcttcagacagtgcttcttcggcagccagaagcactgcaagctgaccaagctgtgccccgccatgggctacaccttcagactggccgccagaaacgacatcggcaccagcggctacagccaggaggtggtgtgctacaccctgggcaacatcccccagatgcccagcgcccccagactggtgagagccggcatcacctgggtgaccctgcagtggagcaagcccgagggctgcagccccgaggaggtgatcacctacaccctggagatccaggaggacgagaacgacaacctgttccaccccaagtacaccggcgaggacctgacctgcaccgtgaagaacctgaagagaagcacccagtacaagttcagactgaccgccagcaacaccgagggcaagagctgccccagcgaggtgctggtgtgcaccaccagccccgacagacccggcccccccaccagacccctggtgaagggccccgtgaccagccacggcttcagcgtgaagtgggacccccccaaggacaacggcggcagcgagatcctgaagtacctgctggagatcaccgacggcaacagcgaggccaaccagtgggaggtggcctacagcggcagcgccaccgagtacaccttcacccacctgaagcccggcaccctgtacaagctgagagcctgctgcatcagcaccggcggccacagccagtgcagcgagagcctgcccgtgagaaccctgagcatcgcccccggccagtgcagaccccccagagtgctgggcagacccaagcacaaggaggtgcacctggagtgggacgtgcccgccagcgagagcggctgcgaggtgagcgagtacagcgtggagatgaccgagcccgaggacgtggccagcgaggtgtaccacggccccgagctggagtgcaccgtgggcaacctgctgcccggcaccgtgtacagattcagagtgagagccctgaacgacggcggctacggcccctacagcgacgtgagcgagatcaccaccgccgccggcccccccggccagtgcaaggccccctgcatcagctgcacccccgacggctgcgtgctggtgggctgggagagccccgacagcagcggcgccgacatcagcgagtacagactggagtggggcgaggacgaggagagcctggagctgatctaccacggcaccgacaccagattcgagatcagagacctgctgcccgccgcccagtactgctgcagactgcaggccttcaaccaggccggcgccggcccctacagcgagctggtgctgtgccagacccccgccagcgcccccgaccccgtgagcaccctgtgcgtgctggaggaggagcccctggacgcctaccccgacagccccagcgcctgcctggtgctgaactgggaggagccctgcaacaacggcagcgagatcctggcctacaccatcgacctgggcgacaccagcatcaccgtgggcaacaccaccatgcacgtgatgaaggacctgctgcccgagaccacctacagaatcagaatccaggccatcaacgagatcggcgccggccccttcagccagttcatcaaggccaagaccagacccctgccccccctgccccccagactggagtgcgccgccgccggcccccagagcctgaagctgaagtggggcgacagcaacagcaagacccacgccgccgaggacatcgtgtacaccctgcagctggaggacagaaacaagagattcatcagcatctacagaggccccagccacacctacaaggtgcagagactgaccgagttcacctgctacagcttcagaatccaggccgccagcgaggccggcgagggccccttcagcgagacctacaccttcagcaccaccaagagcgtgccccccaccatcaaggcccccagagtgacccagctggagggcaacagctgcgagatcctgtgggagaccgtgcccagcatgaagggcgaccccgtgaactacatcctgcaggtgctggtgggcagagagagcgagtacaagcaggtgtacaagggcgaggaggccaccttccagatcagcggcctgcagaccaacaccgactacagattcagagtgtgcgcctgcagaagatgcctggacaccagccaggagctgagcggcgccttcagccccagcgccgccttcgtgctgcagagaagcgaggtgatgctgaccggcgacatgggcagcctggacgaccccaagatgaagagcatgatgcccaccgacgagcagttcgccgccatcatcgtgctgggcttcgccaccctgagcatcctgttcgccttcatcctgcagtacttcctgatgaagtag

SEQ ID NO: 81693 - DNA, 216 bp, Artificial Sequence
  Description of Artificial Sequence: Synthetic coding sequence
atgtacgtgaccatgatgatgaccgaccagatccccctggagctgccccccctgctgaacggcgaggtggccatgatgccccacctggtgaacggcgacgccgcccagcaggtgatcctggtgcaggtgaaccccggcgagaccttcaccatcagagccgaggacggcaccctgcagtgcatccaggaggtgaacgtgaagagacactgcctgtag

SEQ ID NO: 81694 - DNA, 3615 bp, Artificial Sequence; identical to SEQ ID NO: 81692
  Description of Artificial Sequence: Synthetic coding sequence

SEQ ID NO: 81695 - DNA, 3615 bp, Artificial Sequence; identical to SEQ ID NO: 81692
  Description of Artificial Sequence: Synthetic coding sequence

SEQ ID NO: 81696 - DNA, 627 bp, Artificial Sequence
  Description of Artificial Sequence: Synthetic coding sequence
atgttcaccaaggagaagatctggagcgaggtgatcctggtgcaggtgaaccccggcgagaccttcaccatcagagccgaggacggcaccctgcagtgcatccagggccccgccgaggtgcccatgatgagccccaacggcagcatcccccccatccacgtgccccccggctacatcagccaggtgatcgaggacagcaccggcgtgagaagagtggtggtgaccccccagagccccgagtgctacccccccagctaccccagcgccatgagccccacccaccacctgcccccctacctgacccaccacccccacttcatccacaacagccacaccgcctactacccccccgtgaccggccccggcgacatgcccccccagttcttcccccagcaccacctgccccacaccatctacggcgagcaggagatcatccccttctacggcatgagcacctacatcaccagagaggaccagtacagcaagcccccccacaagaagctgaaggacagacagatcgacagacagaacagactgaacagcccccccagcagcatctacaagagcagctgcaccaccgtgtacaacggctacggcaagggccacagcggcggcagcggcggctag

SEQ ID NO: 81697 - DNA, 705 bp, Artificial Sequence
  Description of Artificial Sequence: Synthetic coding sequence
atgcccagcggctgccacagcagcccccccagcggcctgagaggcgacatggccagcctggtgcccctgagcccctacctgagccccaccgtgctgctgctggtgagctgcgacctgggcttcgtgagagccgacagaccccccagccccgtgaacgtgaccgtgacccacctgagagccaacagcgccaccgtgagctgggacgtgcccgagggcaacatcgtgatcggctacagcatcagccagcagagacagaacggccccggccagagagtgatcagagaggtgaacaccaccaccagagcctgcgccctgtggggcctggccgaggacagcgactacaccgtgcaggtgagaagcatcggcctgagaggcgagagcccccccggccccagagtgcacttcagaaccctgaagggcagcgacagactgcccagcaacagcagcagccccggcgacatcaccgtggagggcctggacggcgagagacccctgcagaccggcgaggtggtgatcatcgtggtggtgctgctgatgtgggccgccgtgatcggcctgttctgcagacagtacgacatcatcaaggacaacgacagcaacaacaaccccaaggagaagggcaagggccccgagcagagcccccagggcagacccgtgggcaccagacagaagaagagccccagcatcaacaccatcgacgtgtag

SEQ ID NO: 81698 - DNA, 2478 bp, Artificial Sequence
  Description of Artificial Sequence: Synthetic coding sequence
atggtgggcaagagccagcagaccgacgtgatcgagaagaagaagcacatggccatccccaagagcagcagccccaaggccacccacagaatcggcaacaccagcggcagcaagggcagctacagcgccaaggcctacgagagcatcagagtgagcagcgagctgcagcagacctggaccaagagaaagcacggccaggagatgaccagcaagagcctgcagaccgacaccatcgtggaggagaagaaggaggtgaagctggtggaggagaccgtggtgcccgaggagaagagcgccgacgtgagagaggccgccatcgagctgcccgagagcgtgcaggacgtggagatcccccccaacatccccagcgtgcagctgaagatggacagaagccagcagaccagcagaaccggctactggaccatgatgaacatcccccccgtggagaaggtggacaaggagcagcagacctacttcagcgagagcgagatcgtggtgatcagcagacccgacagcagcagcaccaagagcaaggaggacgccctgaagcacaagagcagcggcaagatcttcgccagcgagcaccccgagttccagcccgccaccaacagcaacgaggagatcggccagaagaacatcagcagaaccagcttcacccaggagaccaagaagggcccccccgtgctgctggaggacgagctgagagaggaggtgaccgtgcccgtggtgcaggagggcagcgccgtgaagaaggtggccagcgccgagatcgagccccccagcaccgagaagttccccgccaagatccagccccccctggtggaggaggccaccgccaaggccgagcccagacccgccgaggagacccacgtgcaggtgcagcccagcaccgaggagacccccgacgccgaggccgccaccgccgtggccgagaacagcgtgaaggtgcagcccccccccgccgaggaggcccccctggtggagttccccgccgagatccagccccccagcgccgaggagagccccagcgtggagctgctggccgagatcctgccccccagcgccgaggagagccccagcgaggagccccccgccgagatcctgcccccccccgccgagaagagccccagcgtggagctgctgggcgagatcagaagccccagcgcccagaaggcccccatcgaggtgcagcccctgcccgccgagggcgccctggaggaggcccccgccaaggtggagccccccaccgtggaggagaccctggccgacgtgcagcccctgctgcccgaggaggcccccagagaggaggccagagagctgcagctgagcaccgccatggagacccccgccgaggaggcccccaccgagttccagagccccctgcccaaggagaccaccgccgaggaggccagcgccgagatccagctgctggccgccaccgagccccccgccgacgagacccccgccgaggccagaagccccctgagcgaggagaccagcgccgaggaggcccacgccgaggtgcagagccccctggccgaggagaccaccgccgaggaggccagcgccgagatccagctgctggccgccatcgaggcccccgccgacgagacccccgccgaggcccagagccccctgagcgaggagaccagcgccgaggaggcccccgccgaggtgcagagccccagcgccaagggcgtgagcatcgaggaggcccccctggagctgcagccccccagcggcgaggagaccaccgccgaggaggccagcgccgccatccagctgctggccgccaccgaggccagcgccgaggaggcccccgccgaggtgcagcccccccccgccgaggaggcccccgccgaggtgcagcccccccccgccgaggaggcccccgccgaggtgcagcccccccccgccgaggaggcccccgccgaggtgcagcccccccccgccgaggaggcccccgccgaggtgcagcccccccccgccgaggaggcccccgccgaggtgcagcccccccccgccgaggaggcccccgccgaggtgcagagcctgcccgccgaggagacccccatcgaggagaccctggccgccgtgcacagcccccccgccgacgacgtgcccgccgaggaggccagcgtggacaagcacagcccccccgccgacctgctgctgaccgaggagttccccatcggcgaggccagcgccgaggtgagccccccccccagcgagcagacccccgaggacgaggccctggtggagaacgtgagcaccgagttccagagcccccaggtggccggcatccccgccgtgaagctgggcagcgtggtgctggagggcgaggccaagttcgaggaggtgagcaagatcaacagcgtgctgaaggacctgagcaacaccaacgacggccaggcccccaccctggagatcgagagcgtgttccacatcgagctgaagcagagaccccccgagctgtag

SEQ ID NO: 81699 - DNA, 2157 bp, Artificial Sequence
  Description of Artificial Sequence: Synthetic coding sequence
atggtgggcaagagccagcagaccgacgtgatcgagaagaagaagcacatggccatccccaagagcagcagccccaaggccacccacagaatcggcaacaccagcggcagcaagggcagctacagcgccaaggcctacgagagcatcagagtgagcagcgagctgcagcagacctggaccaagagaaagcacggccaggagatgaccagcaagagcctgcagaccgacaccatcgtggaggagaagaaggaggtgaagctggtggaggagaccgtggtgcccgaggagaagagcgccgacgtgagagaggccgccatcgagctgcccgagagcgtgcaggacgtggagatcccccccaacatccccagcgtgcagctgaagatggacagaagccagcagaccagcagaaccggctactggaccatgatgaacatcccccccgtggagaaggtggacaaggagcagcagacctacttcagcgagagcgagatcgtggtgatcagcagacccgacagcagcagcaccaagagcaaggaggacgccctgaagcacaagagcagcggcaagatcttcgccagcgagcaccccgagttccagcccgccaccaacagcaacgaggagatcggccagaagaacatcagcagaaccagcttcacccaggagaccaagaagggcccccccgtgctgctggaggacgagctgagagaggaggtgaccgtgcccgtggtgcaggagggcagcgccgtgaagaaggtggccagcgccgagatcgagccccccagcaccgagaagttccccgccaagatccagccccccctggtggaggaggccaccgccaaggccgagcccagacccgccgaggagacccacgtgcaggtgcagcccagcaccgaggagacccccgacgccgaggccgccaccgccgtggccgagaacagcgtgaaggtgcagcccccccccgccgaggaggcccccctggtggagttccccgccgagatccagccccccagcgccgaggagagccccagcgtggagctgctggccgagatcctgccccccagcgccgaggagagccccagcgaggagccccccgccgagatcctgcccccccccgccgagaagagccccagcgtggagctgctgggcgagatcagaagccccagcgcccagaaggcccccatcgaggtgcagcccctgcccgccgagggcgccctggaggaggcccccgccaaggtggagccccccaccgtggaggagaccctggccgacgtgcagcccctgctgcccgaggaggcccccagagaggaggccagagagctgcagctgagcaccgccatggagacccccgccgaggaggcccccaccgagttccagagccccctgcccaaggagaccaccgccgaggaggccagcgccgagatccagctgctggccgccaccgagaccagcgccgaggaggcccccgccgaggtgcagagccccagcgccgaggaggcccccgccgaggtgcagcccccccccgccgaggaggcccccgccgaggtgcagcccccccccgccgaggaggcccccgccgaggtgcagcccccccccgccgaggaggcccccgccgaggtgcagcccccccccgccgaggaggcccccgccgaggtgcagcccccccccgccgaggaggcccccgccgaggtgcagcccccccccgccgaggaggcccccgccgaggtgcagagcctgcccgccgaggagacccccatcgaggagaccctggccgccgtgcacagcccccccgccgacgacgtgcccgccgaggaggccagcgtggacaagcacagcccccccgccgacctgctgctgaccgaggagttccccatcggcgaggccagcgccgaggtgagccccccccccagcgagcagacccccgaggacgaggccctggtggagaacgtgagcaccgagttccagagcccccaggtggccggcatccccgccgtgaagctgggcagcgtggtgctggagggcgaggccaagttcgaggaggtgagcaagatcaacagcgtgctgaaggacctgagcaacaccaacgacggccaggcccccaccctggagatcgagagcgtgttccacatcgagctgaagcagagaccccccgagctgtag

SEQ ID NO: 81700 - DNA, 2052 bp, Artificial Sequence
  Description of Artificial Sequence: Synthetic coding sequence
atggagagagccgcccccagcagaagagtgcccctgcccctgctgctgctgggcggcctggccctgctggccgccggcgtggacgccgacgtgctgctggaggcctgctgcgccgacggccacagaatggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccgacaagatcatcgaggtggaggaggagcaggaggacccctacctgaacgacagatgcagaggcggcggcccctgcaagcagcagtgcagagacaccggcgacgaggtggtgtgcagctgcttcgtgggctaccagctgctgagcgacggcgtgagctgcgaggacgtgaacgagtgcatcaccggcagccacagctgcagactgggcgagagctgcatcaacaccgtgggcagcttcagatgccagagagacagcagctgcggcaccggctacgagctgaccgaggacaacagctgcaaggacatcgacgagtgcgagagcggcatccacaactgcctgcccgacttcatctgccagaacaccctgggcagcttcagatgcagacccaagctgcagtgcaagagcggcttcatccaggacgccctgggcaactgcatcgacatcaacgagtgcctgagcatcagcgccccctgccccatcggccacacctgcatcaacaccgagggcagctacacctgccagaagaacgtgcccaactgcggcagaggctaccacctgaacgaggagggcaccagatgcgtggacgtggacgagtgcgccccccccgccgagccctgcggcaagggccacagatgcgtgaacagccccggcagcttcagatgcgagtgcaagaccggctactacttcgacggcatcagcagaatgtgcgtggacgtgaacgagtgccagagataccccggcagactgtgcggccacaagtgcgagaacaccctgggcagctacctgtgcagctgcagcgtgggcttcagactgagcgtggacggcagaagctgcgaggacatcaacgagtgcagcagcagcccctgcagccaggagtgcgccaacgtgtacggcagctaccagtgctactgcagaagaggctaccagctgagcgacgtggacggcgtgacctgcgaggacatcgacgagtgcgccctgcccaccggcggccacatctgcagctacagatgcatcaacatccccggcagcttccagtgcagctgccccagcagcggctacagactggcccccaacggcagaaactgccaggacatcgacgagtgcgtgaccggcatccacaactgcagcatcaacgagacctgcttcaacatccagggcggcttcagatgcctggccttcgagtgccccgagaactacagaagaagcgccgccaccagatgcgagagactgccctgccacgagaacagagagtgcagcaagctgcccctgagaatcacctactaccacctgagcttccccaccaacatccaggcccccgccgtggtgttcagaatgggccccagcagcgccgtgcccggcgacagcatgcagctggccatcaccggcggcaacgaggagggcttcttcaccaccagaaaggtgagcccccacagcggcgtggtggccctgaccaagcccgtgcccgagcccagagacctgctgctgaccgtgaagatggacctgagcagacacggcaccgtgagcagcttcgtggccaagctgttcatcttcgtgagcgccgagctgtag

SEQ ID NO: 81701 - DNA, 2112 bp, Artificial Sequence
  Description of Artificial Sequence: Synthetic coding sequence
atggagagagccgcccccagcagaagagtgcccctgcccctgctgctgctgggcggcctggccctgctggccgccggcgtggacgccgacgtgctgctggaggcctgctgcgccgacggccacagaatggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccgacaagatcatcgaggtggaggaggagcaggaggacccctacctgaacgacagatgcagaggcggcggcccctgcaagcagcagtgcagagacaccggcgacgaggtggtgtgcagctgcttcgtgggctaccagctgctgagcgacggcgtgagctgcgaggacgtgaacgagtgcatcaccggcagccacagctgcagactgggcgagagctgcatcaacaccgtgggcagcttcagatgccagagagacagcagctgcggcaccggctacgagctgaccgaggacaacagctgcaaggacatcgacgagtgcgagagcggcatccacaactgcctgcccgacttcatctgccagaacaccctgggcagcttcagatgcagacccaagctgcagtgcaagagcggcttcatccaggacgccctgggcaactgcatcgacatcaacgagtgcctgagcatcagcgccccctgccccatcggccacacctgcatcaacaccgagggcagctacacctgccagaagaacgtgcccaactgcggcagaggctaccacctgaacgaggagggcaccagatgcgtggacgtggacgagtgcgccccccccgccgagccctgcggcaagggccacagatgcgtgaacagccccggcagcttcagatgcgagtgcaagaccggctactacttcgacggcatcagcagaatgtgcgtggacgtgaacgagtgccagagataccccggcagactgtgcggccacaagtgcgagaacaccctgggcagctacctgtgcagctgcagcgtgggcttcagactgagcgtggacggcagaagctgcgaggacatcaacgagtgcagcagcagcccctgcagccaggagtgcgccaacgtgtacggcagctaccagtgctactgcagaagaggctaccagctgagcgacgtggacggcgtgacctgcgaggacatcgacgagtgcgccctgcccaccggcggccacatctgcagctacagatgcatcaacatccccggcagcttccagtgcagctgccccagcagcggctacagactggcccccaacggcagaaactgccaggacatcgacgagtgcgtgaccggcatccacaactgcagcatcaacgagacctgcttcaacatccagggcggcttcagatgcctggccttcgagtgccccgagaactacagaagaagcgccgccaccctgcagcaggagaagaccgacaccgtgagatgcatcaagagctgcagacccaacgacgtgacctgcgtgttcgaccccgtgcacaccatcagccacaccgtgatcagcctgcccaccttcagagagttcaccagacccgaggagatcatcttcctgagagccatcacccccccccaccccgccagccaggccaacatcatcttcgacatcaccgagggcaacctgagagacagcttcgacatcatcaagagatacatggacggcatgaccgtgggcgtggtgagacaggtgagacccatcgtgggccccttccacgccgtgctgaagctggagatgaactacgtggtgggcggcgtggtgagccacagaaacgtggtgaacgtgcacatcttcgtgagcgagtactggttctag

SEQ ID NO: 81702 - DNA, 1701 bp, Artificial Sequence
  Description of Artificial Sequence: Synthetic coding sequence
atggagagagccgcccccagcagaagagtgcccctgcccctgctgctgctgggcggcctggccctgctggccgccggcgtggacgccgacgtgctgctggaggcctgctgcgccgacggccacagaatggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccgacaagatcatcgaggtggaggaggagcaggaggacccctacctgaacgacagatgcagaggcggcggcccctgcaagcagcagtgcagagacaccggcgacgaggtggtgtgcagctgcttcgtgggctaccagctgctgagcgacggcgtgagctgcgaggacgtgaacgagtgcatcaccggcagccacagctgcagactgggcgagagctgcatcaacaccgtgggcagcttcagatgccagagagacagcagctgcggcaccggctacgagctgaccgaggacaacagctgcaaggacatcgacgagtgcgagagcggcatccacaactgcctgcccgacttcatctgccagaacaccctgggcagcttcagatgcagacccaagctgcagtgcaagagcggcttcatccaggacgccctgggcaactgcatcgacatcaacgagtgcctgagcatcagcgccccctgccccatcggccacacctgcatcaacaccgagggcagctacacctgccagaagaacgtgcccaactgcggcagaggctaccacctgaacgaggagggcaccagatgcgtggacgtggacgagtgcgccccccccgccgagccctgcggcaagggccacagatgcgtgaacagccccggcagcttcagatgcgagtgcaagaccggctactacttcgacggcatcagcagaatgtgcgtggacgtgaacgagtgccagagataccccggcagactgtgcggccacaagtgcgagaacaccctgggcagctacctgtgcagctgcagcgtgggcttcagactgagcgtggacggcagaagctgcgaggacatcaacgagtgcagcagcagcccctgcagccaggagtgcgccaacgtgtacggcagctaccagtgctactgcagaagaggctaccagctgagcgacgtggacggcgtgacctgcgaggacatcgacgagtgcgccctgcccaccggcggccacatctgcagctacagatgcatcaacatccccggcagcttccagtgcagctgccccagcagcggctacagactggcccccaacggcagaaactgccaggacatcgacgagtgcgtgaccggcatccacaactgcagcatcaacgagacctgcttcaacatccagggcggcttcagatgcctggccttcgagtgccccgagaactacagaagaagcgccgccacctag

SEQ ID NO: 81703 - DNA, 2112 bp, Artificial Sequence
  Description of Artificial Sequence: Synthetic coding sequence
atggagagagccgcccccagcagaagagtgcccctgcccctgctgctgctgggcggcctggccctgctggccgccggcgtggacgccgacgtgctgctggaggcctgctgcgccgacggccacagaatggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccgacaagatcatcgaggtggaggaggagcaggaggacccctacctgaacgacagatgcagaggcggcggcccctgcaagcagcagtgcagagacaccggcgacgaggtggtgtgcagctgcttcgtgggctaccagctgctgagcgacggcgtgagctgcgaggacgtgaacgagtgcatcaccggcagccacagctgcagactgggcgagagctgcatcaacaccgtgggcagcttcagatgccagagagacagcagctgcggcaccggctacgagctgaccgaggacaacagctgcaaggacatcgacgagtgcgagagcggcatccacaactgcctgcccgacttcatctgccagaacaccctgggcagcttcagatgcagacccaagctgcagtgcaagagcggcttcatccaggacgccctgggcaactgcatcgacatcaacgagtgcctgagcatcagcgccccctgccccatcggccacacctgcatcaacaccgagggcagctacacctgccagaagaacgtgcccaactgcggcagaggctaccacctgaacgaggagggcaccagatgcgtggacgtggacgagtgcgccccccccgccgagccctgcggcaagggccacagatgcgtgaacagccccggcagcttcagatgcgagtgcaagaccggctactacttcgacggcatcagcagaatgtgcgtggacgtgaacgagtgccagagataccccggcagactgtgcggccacaagtgcgagaacaccctgggcagctacctgtgcagctgcagcgtgggcttcagactgagcgtggacggcagaagctgcgaggacatcaacgagtgcagcagcagcccctgcagccaggagtgcgccaacgtgtacggcagctaccagtgctactgcagaagaggctaccagctgagcgacgtggacggcgtgacctgcgaggacatcgacgagtgcgccctgcccaccggcggccacatctgcagctacagatgcatcaacatccccggcagcttccagtgcagctgccccagcagcggctacagactggcccccaacggcagaaactgccaggacatcgacgagtgcgtgaccggcatccacaactgcagcatcaacgagacctgcttcaacatccagggcggcttcagatgcctggccttcgagtgccccgagaactacagaagaagcgccgccacccagaagagcaagaagggcagacagaacacccccgccggcagcagcaaggaggactgcagagtgctgccctggaagcagggcctggaggacacccacctggacgcctacctgccctgctgcagaagattcaccagacccgaggagatcatcttcctgagagccatcacccccccccaccccgccagccaggccaacatcatcttcgacatcaccgagggcaacctgagagacagcttcgacatcatcaagagatacatggacggcatgaccgtgggcgtggtgagacaggtgagacccatcgtgggccccttccacgccgtgctgaagctggagatgaactacgtggtgggcggcgtggtgagccacagaaacgtggtgaacgtgcacatcttcgtgagcgagtactggttctag

SEQ ID NO: 81704 - DNA, 2166 bp, Artificial Sequence
  Description of Artificial Sequence: Synthetic coding sequence
atggagagagccgcccccagcagaagagtgcccctgcccctgctgctgctgggcggcctggccctgctggccgccggcgtggacgccgacgtgctgctggaggcctgctgcgccgacggccacagaatggccacccaccagaaggactgcagcctgccctacgccaccgagagcaaggagtgcagagccgtgggcctggccagcctgtgccaggacctgaacggcgcctgggccgtgtggaaggtgggcagagccagccaggccgagggcaccgccagcgccagagcccagagaagaggcatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccgacaagatcatcgaggtggaggaggagcaggaggacccctacctgaacgacagatgcagaggcggcggcccctgcaagcagcagtgcagagacaccggcgacgaggtggtgtgcagctgcttcgtgggctaccagctgctgagcgacggcgtgagctgcgaggacgtgaacgagtgcatcaccggcagccacagctgcagactgggcgagagctgcatcaacaccgtgggcagcttcagatgccagagagacagcagctgcggcaccggctacgagctgaccgaggacaacagctgcaaggacatcgacgagtgcgagagcggcatccacaactgcctgcccgacttcatctgccagaacaccctgggcagcttcagatgcagacccaagctgcagtgcaagagcggcttcatccaggacgccctgggcaactgcatcgacatcaacgagtgcctgagcatcagcgccccctgccccatcggccacacctgcatcaacaccgagggcagctacacctgccagaagaacgtgcccaactgcggcagaggctaccacctgaacgaggagggcaccagatgcgtggacgtggacgagtgcgccccccccgccgagccctgcggcaagggccacagatgcgtgaacagccccggcagcttcagatgcgagtgcaagaccggctactacttcgacggcatcagcagaatgtgcgtggacgtgaacgagtgccagagataccccggcagactgtgcggccacaagtgcgagaacaccctgggcagctacctgtgcagctgcagcgtgggcttcagactgagcgtggacggcagaagctgcgaggacatcaacgagtgcagcagcagcccctgcagccaggagtgcgccaacgtgtacggcagctaccagtgctactgcagaagaggctaccagctgagcgacgtggacggcgtgacctgcgaggacatcgacgagtgcgccctgcccaccggcggccacatctgcagctacagatgcatcaacatccccggcagcttccagtgcagctgccccagcagcggctacagactggcccccaacggcagaaactgccaggacatcgacgagtgcgtgaccggcatccacaactgcagcatcaacgagacctgcttcaacatccagggcggcttcagatgcctggccttcgagtgccccgagaactacagaagaagcgccgccaccagatgcgagagactgccctgccacgagaacagagagtgcagcaagctgcccctgagaatcacctactaccacctgagcttccccaccaacatccaggcccccgccgtggtgttcagaatgggccccagcagcgccgtgcccggcgacagcatgcagctggccatcaccggcggcaacgaggagggcttcttcaccaccagaaaggtgagcccccacagcggcgtggtggccctgaccaagcccgtgcccgagcccagagacctgctgctgaccgtgaagatggacctgagcagacacggcaccgtgagcagcttcgtggccaagctgttcatcttcgtgagcgccgagctgtag

SEQ ID NO: 81705 - DNA, 570 bp, Artificial Sequence
  Description of Artificial Sequence: Synthetic coding sequence
atgaacagctacaccagaggcagcagaagacccagcgccaaggccgccagccccgccgccagcgtgaccagcagagtgagccccagcggccccggcgtgcccgtggacgccgacgtgctgctggaggcctgctgcgccgacggccacagaatggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccgacaagatcatcgaggtggaggaggagcaggaggacccctacctgaacgacagatgcagatag

SEQ ID NO: 81706 - DNA, 81 bp, Artificial Sequence
  Description of Artificial Sequence: Synthetic coding sequence
atggccacccaccagaaggactgcagcctgccctacgccaccgagagcaaggagtgcagaatggtgcaggagcagtgctag

SEQ ID NO: 81707 - DNA, 1806 bp, Artificial Sequence
  Description of Artificial Sequence: Synthetic coding sequence
atggagagagccgcccccagcagaagagtgcccctgcccctgctgctgctgggcggcctggccctgctggccgccggcgtggacgccgacgtgctgctggaggcctgctgcgccgacggccacagaatggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccgacaagatcatcgaggtggaggaggagcaggaggacccctacctgaacgacagatgcagaggcggcggcccctgcaagcagcagtgcagagacaccggcgacgaggtggtgtgcagctgcttcgtgggctaccagctgctgagcgacggcgtgagctgcgaggacgtgaacgagtgcatcaccggcagccacagctgcagactgggcgagagctgcatcaacaccgtgggcagcttcagatgccagagagacagcagctgcggcaccggctacgagctgaccgaggacaacagctgcaaggacatcgacgagtgcgagagcggcatccacaactgcctgcccgacttcatctgccagaacaccctgggcagcttcagatgcagacccaagctgcagtgcaagagcggcttcatccaggacgccctgggcaactgcatcgacatcaacgagtgcctgagcatcagcgccccctgccccatcggccacacctgcatcaacaccgagggcagctacacctgccagaagaacgtgcccaactgcggcagaggctaccacctgaacgaggagggcaccagatgcgtggacgtggacgagtgcgccccccccgccgagccctgcggcaagggccacagatgcgtgaacagccccggcagcttcagatgcgagtgcaagaccggctactacttcgacggcatcagcagaatgtgcgtggacgtgaacgagtgccagagataccccggcagactgtgcggccacaagtgcgagaacaccctgggcagctacctgtgcagctgcagcgtgggcttcagactgagcgtggacggcagaagctgcgaggacatcaacgagtgcagcagcagcccctgcagccaggagtgcgccaacgtgtacggcagctaccagtgctactgcagaagaggctaccagctgagcgacgtggacggcgtgacctgcgaggacatcgacgagtgcgccctgcccaccggcggccacatctgcagctacagatgcatcaacatccccggcagcttccagtgcagctgccccagcagcggctacagactggcccccaacggcagaaactgccaggacatcgacgagtgcgtgaccggcatccacaactgcagcatcaacgagacctgcttcaacatccagggcggcttcagatgcctggccttcgagtgccccgagaactacagaagaagcgccgccacccagaagagcaagaagggcagacagaacacccccgccggcagcagcaaggaggactgcagagtgctgccctggaagcagggcctggaggacacccacctggacgcctag

SEQ ID NO: 81708 - DNA, 198 bp, Artificial Sequence
  Description of Artificial Sequence: Synthetic coding sequence
atggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagtag

SEQ ID NO: 81709 - DNA, 546 bp, Artificial Sequence
  Description of Artificial Sequence: Synthetic coding sequence
tgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccggcggcggcccctgcaagcagcagtgcagagacaccggcgacgaggtggtgtgcagctgcttcgtgggctaccagctgctgagcgacggcgtgagctgcgaggacgtgaacgagtgcatcaccggcagccacagctgcagactgggcgagagctgcatcaacaccgtgggcagcttcagatgccagagagacagcagctgcggcaccggctacgagctgaccgaggacaacagctgcaagtag

SEQ ID NO: 81710 - DNA, 420 bp, Artificial Sequence
  Description of Artificial Sequence: Synthetic coding sequence
atggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccgacaagatcatcgaggtggaggaggagcaggaggacccctacctgaacgacagatgcagatag

SEQ ID NO: 81711 - DNA, 519 bp, Artificial Sequence
  Description of Artificial Sequence: Synthetic coding sequence
atggagagagccgcccccagcagaagagtgcccctgcccctgctgctgctgggcggcctggccctgctggccgccggcgtggacgccgacgtgctgctggaggcctgctgcgccgacggccacagaatggccacccaccagaaggactgcagcctgccctacgccaccgagagcaaggagtgcagaatggtgcaggagcagtgctgccacagccagctggaggagctgcactgcgccaccggcatcagcctggccaacgagcaggacagatgcgccaccccccacggcgacaacgccagcctggaggccaccttcgtgaagagatgctgccactgctgcctgctgggcagagccgcccaggcccagggccagagctgcgagtacagcctgatggtgggctaccagtgcggccaggtgttccaggcctgctgcgtgaagagccaggagaccggcgacctggacgtgggcggcctgcaggagaccggcggcggcccctgcaagcagcagtgcagagactag

SEQ ID NO: 81712 - DNA, 3555 bp, Artificial Sequence
  Description of Artificial Sequence: Synthetic coding sequence
atggtgctgctgtgggagcccgccggcgcctggctggccctgggcctggccctggccctgggccccagcgtggccgccgccgcccccagacaggactgcaccggcgtggagtgcccccccctggagaactgcatcgaggaggccctggagcccggcgcctgctgcgccacctgcgtgcagcagggctgcgcctgcgagggctaccagtactacgactgcctgcagggcggcttcgtgagaggcagagtgcccgccggccagagctacttcgtggacttcggcagcaccgagtgcagctgcccccccggcggcggcaagatcagctgccagttcatgctgtgccccgagctgccccccaactgcatcgaggccgtggtggtggccgacagctgcccccagtgcggccaggtgggctgcgtgcacgccggccacaagtacgccgccggccacaccgtgcacctgcccccctgcagagcctgccactgccccgacgccggcggcgagctgatctgctaccagctgcccggctgccacggcaacttcagcgacgccgaggagggcgaccccgagagacactacgaggacccctacagctacgaccaggaggtggccgaggtggaggccgccaccgccctgggcggcgaggtgcaggccggcgccgtgcaggccggcgccggcggcccccccgccgccctgggcggcggcagccagcccctgagcaccatccaggcccccccctggcccgccgtgctgcccagacccaccgccgccgccgccctgggcccccccgcccccgtgcaggccaaggccagaagagtgaccgaggacagcgaggaggaggaggaggaggaggaggagagagaggagatggccgtgaccgagcagctggccgccggcggccacagaggcctggacggcctgcccaccaccgcccccgccggccccagcctgcccatccaggaggagagagccgaggccggcgccagagccgaggccggcgccagacccgaggagaacctgatcctggacgcccaggccaccagcagaagcaccggccccgagggcgtgacccacgcccccagcctgggcaaggccgccctggtgcccacccaggccgtgcccggcagccccagagaccccgtgaagcccagcccccacaacatcctgagcaccagcctgcccgacgccgcctggatcccccccaccagagaggtgcccagaaagccccaggtgctgccccacagccacgtggaggaggacaccgaccccaacagcgtgcacagcatccccagaagcagccccgagggcagcaccaaggacctgatcgagacctgctgcgccgccggccagcagtgggccatcgacaacgacgagtgcctggagatccccgagagcggcaccgaggacaacgtgtgcagaaccgcccagagacactgctgcgtgagctacctgcaggagaagagctgcatggccggcgtgctgggcgccaaggagggcgagacctgcggcgccgaggacaacgacagctgcggcatcagcctgtacaagcagtgctgcgactgctgcggcctgggcctgagagtgagagccgagggccagagctgcgagagcaaccccaacctgggctacccctgcaaccacgtgatgctgagctgctgcgagggcgaggagcccctgatcgtgcccgaggtgagaagaccccccgagcccgccgccgcccccagaagagtgagcgaggccgagatggccggcagagaggccctgagcctgggcaccgaggccgagctgcccaacagcctgcccggcgacgaccaggacgagtgcctgctgctgcccggcgagctgtgccagcacctgtgcatcaacaccgtgggcagctaccactgcgcctgcttccccggcttcagcctgcaggacgacggcagaacctgcagacccgagggccaccccccccagcccgaggccccccaggagcccgccctgaagagcgagttcagccaggtggccagcaacaccatccccctgcccctgccccagcccaacacctgcaaggacaacggcccctgcaagcaggtgtgcagcaccgtgggcggcagcgccatctgcagctgcttccccggctacgccatcatggccgacggcgtgagctgcgaggacatcaacgagtgcgtgaccgacctgcacacctgcagcagaggcgagcactgcgtgaacaccctgggcagcttccactgctacaaggccctgacctgcgagcccggctacgccctgaaggacggcgagtgcgaggacgtggacgagtgcgccatgggcacccacacctgccagcccggcttcctgtgccagaacaccaagggcagcttctactgccaggccagacagagatgcatggacggcttcctgcaggaccccgagggcaactgcgtggacatcaacgagtgcaccagcctgagcgagccctgcagacccggcttcagctgcatcaacaccgtgggcagctacacctgccagagaaaccccctgatctgcgccagaggctaccacgccagcgacgacggcaccaagtgcgtggacgtgaacgagtgcgagaccggcgtgcacagatgcggcgagggccaggtgtgccacaacctgcccggcagctacagatgcgactgcaaggccggcttccagagagacgccttcggcagaggctgcatcgacgtgaacgagtgctgggccagccccggcagactgtgccagcacacctgcgagaacaccctgggcagctacagatgcagctgcgccagcggcttcctgctggccgccgacggcaagagatgcgaggacgtgaacgagtgcgaggcccagagatgcagccaggagtgcgccaacatctacggcagctaccagtgctactgcagacagggctaccagctggccgaggacggccacacctgcaccgacatcgacgagtgcgcccagggcgccggcatcctgtgcaccttcagatgcctgaacgtgcccggcagctaccagtgcgcctgccccgagcagggctacaccatgaccgccaacggcagaagctgcaaggacgtggacgagtgcgccctgggcacccacaactgcagcgaggccgagacctgccacaacatccagggcagcttcagatgcctgagattcgagtgcccccccaactacgtgcaggtgagcaagaccaagtgcgagagaaccacctgccacgacttcctggagtgccagaacagccccgccagaatcacccactaccagctgaacttccagaccggcctgctggtgcccgcccacatcttcagaatcggccccgcccccgccttcaccggcgacaccatcgccctgaacatcatcaagggcaacgaggagggctacttcggcaccagaagactgaacgcctacaccggcgtggtgtacctgcagagagccgtgctggagcccagagacttcgccctggacgtggagatgaagctgtggagacagggcagcgtgaccaccttcctggccaagatgcacatcttcttcaccaccttcgccctgtag

SEQ ID NO: 81713 - DNA, 3696 bp, Artificial Sequence
  Description of Artificial Sequence: Synthetic coding sequence
atggtgctgctgtgggagcccgccggcgcctggctggccctgggcctggccctggccctgggccccagcgtggccgccgccgcccccagacaggactgcaccggcgtggagtgcccccccctggagaactgcatcgaggaggccctggagcccggcgcctgctgcgccacctgcgtgcagcagggctgcgcctgcgagggctaccagtactacgactgcctgcagggcggcttcgtgagaggcagagtgcccgccggccagagctacttcgtggacttcggcagcaccgagtgcagctgcccccccggcggcggcaagatcagctgccagttcatgctgtgccccgagctgccccccaactgcatcgaggccgtggtggtggccgacagctgcccccagtgcggccaggtgggctgcgtgcacgccggccacaagtacgccgccggccacaccgtgcacctgcccccctgcagagcctgccactgccccgacgccggcggcgagctgatctgctaccagctgcccggctgccacggcaacttcagcgacgccgaggagggcgaccccgagagacactacgaggacccctacagctacgaccaggaggtggccgaggtggaggccgccaccgccctgggcggcgaggtgcaggccggcgccgtgcaggccggcgccggcggcccccccgccgccctgggcggcggcagccagcccctgagcaccatccaggcccccccctggcccgccgtgctgcccagacccaccgccgccgccgccctgggcccccccgcccccgtgcaggccaaggccagaagagtgaccgaggacagcgaggaggaggaggaggaggaggaggagagagaggagatggccgtgaccgagcagctggccgccggcggccacagaggcctggacggcctgcccaccaccgcccccgccggccccagcctgcccatccaggaggagagagccgaggccggcgccagagccgaggccggcgccagacccgaggagaacctgatcctggacgcccaggccaccagcagaagcaccggccccgagggcgtgacccacgcccccagcctgggcaaggccgccctggtgcccacccaggccgtgcccggcagccccagagaccccgtgaagcccagcccccacaacatcctgagcaccagcctgcccgacgccgcctggatcccccccaccagagaggtgcccagaaagccccaggtgctgccccacagccacgtggaggaggacaccgaccccaacagcgtgcacagcatccccagaagcagccccgagggcagcaccaaggacctgatcgagacctgctgcgccgccggccagcagtgggccatcgacaacgacgagtgcctggagatccccgagagcggcaccgaggacaacgtgtgcagaaccgcccagagacactgctgcgtgagctacctgcaggagaagagctgcatggccggcgtgctgggcgccaaggagggcgagacctgcggcgccgaggacaacgacagctgcggcatcagcctgtacaagcagtgctgcgactgctgcggcctgggcctgagagtgagagccgagggccagagctgcgagagcaaccccaacctgggctacccctgcaaccacgtgatgctgagctgctgcgagggcgaggagcccctgatcgtgcccgaggtgagaagaccccccgagcccgccgccgcccccagaagagtgagcgaggccgagatggccggcagagaggccctgagcctgggcaccgaggccgagctgcccaacagcctgcccggcgacgaccaggacgagtgcctgctgctgcccggcgagctgtgccagcacctgtgcatcaacaccgtgggcagctaccactgcgcctgcttccccggcttcagcctgcaggacgacggcagaacctgcagacccgagggccaccccccccagcccgaggccccccaggagcccgccctgaagagcgagttcagccaggtggccagcaacaccatccccctgcccctgccccagcccaacacctgcaaggacaacggcccctgcaagcaggtgtgcagcaccgtgggcggcagcgccatctgcagctgcttccccggctacgccatcatggccgacggcgtgagctgcgaggaccaggacgagtgcctgatgggcgcccacgactgcagcagaagacagttctgcgtgaacaccctgggcagcttctactgcgtgaaccacaccgtgctgtgcgccgacggctacatcctgaacgcccacagaaagtgcgtggacatcaacgagtgcgtgaccgacctgcacacctgcagcagaggcgagcactgcgtgaacaccctgggcagcttccactgctacaaggccctgacctgcgagcccggctacgccctgaaggacggcgagtgcgaggacgtggacgagtgcgccatgggcacccacacctgccagcccggcttcctgtgccagaacaccaagggcagcttctactgccaggccagacagagatgcatggacggcttcctgcaggaccccgagggcaactgcgtggacatcaacgagtgcaccagcctgagcgagccctgcagacccggcttcagctgcatcaacaccgtgggcagctacacctgccagagaaaccccctgatctgcgccagaggctaccacgccagcgacgacggcaccaagtgcgtggacgtgaacgagtgcgagaccggcgtgcacagatgcggcgagggccaggtgtgccacaacctgcccggcagctacagatgcgactgcaaggccggcttccagagagacgccttcggcagaggctgcatcgacgtgaacgagtgctgggccagccccggcagactgtgccagcacacctgcgagaacaccctgggcagctacagatgcagctgcgccagcggcttcctgctggccgccgacggcaagagatgcgaggacgtgaacgagtgcgaggcccagagatgcagccaggagtgcgccaacatctacggcagctaccagtgctactgcagacagggctaccagctggccgaggacggccacacctgcaccgacatcgacgagtgcgcccagggcgccggcatcctgtgcaccttcagatgcctgaacgtgcccggcagctaccagtgcgcctgccccgagcagggctacaccatgaccgccaacggcagaagctgcaaggacgtggacgagtgcgccctgggcacccacaactgcagcgaggccgagacctgccacaacatccagggcagcttcagatgcctgagattcgagtgcccccccaactacgtgcaggtgagcaagaccaagtgcgagagaaccacctgccacgacttcctggagtgccagaacagccccgccagaatcacccactaccagctgaacttccagaccggcctgctggtgcccgcccacatcttcagaatcggccccgcccccgccttcaccggcgacaccatcgccctgaacatcatcaagggcaacgaggagggctacttcggcaccagaagactgaacgcctacaccggcgtggtgtacctgcagagagccgtgctggagcccagagacttcgccctggacgtggagatgaagctgtggagacagggcagcgtgaccaccttcctggccaagatgcacatcttcttcaccaccttcgccctgtag

SEQ ID NO: 81714 - DNA, 480 bp, Artificial Sequence
  Description of Artificial Sequence: Synthetic coding sequence
atggtgctgctgtgggagcccgccggcgcctggctggccctgggcctggccctggccctgggccccagcgtggccgccgccgcccccagacaggactgcaccggcgtggagtgcccccccctggagaactgcatcgaggaggccctggagcccggcgcctgctgcgccacctgcgtgcagcagggctgcgcctgcgagggctaccagtactacgactgcctgcagggcggcttcgtgagaggcagagtgcccgccggccagagctacttcgtggacttcggcagcaccgagtgcagctgcccccccggcggcggcaagatcagctgccagttcatgctgtgccccgagctgccccccaactgcatcgaggccgtggtggtggccgacagctgcccccagtgcggccaggtgggctgcgtgcacgccggccacaagtacgccgccggccacaccgtgcacctgcccccctgcagagcctag

SEQ ID NO: 81715 - DNA, 3696 bp, Artificial Sequence; identical to SEQ ID NO: 81713
  Description of Artificial Sequence: Synthetic coding sequence

SEQ ID NO: 81716 - DNA, 3633 bp, Artificial Sequence
  Description of Artificial Sequence: Synthetic coding sequence
atggagaccagcctgagcctggagagcggccaccacggcagctacagaagaggcgacagacccggcctggcctggaccatggtgctgctgtgggagcccgccggcgcctggctggccctgggcctggccctggccctgggccccagcgtggccgccgccgcccccagacaggactgcaccggcgtggagtgcccccccctggagaactgcatcgaggaggccctggagcccggcgcctgctgcgccacctgcgtgcagcagggctgcgcctgcgagggctaccagtactacgactgcctgcagggcggcttcgtgagaggcagagtgcccgccggccagagctacttcgtggacttcggcagcaccgagtgcagctgcccccccggcggcggcaagatcagctgccagttcatgctgtgccccgagctgccccccaactgcatcgaggccgtggtggtggccgacagctgcccccagtgcggccaggtgggctgcgtgcacgccggccacaagtacgccgccggccacaccgtgcacctgcccccctgcagagcctgccactgccccgacgccggcggcgagctgatctgctaccagctgcccggctgccacggcaacttcagcgacgccgaggagggcgaccccgagagacactacgaggacccctacagctacgaccaggaggtggccgaggtggaggccgccaccgccctgggcggcgaggtgcaggccggcgccgtgcaggccggcgccggcggcccccccgccgccctgggcggcggcagccagcccctgagcaccatccaggcccccccctggcccgccgtgctgcccagacccaccgccgccgccgccctgggcccccccgcccccgtgcaggccaaggccagaagagtgaccgaggacagcgaggaggaggaggaggaggaggaggagagagaggagatggccgtgaccgagcagctggccgccggcggccacagaggcctggacggcctgcccaccaccgcccccgccggccccagcctgcccatccaggaggagagagccgaggccggcgccagagccgaggccggcgccagacccgaggagaacctgatcctggacgcccaggccaccagcagaagcaccggccccgagggcgtgacccacgcccccagcctgggcaaggccgccctggtgcccacccaggccgtgcccggcagccccagagaccccgtgaagcccagcccccacaacatcctgagcaccagcctgcccgacgccgcctggatcccccccaccagagaggtgcccagaaagccccaggtgctgccccacagccacgtggaggaggacaccgaccccaacagcgtgcacagcatccccagaagcagccccgagggcagcaccaaggacctgatcgagacctgctgcgccgccggccagcagtgggccatcgacaacgacgagtgcctggagatccccgagagcggcaccgaggacaacgtgtgcagaaccgcccagagacactgctgcgtgagctacctgcaggagaagagctgcatggccggcgtgctgggcgccaaggagggcgagacctgcggcgccgaggacaacgacagctgcggcatcagcctgtacaagcagtgctgcgactgctgcggcctgggcctgagagtgagagccgagggccagagctgcgagagcaaccccaacctgggctacccctgcaaccacgtgatgctgagctgctgcgagggcgaggagcccctgatcgtgcccgaggtgagaagaccccccgagcccgccgccgcccccagaagagtgagcgaggccgagatggccggcagagaggccctgagcctgggcaccgaggccgagctgcccaacagcctgcccggcgacgaccaggacgagtgcctgctgctgcccggcgagctgtgccagcacctgtgcatcaacaccgtgggcagctaccactgcgcctgcttccccggcttcagcctgcaggacgacggcagaacctgcagacccgagggccaccccccccagcccgaggccccccaggagcccgccctgaagagcgagttcagccaggtggccagcaacaccatccccctgcccctgccccagcccaacacctgcaaggacaacggcccctgcaagcaggtgtgcagcaccgtgggcggcagcgccatctgcagctgcttccccggctacgccatcatggccgacggcgtgagctgcgaggacatcaacgagtgcgtgaccgacctgcacacctgcagcagaggcgagcactgcgtgaacaccctgggcagcttccactgctacaaggccctgacctgcgagcccggctacgccctgaaggacggcgagtgcgaggacgtggacgagtgcgccatgggcacccacacctgccagcccggcttcctgtgccagaacaccaagggcagcttctactgccaggccagacagagatgcatggacggcttcctgcaggaccccgagggcaactgcgtggacatcaacgagtgcaccagcctgagcgagccctgcagacccggcttcagctgcatcaacaccgtgggcagctacacctgccagagaaaccccctgatctgcgccagaggctaccacgccagcgacgacggcaccaagtgcgtggacgtgaacgagtgcgagaccggcgtgcacagatgcggcgagggccaggtgtgccacaacctgcccggcagctacagatgcgactgcaaggccggcttccagagagacgccttcggcagaggctgcatcgacgtgaacgagtgctgggccagccccggcagactgtgccagcacacctgcgagaacaccctgggcagctacagatgcagctgcgccagcggcttcctgctggccgccgacggcaagagatgcgaggacgtgaacgagtgcgaggcccagagatgcagccaggagtgcgccaacatctacggcagctaccagtgctactgcagacagggctaccagctggccgaggacggccacacctgcaccgacatcgacgagtgcgcccagggcgccggcatcctgtgcaccttcagatgcctgaacgtgcccggcagctaccagtgcgcctgccccgagcagggctacaccatgaccgccaacggcagaagctgcaaggacgtggacgagtgcgccctgggcacccacaactgcagcgaggccgagacctgccacaacatccagggcagcttcagatgcctgagattcgagtgcccccccaactacgtgcaggtgagcaagaccaagtgcgagagaaccacctgccacgacttcctggagtgccagaacagccccgccagaatcacccactaccagctgaacttccagaccggcctgctggtgcccgcccacatcttcagaatcggccccgcccccgccttcaccggcgacaccatcgccctgaacatcatcaagggcaacgaggagggctacttcggcaccagaagactgaacgcctacaccggcgtggtgtacctgcagagagccgtgctggagcccagagacttcgccctggacgtggagatgaagctgtggagacagggcagcgtgaccaccttcctggccaagatgcacatcttcttcaccaccttcgccctgtag

SEQ ID NO: 81717 - DNA, 1347 bp, Artificial Sequence
  Description of Artificial Sequence: Synthetic coding sequence
atgcccggcatcaagagaatcctgaccgtgaccatcctggccctgtgcctgcccagccccggcaacgcccaggcccagtgcaccaacggcttcgacctggacagacagagcggccagtgcctggacatcgacgagtgcagaaccatccccgaggcctgcagaggcgacatgatgtgcgtgaaccagaacggcggctacctgtgcatccccagaaccaaccccgtgtacagaggcccctacagcaacccctacagcaccccctacagcggcccctaccccgccgccgccccccccctgagcgcccccaactaccccaccatcagcagacccctgatctgcagattcggctaccagatggacgagagcaaccagtgcgtggacgtggacgagtgcgccaccgacagccaccagtgcaaccccacccagatctgcatcaacaccgagggcggctacacctgcagctgcaccgacggctactggctgctggagggccagtgcctggacatcgacgagtgcagatacggctactgccagcagctgtgcgccaacgtgcccggcagctacagctgcacctgcaaccccggcttcaccctgaacgaggacggcagaagctgccaggacgtgaacgagtgcgccaccgagaacccctgcgtgcagacctgcgtgaacacctacggcagcttcatctgcagatgcgaccccggctacgagctggaggaggacggcgtgcactgcagcgacatggacgagtgcagcttcagcgagttcctgtgccagcacgagtgcgtgaaccagcccggcacctacttctgcagctgcccccccggctacatcctgctggacgacaacagaagctgccaggacatcaacgagtgcgagcacagaaaccacacctgcaacctgcagcagacctgctacaacctgcagggcggcttcaagtgcatcgaccccatcagatgcgaggagccctacctgagaatcagcgacaacagatgcatgtgccccgccgagaaccccggctgcagagaccagcccttcaccatcctgtacagagacatggacgtggtgagcggcagaagcgtgcccgccgacatcttccagatgcaggccaccaccagataccccggcgcctactacatcttccagatcaagagcggcaacgagggcagagagttctacatgagacagaccggccccatcagcgccaccctggtgatgaccagacccatcaagggccccagagagatccagctggacctggagatgatcaccgtgaacaccgtgatcaacttcagaggcagcagcgtgatcagactgagaatctacgtgagccagtaccccttctag

SEQ ID NO: 81718 - DNA, 276 bp, Artificial Sequence
  Description of Artificial Sequence: Synthetic coding sequence
atgcccggcatcaagagaatcctgaccgtgaccatcctggccctgtgcctgcccagccccggcaacgcccaggcccagtgcaccaacggcttcgacctggacagacagagcggccagtgcctggacatcgacgagtgcagaaccatccccgaggcctgcagaggcgacatgatgtgcgtgaaccagaacggcggctacctgtgcatccccagaaccaaccccgtgtacagaggcccctacagcaacccctacagcaccccctacagcggcccctag

SEQ ID NO: 81719 - DNA, 1320 bp, Artificial Sequence
  Description of Artificial Sequence: Synthetic coding sequence
atggtgcccagcagccccagagccctgttcctgctgctgctgatcctggcctgccccgagcccagagccagccagaactgcctgagcaagcagcagctgctgagcgccatcagacagctgcagcagctgctgaagggccaggagaccagattcgccgagggcatcagacacatgaagagcagactggccgccctgcagaacagcgtgggcagagtgggccccgacgccctgcccgtgagctgccccgccctgaacacccccgccgacggcagaaagttcggcagcaagtacctggtggaccacgaggtgcacttcacctgcaaccccggcttcagactggtgggccccagcagcgtggtgtgcctgcccaacggcacctggaccggcgagcagccccactgcagaggcatcagcgagtgcagcagccagccctgccagaacggcggcacctgcgtggagggcgtgaaccagtacagatgcatctgcccccccggcagaaccggcaacagatgccagcaccaggcccagaccgccgcccccgagggcagcgtggccggcgacagcgccttcagcagagcccccagatgcgcccaggtggagagagcccagcactgcagctgcgaggccggcttccacctgagcggcgccgccggcgacagcgtgtgccaggacgtgaacgagtgcgagctgtacggccaggagggcagacccagactgtgcatgcacgcctgcgtgaacacccccggcagctacagatgcacctgccccggcggctacagaaccctggccgacggcaagagctgcgaggacgtggacgagtgcgtgggcctgcagcccgtgtgcccccagggcaccacctgcatcaacaccggcggcagcttccagtgcgtgagccccgagtgccccgagggcagcggcaacgtgagctacgtgaagaccagccccttccagtgcgagagaaacccctgccccatggacagcagaccctgcagacacctgcccaagaccatcagcttccactacctgagcctgcccagcaacctgaagacccccatcaccctgttcagaatggccaccgccagcgcccccggcagagccggccccaacagcctgagattcggcatcgtgggcggcaacagcagaggccacttcgtgatgcagagaagcgacagacagaccggcgacctgatcctggtgcagaacctggagggcccccagaccctggaggtggacgtggacatgagcgagtacctggacagaagcttccaggccaaccacgtgagcaaggtgaccatcttcgtgagcccctacgacttctag

SEQ ID NO: 81720 - DNA, 1182 bp, Artificial Sequence
  Description of Artificial Sequence: Synthetic coding sequence
atggtgcccagcagccccagagccctgttcctgctgctgctgatcctggcctgccccgagcccagagccagccagaactgcctgagcaagcagcagctgctgagcgccatcagacagctgcagcagctgctgaagggccaggagaccagattcgccgagggcatcagacacatgaagagcagactggccgccctgcagaacagcgtgggcagagtgggccccgacgccctgcccgtgagctgccccgccctgaacacccccgccgacggcagaaagttcggcagcaagtacctggtggaccacgaggtgcacttcacctgcaaccccggcttcagactggtgggccccagcagcgtggtgtgcctgcccaacggcacctggaccggcgagcagccccactgcagaggcatcagcgagtgcagcagccagccctgccagaacggcggcacctgcgtggagggcgtgaaccagtacagatgcatctgcccccccggcagaaccggcaacagatgccagcaccaggcccagaccgacgtgaacgagtgcgagctgtacggccaggagggcagacccagactgtgcatgcacgcctgcgtgaacacccccggcagctacagatgcacctgccccggcggctacagaaccctggccgacggcaagagctgcgaggacgtggacgagtgcgtgggcctgcagcccgtgtgcccccagggcaccacctgcatcaacaccggcggcagcttccagtgcgtgagccccgagtgccccgagggcagcggcaacgtgagctacgtgaagaccagccccttccagtgcgagagaaacccctgccccatggacagcagaccctgcagacacctgcccaagaccatcagcttccactacctgagcctgcccagcaacctgaagacccccatcaccctgttcagaatggccaccgccagcgcccccggcagagccggccccaacagcctgagattcggcatcgtgggcggcaacagcagaggccacttcgtgatgcagagaagcgacagacagaccggcgacctgatcctggtgcagaacctggagggcccccagaccctggaggtggacgtggacatgagcgagtacctggacagaagcttccaggccaaccacgtgagcaaggtgaccatcttcgtgagcccctacgacttctag

SEQ ID NO: 81721 - DNA, 942 bp, Artificial Sequence
  Description of Artificial Sequence: Synthetic coding sequence
atggagctggacagagccgtgggcgtgctgggcgccgccaccctgctgctgagcttcctgggcatggcctgggccctgcaggccgccgacacctgccccgaggtgaagatggtgggcctggagggcagcgacaagctgaccatcctgagaggctgccccggcctgcccggcgcccccggccccaagggcgaggccggcaccaacggcaagagaggcgagagaggcccccccggcccccccggcaaggccggcccccccggccccaacggcgcccccggcgagccccagccctgcctgaccggccccagaacctgcaaggacctgctggacagaggccacttcctgagcggctggcacaccatctacctgcccgactgcagacccctgaccgtgctgtgcgacatggacaccgacggcggcggctggaccgtgttccagagaagagtggacggcagcgtggacttctacagagactgggccacctacaagcagggcttcggcagcagactgggcgagttctggctgggcaacgacaacatccacgccctgaccgcccagggcaccagcgagctgagagtggacctggtggacttcgaggacaactaccagttcgccaagtacagaagcttcaaggtggccgacgaggccgagaagtacaacctggtgctgggcgccttcgtggagggcagcgccggcgacagcctgaccttccacaacaaccagagcttcagcaccaaggaccaggacaacgacctgaacaccggcaactgcgccgtgatgttccagggcgcctggtggtacaagaactgccacgtgagcaacctgaacggcagatacctgagaggcacccacggcagcttcgccaacggcatcaactggaagagcggcaagggctacaactacagctacaaggtgagcgagatgaaggtgagacccgcctag

SEQ ID NO: 81722 - DNA, 828 bp, Artificial Sequence
  Description of Artificial Sequence: Synthetic coding sequence
atggagctggacagagccgtgggcgtgctgggcgccgccaccctgctgctgagcttcctgggcatggcctgggccctgcaggccgccgacacctgccccggcgagagaggcccccccggcccccccggcaaggccggcccccccggccccaacggcgcccccggcgagccccagccctgcctgaccggccccagaacctgcaaggacctgctggacagaggccacttcctgagcggctggcacaccatctacctgcccgactgcagacccctgaccgtgctgtgcgacatggacaccgacggcggcggctggaccgtgttccagagaagagtggacggcagcgtggacttctacagagactgggccacctacaagcagggcttcggcagcagactgggcgagttctggctgggcaacgacaacatccacgccctgaccgcccagggcaccagcgagctgagagtggacctggtggacttcgaggacaactaccagttcgccaagtacagaagcttcaaggtggccgacgaggccgagaagtacaacctggtgctgggcgccttcgtggagggcagcgccggcgacagcctgaccttccacaacaaccagagcttcagcaccaaggaccaggacaacgacctgaacaccggcaactgcgccgtgatgttccagggcgcctggtggtacaagaactgccacgtgagcaacctgaacggcagatacctgagaggcacccacggcagcttcgccaacggcatcaactggaagagcggcaagggctacaactacagctacaaggtgagcgagatgaaggtgagacccgcctag

SEQ ID NO: 81723 - DNA, 564 bp, Artificial Sequence
  Description of Artificial Sequence: Synthetic coding sequence
atggagctgagcggcgccaccatggccagaggcctggccgtgctgctggtgctgttcctgcacatcaagaacctgcccgcccaggccgccgacacctgccccgaggtgaaggtggtgggcctggagggcagcgacaagctgaccatcctgagaggctgccccggcctgcccggcgcccccggccccaagggcgaggccggcgtgatcggcgagagaggcgagagaggcctgcccggcgcccccggcaaggccggccccgtgggccccaagggcgacgccggccagagccagagctgcgccaccggccccagaaactgcaaggacctgctggacagaggctacttcctgagcggctggcacaccatctacctgcccgactgcagacccctgaccgtgctgtgcgacatggacaccgacggcggcggctggaccgtgttccagagaagaatggacggcagcgtggacttctacagagactgggccgcctacaagcagggcttcggcagccagctgggcgagttctggctgggcaacgacaacatccacgccctgaccgcccagtag

SEQ ID NO: 81724 - DNA, 981 bp, Artificial Sequence
  Description of Artificial Sequence: Synthetic coding sequence
atggagctgagcggcgccaccatggccagaggcctggccgtgctgctggtgctgttcctgcacatcaagaacctgcccgcccaggccgccgacacctgccccgaggtgaaggtggtgggcctggagggcagcgacaagctgaccatcctgagaggctgccccggcctgcccggcgcccccggccccaagggcgaggccggcgtgatcggcgagagaggcgagagaggcctgcccggcgcccccggcaaggccggccccgtgggccccaagggcgacagaggcgagaagggcatgagaggcgagaagggcgacgccggccagagccagagctgcgccaccggccccagaaactgcaaggacctgctggacagaggctacttcctgagcggctggcacaccatctacctgcccgactgcagacccctgaccgtgctgtgcgacatggacaccgacggcggcggctggaccgtgttccagagaagaatggacggcagcgtggacttctacagagactgggccgcctacaagcagggcttcggcagccagctgggcgagttctggctgggcaacgacaacatccacgccctgaccgcccagggcagcagcgagctgagagtggacctggtggacttcgagggcaaccaccagttcgccaagtacaagagcttcaaggtggccgacgaggccgagaagtacaagctggtgctgggcgccttcgtgggcggcagcgccggcaacagcctgaccggccacaacaacaacttcttcagcaccaaggaccaggacaacgacgtgagcagcagcaactgcgccgagaagttccagggcgcctggtggtacgccgactgccacgccagcaacctgaacggcctgtacctgatgggcccccacgagagctacgccaacggcatcaactggagcgccgccaagggctacaagtacagctacaaggtgagcgagatgaaggtgagacccgcctag

SEQ ID NO: 81725 - DNA, 1083 bp, Artificial Sequence
  Description of Artificial Sequence: Synthetic coding sequence
atggagctgagcggcgccaccatggccagaggcctggccgtgctgctggtgctgttcctgcacatcaagaacctgcccgcccaggccgccgacacctgccccgaggtgaaggtggtgggcctggagggcagcgacaagctgaccatcctgagaggctgccccggcctgcccggcgcccccggccccaagggcgaggccggcgtgatcggcgagagaggcgagagaggcctgcccggcgcccccggcaaggccggccccgtgggccccaagggcgacagaggcgagaagggcatgagaggcgagaagggcgacgccggccagagccagagctgcgccaccggccccagaaactgcaaggacctgctggacagaggctacttcctgagcggctggcacaccatctacctgcccgactgcagacccctgaccgtgctgtgcgacatggacaccgacggcggcggctggaccgtgttccagagaagaatggacggcagcgtggacttctacagagactgggccgcctacaagcagggcttcggcagccagacccacagccacgacgcccacagctgccccttcgcccccagcagcgtgaagcccccccacgcccacaacctgaccagaggcagaatcatgttcctgaacatgttcaccctgggccagaagagcttcaccagcttcaacgtgtgcttcctgaacaccagcggcttcgaccacttccccgtgagcgtggccagacaggtgttcccctggaacctggtgagcagagaggagagcggccccctgttcagcagatggcactacagatgcagcggcagactgagcgacttctgcgaggacttccccccccccgtgatcgacaccggcagaagcagcccccccccccccagcctgccccacccccccatgccccacagccagcacttcaccctgctggagaagggccacttcggcgtgcagaagaccctgaccaagaagggcgagagcctggtgggcaccttcctgctgcccaccaccgccgagttcatgctgtgggccggctggctgctgggcagagacaagcacctggccctgaccaagtag

SEQ ID NO: 81726 - DNA, 900 bp, Artificial Sequence
  Description of Artificial Sequence: Synthetic coding sequence
atggacctgctgtggatcctgcccagcctgtggctgctgctgctgggcggccccgcctgcctgaagacccaggagcaccccagctgccccggccccagagagctggaggccagcaaggtggtgctgctgcccagctgccccggcgcccccggcagccccggcgagaagggcgcccccggcccccagggcccccccggcccccccggcaagatgggccccaagggcgagcccggcgaccccgtgaacctgctgagatgccaggagggccccagaaactgcagagagctgctgagccagggcgccaccctgagcggctggtaccacctgtgcctgcccgagggcagagccctgcccgtgttctgcgacatggacaccgagggcggcggctggctggtgttccagagaagacaggacggcagcgtggacttcttcagaagctggagcagctacagagccggcttcggcaaccaggagagcgagttctggctgggcaacgagaacctgcaccagctgaccctgcagggcaactgggagctgagagtggagctggaggacttcaacggcaacagaaccttcgcccactacgccaccttcagactgctgggcgaggtggaccactaccagctggccctgggcaagttcagcgagggcaccgccggcgacagcctgagcctgcacagcggcagacccttcaccacctacgacgccgaccacgacagcagcaacagcaactgcgccgtgatcgtgcacggcgcctggtggtacgccagctgctacagaagcaacctgaacggcagatacgccgtgagcgaggccgccgcccacaagtacggcatcgactgggccagcggcagaggcgtgggccacccctacagaagagtgagaatgatgctgagatag

SEQ ID NO: 81727 - DNA, 867 bp, Artificial Sequence
  Description of Artificial Sequence: Synthetic coding sequence
atggacctgctgtggatcctgcccagcctgtggctgctgctgctgggcggccccgcctgcctgaagacccaggagcaccccagctgccccggccccagagagctggaggccagcaaggtggtgctgctgcccagctgccccggcgcccccggcagccccggcgagaagggcgcccccggcccccagggcccccccggcccccccggcaagatgggccccaagggcgagcccggccccagaaactgcagagagctgctgagccagggcgccaccctgagcggctggtaccacctgtgcctgcccgagggcagagccctgcccgtgttctgcgacatggacaccgagggcggcggctggctggtgttccagagaagacaggacggcagcgtggacttcttcagaagctggagcagctacagagccggcttcggcaaccaggagagcgagttctggctgggcaacgagaacctgcaccagctgaccctgcagggcaactgggagctgagagtggagctggaggacttcaacggcaacagaaccttcgcccactacgccaccttcagactgctgggcgaggtggaccactaccagctggccctgggcaagttcagcgagggcaccgccggcgacagcctgagcctgcacagcggcagacccttcaccacctacgacgccgaccacgacagcagcaacagcaactgcgccgtgatcgtgcacggcgcctggtggtacgccagctgctacagaagcaacctgaacggcagatacgccgtgagcgaggccgccgcccacaagtacggcatcgactgggccagcggcagaggcgtgggccacccctacagaagagtgagaatgatgctgagatag

SEQ ID NO: 81728 - DNA, 300 bp, Artificial Sequence
  Description of Artificial Sequence: Synthetic coding sequence
atggacaccgagggcggcggctggctggtgttccagagaagacaggacggcagcgtggacttcttcagaagctggagcagctacagagccggcttcggcaaccaggagagcgagttctggctgggcaacgagaacctgcaccagctgaccctgcagggcaactgggagctgagagtggagctggaggacttcaacggcaacagaaccttcgcccactacgccaccttcagactgctgggcgaggtggaccactaccagctggccctgggcaagttcagcgagggcaccgccggcgagtag

SEQ ID NO: 81729 - DNA, 2094 bp, Artificial Sequence
  Description of Artificial Sequence: Synthetic coding sequence
atggccgagaccagccccgagcccagcggccagctggtggtgcacagcgacgcccacagcgacaccgtgctggccagcttcgaggaccagagaaagaagggcttcctgtgcgacatcaccctgatcgtggagaacgtgcacttcagagcccacaaggccctgctggccgccagcagcgagtacttcagcatgatgttcgccgaggagggcgagatcggccagagcatctacatgctggagggcatggtggccgacaccttcggcatcctgctggagttcatctacaccggctacctgcacgccagcgagaagagcaccgagcagatcctggccaccgcccagttcctgaaggtgtacgacctggtgaaggcctacaccgacttccagaacaaccacagcagccccaagcccaccaccctgaacaccgccggcgcccccgtggtggtgatcagcaacaagaagaacgacccccccaagagaaagagaggcagacccaagaaggtgaacaccctgcaggaggagaagagcgagctggccgccgaggaggagatccagctgagagtgaacaacagcgtgcagaacagacagaacttcgtggtgaagggcgacagcggcgtgctgaacgagcagatcgccgccaaggagaaggaggagagcgagcccacctgcgagcccagcagagaggaggagatgcccgtggagaaggacgagaactacgaccccaagaccgaggacggccaggccagccagagcagatacagcaagagaagaatctggagaagcgtgaagctgaaggactacaagctggtgggcgaccaggaggaccacggcagcgccaagagaatctgcggcagaagaaagagacccggcggccccgaggccagatgcaaggactgcggcaaggtgttcaagtacaaccacttcctggccatccaccagagaagccacaccggcgagagacccttcaagtgcaacgagtgcggcaagggcttcgcccagaagcacagcctgcaggtgcacaccagaatgcacaccggcgagagaccctacacctgcaccgtgtgcagcaaggccctgaccaccaagcacagcctgctggagcacatgagcctgcacagcggccagaagagcttcacctgcgaccagtgcggcaagtacttcagccagaacagacagctgaagagccactacagagtgcacaccggccacagcctgcccgagtgcaaggactgccacagaaagttcatggacgtgagccagctgaagaagcacctgagaacccacaccggcgagaagcccttcacctgcgagatctgcggcaagagcttcaccgccaagagcagcctgcagacccacatcagaatccacagaggcgagaagccctacagctgcggcatctgcggcaagagcttcagcgacagcagcgccaagagaagacactgcatcctgcacaccggcaagaagcccttcagctgccccgagtgcaacctgcagttcgccagactggacaacctgaaggcccacctgaagatccacagcaaggagaagcacgccagcgacgccagcagcatcagcggcagcagcaacaccgaggaggtgagaaacatcctgcagctgcagccctaccagctgagcaccagcggcgagcaggagatccagctgctggtgaccgacagcgtgcacaacatcaacttcatgcccggccccagccagggcatcagcatcgtgaccgccgagagcagccagaacatgaccgccgaccaggccgccaacctgaccctgctgacccagcagcccgagcagctgcagaacctgatcctgagcgcccagcaggagcagaccgagcacatccagagcctgaacatgatcgagagccagatgggccccagccagaccgagcccgtgcacgtgatcaccctgagcaaggagaccctggagcacctgcacgcccaccaggagcagaccgaggagctgcacctggccaccagcaccagcgaccccgcccagcacctgcagctgacccaggagcccggcccccccccccccacccaccacgtgccccagcccacccccctgggccaggagcagagctag

SEQ ID NO: 81730 - DNA, 420 bp, Artificial Sequence
  Description of Artificial Sequence: Synthetic coding sequence
atgggccagaagggcagcagcggcctgttcagagccgtgagcgccttcggcgtggtgggcttcgtgagattcctggagggctactacatcgtgctgatcaccaagagaagaaagatggccgacatcggcggccacgccatctacaaggtggaggacaccaacatgatctacatccccaacgacagcgtgagagtgacccaccccgacgaggccagatacctgagaatcttccagaacgtggacctgagcagcaacttctacttcagctacagctacgacctgagccacagcctgcagtacaacctgaccgtgctgagaatgcccctggagatgctgaagagcgagatgacccagaacagacaggagagcttcgacatcttcgaggacgagggcctgatcacccagggcggcagcggctag

SEQ ID NO: 81731 - DNA, 411 bp, Artificial Sequence
  Description of Artificial Sequence: Synthetic coding sequence
tgactgttcgaggagctgtacgaggaccacggcgacaccctgagcctgcagtacggcggcagccagctggtgcacagagtgaagacctacagaaagatcgccccctggacccagcacagcaaggacatcatgcagaccctgagcagatactacagcaacgccttcagcgacgccgacagacaggacagcatcaacctgttcctgggcgtgttccaccccaccgagggcaagccccacctgtgggagctgcccaccgacttctacctgcaccacaagaacaccatgagactgctgcccaccagaagaagctacacctactggtggacccccgaggtgatcaagcacctgcccctgccctacgacgagggcttcctggccagaagccccgccaacctggagtgcagcaactag

SEQ ID NO: 81732 - DNA, 300 bp, Artificial Sequence
  Description of Artificial Sequence: Synthetic coding sequence
atgaccagcagcgccagagacttcatgcccaagaccgtgggcatcgaccccagccccttcaccgtgagaaagcccgacgagaccggcaagagcgtgctgggcaacaagagcaacagagaggaggccgtgctgcagagaaagaccgccgccagcgccccccccccccccagcgaggaggccgtgagcagcagcagcgaggacgacagcggcaccgacagagaggaggagggcagcgtgagccagagaagcacccccgtgaagatgaccgacgccggcgacagcgccaaggtgaccgagtag

SEQ ID NO: 81733 - DNA, 1806 bp, Artificial Sequence
  Description of Artificial Sequence: Synthetic coding sequence
atgaccggctacctgagaatcttccagaacgtggacctgagcagcaacttctacttcagctacagctacgacctgagccacagcctgcagtacaacctgaccgtgctgagaatgcccctggagatgctgaagagcgagatgacccagaacagacaggagagcttcgacatcttcgaggacgagggcctgatcacccagggcggcagcgtggaccaggccgaccccttcgcccacgtggccgccctgcacttcgaccagatgttccagagattcggcagccccatcatcatcctgaacctggtgaaggagagagagaagagaaagcacgagagaatcctgagcgaggagctggtggccgccgtgacctacctgaaccagttcctgccccccgagcacaccatcgtgtacatcccctgggacatggccaagtacaccaagagcaagctgtgcaacgtgctggacagactgaacgtgatcgccgagagcgtggtgaagaagaccggcttcttcgtgaacagacccgacagctactgcagcatcctgagacccgacgagaagtggaacgagctgggcggctgcgtgatccccaccggcagactgcagaccggcatcctgagaaccaactgcgtggactgcctggacagaaccaacaccgcccagttcatggtgggcaagtgcgccctggcctaccagctgtacagcctgggcctgatcgacaagcccaacctgcagttcgacaccgacgccgtgagactgttcgaggagctgtacgaggaccacggcgacaccctgagcctgcagtacggcggcagccagctggtgcacagagtgaagacctacagaaagatcgccccctggacccagcacagcaaggacatcatgcagaccctgagcagatactacagcaacgccttcagcgacgccgacagacaggacagcatcaacctgttcctgggcgtgttccaccccaccgagggcaagccccacctgtgggagctgcccaccgacttctacctgcaccacaagaacaccatgagactgctgcccaccagaagaagctacacctactggtggacccccgaggtgatcaagcacctgcccctgccctacgacgaggtgatctgcgccgtgaacctgaagaagctgatcgtgaagaagttccacaagtacgaggaggagatcgacatccacaacgagttcttcagaccctacgagctgagcagcttcgacgacaccttctgcctggccatgaccagcagcgccagagacttcatgcccaagaccgtgggcatcgaccccagccccttcaccgtgagaaagcccgacgagaccggcaagagcgtgctgggcaacaagagcaacagagaggaggccgtgctgcagagaaagaccgccgccagcgccccccccccccccagcgaggaggccgtgagcagcagcagcgaggacgacagcggcaccgacagagaggaggagggcagcgtgagccagagaagcacccccgtgaagatgaccgacgccggcgacagcgccaaggtgaccgagaacgtggtgcagcccatgaaggagctgtacggcatcaacctgagcgacggcctgagcgaggaggacttcagcatctacagcagaacccccatcagcgccttcagccaggacaacatctacgaggtgcagccccccagagtggacagaaagagcaccgagatcttccaggcccacatccaggccagccagggcatcatgcagcccctgggcaaggaggacagcagcatgtacagagagtacatcagaaacagatacctgtag

SEQ ID NO: 81734 - DNA, 714 bp, Artificial Sequence
  Description of Artificial Sequence: Synthetic coding sequence
atgagatacttcctggtgggcagcaacaacgccgagaccaagtacagagtgctgaagatcgacagaaccgagcccaaggacctggtgatcatcgacgacagacacgtgtacacccagcaggaggtgagagagctgctgggcagactggacctgggcaacagaaccaagatgggccagaagggcagcagcggcctgttcagagccgtgagcgccttcggcgtggtgggcttcgtgagattcctggagggctactacatcgtgctgatcaccaagagaagaaagatggccgacatcggcggccacgccatctacaaggtggaggacaccaacatgatctacatccccaacgacagcgtgagagtgacccaccccgacgaggccagatacctgagaatcttccagaacgtggacctgagcagcaacttctacttcagctacagctacgacctgagccacagcctgcagtacaacctgaccgtgctgagaatgcccctggagatgctgaagagcgagatgacccagaacagacaggagagcttcgacatcttcgaggacgagggcctgatcacccagggcggcagcggcgtgttcggcatctgcagcgagccctacatgaagtacgtgtggaacggcgagctgctggacatcatcaagagcaccgtgcacagagactggctgctgtacatcatccacggcttctgcggccagagctag

SEQ ID NO: 81735 - DNA, 969 bp, Artificial Sequence
  Description of Artificial Sequence: Synthetic coding sequence
ctgtaccaggtgagcacccacgagcagagcgagagcgcccacggcagaaccggccccagcaccggcggcagacagagaagcagacacgagcaggccagagacagcagcagacacagcgccagccaggagggccaggacaccatcagaggccaccccggcagcagcagaggcggcagacagggcagccactacgagcagagcgtggacagcagcggccacagcggcagccaccacagccacaccaccagccaggagagaagcgacgtgagcagaggccagagcggcagcagaagcgtgagcagacagaccagaaacgagaagcagagcggcgacggcagcagacacagcggcagcagacaccacgaggccagcagcagagccgacagcagcagacacagccaggtgggccagggccagagcagcggccccagaaccagcagaaaccagggcagcagcgtgagccaggacagcgacagccagggccacagcgaggacagcgagagaagaagcggcagcgccagcagaaaccaccacggcagcgcccaggagcagagcagagacggcagcagacaccccagaagccaccacgaggacagagccggccacggccacagcgccgagagcagcagacagagcggcacccaccacgccgagaacagcagcggcggccaggccgccagcagccacgagcaggccagaagcagcgccggcgagagacacggcagccaccaccagcagagcgccgacagcagcagacacagcggcatcggccacggccaggccagcagcgccgtgagagacagcggccacagaggcagcagcggcagccaggccagcgacagcgagggccacagcgaggacagcgacacccagagcgtgagcgcccacggccaggccggcccccaccagcagagccaccaggagagcaccagaggcagaagcgccggcagaagcggcagaagcggctag

SEQ ID NO: 81736 - DNA, 969 bp, Artificial Sequence
  Description of Artificial Sequence: Synthetic coding sequence
ctgtaccaggtgagcacccacgagcagagcgagagcagccacggctggaccggccccagcaccagaggcagacagggcagcagacacgagcaggcccaggacagcagcagacacagcgccagccaggacggccaggacaccatcagaggccaccccggcagcagcagaggcggcagacagggctaccaccacgagcacagcgtggacagcagcggccacagcggcagccaccacagccacaccaccagccagggcagaagcgacgccagcagaggccagagcggcagcagaagcgccagcagaaccaccagaaacgaggagcagagcggcgacggcagcagacacagcggcagcagacaccacgaggccagcacccacgccgacatcagcagacacagccaggccgtgcagggccagagcgagggcagcagaagaagcagaagacagggcagcagcgtgagccaggacagcgacagcgagggccacagcgaggacagcgagagatggagcggcagcgccagcagaaaccacagaggcagcgtgcaggagcagagcagacacggcagcagacaccccagaagccaccacgaggacagagccggccacggccacagcgccgacagaagcagacagagcggcaccagacacgccgagaccagcagcggcggccaggccgccagcagccacgagcaggccagaagcagccccggcgagagacacggcagcagacaccagcagagcgccgacagcagcagacacagcggcatccccagaggccaggccagcagcgccgtgagagacagcagacactggggcagcagcggcagccaggccagcgacagcgagggccacagcgaggagagcgacacccagagcgtgagcggccacggccaggccggcccccaccagcagagccaccaggagagcgccagagacagaagcggcggcagaagcggcagaagcggctag

SEQ ID NO: 81737 - DNA, 12186 bp, Artificial Sequence
  Description of Artificial Sequence: Synthetic coding sequence
atgagcaccctgctggagaacatcttcgccatcatcaacctgttcaagcagtacagcaagaaggacaagaacaccgacaccctgagcaagaaggagctgaaggagctgctggagaaggagttcagacagatcctgaagaaccccgacgaccccgacatggtggacgtgttcatggaccacctggacatcgaccacaacaagaagatcgacttcaccgagttcctgctgatggtgttcaagctggcccaggcctactacgagagcaccagaaaggagaacctgcccatcagcggccacaagcacagaaagcacagccaccacgacaagcacgaggacaacaagcaggaggagaacaaggagaacagaaagagacccagcagcctggagagaagaaacaacagaaagggcaacaagggcagaagcaagagccccagagagaccggcggcaagagacacgagagcagcagcgagaagaaggagagaaagggctacagccccacccacagagaggaggagtacggcaagaaccaccacaacagcagcaagaaggagaagaacaagaccgagaacaccagactgggcgacaacagaaagagactgagcgagagactggaggagaaggaggacaacgaggagggcgtgtacgactacgagaacaccggcagaatgacccagaagtggatccagagcggccacatcgccacctactacaccatccaggacgaggcctacgacaccaccgacagcctgctggaggagaacaagatctacgagagaagcagaagcagcgacggcaagagcagcagccaggtgaacagaagcagacacgagaacaccagccaggtgcccctgcaggagagcagaaccagaaagagaagaggcagcagagtgagccaggacagagacagcgagggccacagcgaggacagcgagagacacagcggcagcgccagcagaaaccaccacggcagcgcctgggagcagagcagagacggcagcagacaccccagaagccacgacgaggacagagccagccacggccacagcgccgacagcagcagacagagcggcaccagacacgccgagaccagcagcagaggccagaccgccagcagccacgagcaggccagaagcagccccggcgagagacacggcagcggccaccagcagagcgccgacagcagcagacacagcgccaccggcagaggccaggccagcagcgccgtgagcgacagaggccacagaggcagcagcggcagccaggccagcgacagcgagggccacagcgagaacagcgacacccagagcgtgagcggccacggcaaggccggcctgagacagcagagccaccaggagagcaccagaggcagaagcggcgagagaagcggcagaagcggcagcagcctgtaccaggtgagcacccacgagcagcccgacagcgcccacggcagaaccggcaccagcaccggcggcagacagggcagccaccacgagcaggccagagacagcagcagacacagcgccagccaggagggccaggacaccatcagaggccaccccggcagcagcagaggcggcagacagggcagccaccacgagcagagcgtgaacagaagcggccacagcggcagccaccacagccacaccaccagccagggcagaagcgacgccagccacggccagagcggcagcagaagcgccagcagacagaccagaaacgaggagcagagcggcgacggcaccagacacagcggcagcagacaccacgaggccagcagccaggccgacagcagcagacacagccaggtgggccagggccagagcagcggccccagaaccagcagaaaccagggcagcagcgtgagccaggacagcgacagccagggccacagcgaggacagcgagagatggagcggcagcgccagcagaaaccaccacggcagcgcccaggagcagagcagagacggcagcagacaccccagaagccaccacgaggacagagccggccacggccacagcgccgacagcagcagaaagagcggcaccagacacacccagaacagcagcagcggccaggccgccagcagccacgagcaggccagaagcagcgccggcgagagacacggcagcagacaccagctgcagagcgccgacagcagcagacacagcggcaccggccacggccaggccagcagcgccgtgagagacagcggccacagaggcagcagcggcagccaggccaccgacagcgagggccacagcgaggacagcgacacccagagcgtgagcggccacggccaggccggccaccaccagcagagccaccaggagagcgccagagacagaagcggcgagagaagcagaagaagcggcagcttcctgtaccaggtgagcacccacaagcagagcgagagcagccacggctggaccggccccagcaccggcgtgagacagggcagccaccacgagcaggccagagacaacagcagacacagcgccagccaggacggccaggacaccatcagaggccaccccggcagcagcagaagaggcagacagggcagccaccacgagcagagcgtggacagaagcggccacagcggcagccaccacagccacaccaccagccagggcagaagcgacgccagcagaggccagagcggcagcagaagcgccagcagaaccaccagaaacgaggagcagagcagagacggcagcagacacagcggcagcagacaccacgaggccagcagccacgccgacatcagcagacacagccaggccggccagggccagagcgagggcagcagaaccagcagaagacagggcagcagcgtgagccaggacagcgacagcgagggccacagcgaggacagcgagagatggagcggcagcgccagcagaaaccacagaggcagcgcccaggagcagagcagacacggcagcagacaccccagaagccaccacgaggacagagccggccacggccacagcgccgacagcagcagacagagcggcaccccccacgccgagaccagcagcggcggccaggccgccagcagccacgagcaggccagaagcagccccggcgagagacacggcagcagacaccagcagagcgccgacagcagcagacacagcggcatccccagaagacaggccagcagcgccgtgagagacagcggccactggggcagcagcggcagccaggccagcgacagcgagggccacagcgaggagagcgacacccagagcgtgagcggccacggccaggacggcccccaccagcagagccaccaggagagcgccagagactggagcggcggcagaagcggcagaagcggcagcttcatctaccaggtgagcacccacgagcagagcgagagcgcccacggcagaaccagaaccagcaccggcagaagacagggcagccaccacgagcaggccagagacagcagcagacacagcgccagccaggagggccaggacaccatcagagcccaccccggcagcagaagaggcggcagacagggcagccaccacgagcagagcgtggacagaagcggccacagcggcagccaccacagccacaccaccagccagggcagaagcgacgccagccacggccagagcggcagcagaagcgccagcagacagaccagaaaggacaagcagagcggcgacggcagcagacacagcggcagcagacaccacgaggccgccagctgggccgacagcagcagacacagccaggtgggccaggagcagagcagcggcagcagaaccagcagacaccagggcagcagcgtgagccaggacagcgacagcgagagacacagcgacgacagcgagagactgagcggcagcgccagcagaaaccaccacggcagcagcagagagcagagcagagacggcagcagacaccccggcttccaccaggaggacagagccagccacggccacagcgccgacagcagcagacagagcggcacccaccacaccgagagcagcagccacggccaggccgtgagcagccacgagcaggccagaagcagccccggcgagagacacggcagcagacaccagcagagcgccgacagcagcagacacagcggcatcggccacagacaggccagcagcgccgtgagagacagcggccacagaggcagcagcggcagccaggtgaccaacagcgagggccacagcgaggacagcgacacccagagcgtgagcgcccacggccaggccggcccccaccagcagagccacaaggagagcgccagaggccagagcggcgagagcagcggcagaagcagaagcttcctgtaccaggtgagcagccacgagcagagcgagagcacccacggccagaccgcccccagcaccggcggcagacagggcagcagacacgagcaggccagaaacagcagcagacacagcgccagccaggacggccaggacaccatcagaggccaccccggcagcagcagaggcggcagacagggcagctaccacgagcagagcgtggacagaagcggccacagcggctaccaccacagccacaccaccccccagggcagaagcgacgccagccacggccagagcggccccagaagcgccagcagacagaccagaaacgaggagcagagcggcgacggcagcagacacagcggcagcagacaccacgagcccagcaccagagccggcagcagcagacacagccaggtgggccagggcgagagcgccggcagcaagaccagcagaagacagggcagcagcgtgagccaggacagagacagcgagggccacagcgaggacagcgagagaagaagcgagagcgccagcagaaaccactacggcagcgccagagagcagagcagacacggcagcagaaaccccagaagccaccaggaggacagagccagccacggccacagcgccgagagcagcagacagagcggcaccagacacgccgagaccagcagcggcggccaggccgccagcagccaggagcaggccagaagcagccccggcgagagacacggcagcagacaccagcagagcgccgacagcagcaccgacagcggcaccggcagaagacaggacagcagcgtggtgggcgacagcggcaacagaggcagcagcggcagccaggccagcgacagcgagggccacagcgaggagagcgacacccagagcgtgagcgcccacggccaggccggcccccaccagcagagccaccaggagagcaccagaggccagagcggcgagagaagcggcagaagcggcagcttcctgtaccaggtgagcacccacgagcagagcgagagcgcccacggcagaaccggccccagcaccggcggcagacagagaagcagacacgagcaggccagagacagcagcagacacagcgccagccaggagggccaggacaccatcagaggccaccccggcagcagcagaggcggcagacagggcagccactacgagcagagcgtggacagcagcggccacagcggcagccaccacagccacaccaccagccaggagagaagcgacgtgagcagaggccagagcggcagcagaagcgtgagcagacagaccagaaacgagaagcagagcggcgacggcagcagacacagcggcagcagacaccacgaggccagcagcagagccgacagcagcagacacagccaggtgggccagggccagagcagcggccccagaaccagcagaaaccagggcagcagcgtgagccaggacagcgacagccagggccacagcgaggacagcgagagatggagcggcagcgccagcagaaaccacctgggcagcgcctgggagcagagcagagacggcagcagacaccccggcagccaccacgaggacagagccggccacggccacagcgccgacagcagcagacagagcggcaccagacacaccgagagcagcagcagaggccaggccgccagcagccacgagcaggccagaagcagcgccggcgagagacacggcagccaccaccagctgcagagcgccgacagcagcagacacagcggcatcggccacggccaggccagcagcgccgtgagagacagcggccacagaggctacagcggcagccaggccagcgacagcgagggccacagcgaggacagcgacacccagagcgtgagcgcccagggcaaggccggcccccaccagcagagccacaaggagagcgccagaggccagagcggcgagagcagcggcagaagcggcagcttcctgtaccaggtgagcacccacgagcagagcgagagcacccacggccagagcgcccccagcaccggcggcagacagggcagccactacgaccaggcccaggacagcagcagacacagcgccagccaggagggccaggacaccatcagaggccaccccggccccagcagaggcggcagacagggcagccaccaggagcagagcgtggacagaagcggccacagcggcagccaccacagccacaccaccagccagggcagaagcgacgccagcagaggccagagcggcagcagaagcgccagcagaaagacctacgacaaggagcagagcggcgacggcagcagacacagcggcagccaccaccacgaggccagcagctgggccgacagcagcagacacagcctggtgggccagggccagagcagcggccccagaaccagcagacccagaggcagcagcgtgagccaggacagcgacagcgagggccacagcgaggacagcgagagaagaagcggcagcgccagcagaaaccaccacggcagcgcccaggagcagagcagagacggcagcagacaccccagaagccaccacgaggacagagccggccacggccacagcgccgagagcagcagacagagcggcacccaccacgccgagaacagcagcggcggccaggccgccagcagccacgagcaggccagaagcagcgccggcgagagacacggcagccaccaccagcagagcgccgacagcagcagacacagcggcatcggccacggccaggccagcagcgccgtgagagacagcggccacagaggcagcagcggcagccaggccagcgacagcgagggccacagcgaggacagcgacacccagagcgtgagcgcccacggccaggccggcccccaccagcagagccaccaggagagcaccagaggcagaagcgccggcagaagcggcagaagcggcagcttcctgtaccaggtgagcacccacgagcagagcgagagcgcccacggcagaaccggcaccagcaccggcggcagacagggcagccaccacaagcaggccagagacagcagcagacacagcaccagccaggagggccaggacaccatccacggccaccccggcagcagcagcggcggcagacagggcagccactacgagcagctggtggacagaagcggccacagcggcagccaccacagccacaccaccagccagggcagaagcgacgccagccacggccacagcggcagcagaagcgccagcagacagaccagaaacgacgagcagagcggcgacggcagcagacacagcggcagcagacaccacgaggccagcagcagagccgacagcagcggccacagccaggtgggccagggccagagcgagggccccagaaccagcagaaactggggcagcagcttcagccaggacagcgacagccagggccacagcgaggacagcgagagatggagcggcagcgccagcagaaaccaccacggcagcgcccaggagcagctgagagacggcagcagacaccccagaagccaccaggaggacagagccggccacggccacagcgccgacagcagcagacagagcggcaccagacacacccagaccagcagcggcggccaggccgccagcagccacgagcaggccagaagcagcgccggcgagagacacggcagccaccaccagcagagcgccgacagcagcagacacagcggcatcggccacggccaggccagcagcgccgtgagagacagcggccacagaggctacagcggcagccaggccagcgacaacgagggccacagcgaggacagcgacacccagagcgtgagcgcccacggccaggccggcagccaccagcagagccaccaggagagcgccagaggcagaagcggcgagaccagcggccacagcggcagcttcctgtaccaggtgagcacccacgagcagagcgagagcagccacggctggaccggccccagcaccagaggcagacagggcagcagacacgagcaggcccaggacagcagcagacacagcgccagccaggacggccaggacaccatcagaggccaccccggcagcagcagaggcggcagacagggctaccaccacgagcacagcgtggacagcagcggccacagcggcagccaccacagccacaccaccagccagggcagaagcgacgccagcagaggccagagcggcagcagaagcgccagcagaaccaccagaaacgaggagcagagcggcgacggcagcagacacagcggcagcagacaccacgaggccagcacccacgccgacatcagcagacacagccaggccgtgcagggccagagcgagggcagcagaagaagcagaagacagggcagcagcgtgagccaggacagcgacagcgagggccacagcgaggacagcgagagatggagcggcagcgccagcagaaaccaccacggcagcgcccaggagcagctgagagacggcagcagacaccccagaagccaccaggaggacagagccggccacggccacagcgccgacagcagcagacagagcggcaccagacacacccagaccagcagcggcggccaggccgccagcagccacgagcaggccagaagcagcgccggcgagagacacggcagccaccaccagcagagcgccgacagcagcagacacagcggcatcggccacggccaggccagcagcgccgtgagagacagcggccacagaggctacagcggcagccaggccagcgacaacgagggccacagcgaggacagcgacacccagagcgtgagcgcccacggccaggccggcagccaccagcagagccaccaggagagcgccagaggcagaagcggcgagaccagcggccacagcggcagcttcctgtaccaggtgagcacccacgagcagagcgagagcagccacggctggaccggccccagcaccagaggcagacagggcagcagacacgagcaggcccaggacagcagcagacacagcgccagccagtacggccaggacaccatcagaggccaccccggcagcagcagaggcggcagacagggctaccaccacgagcacagcgtggacagcagcggccacagcggcagccaccacagccacaccaccagccagggcagaagcgacgccagcagaggccagagcggcagcagaagcgccagcagaaccaccagaaacgaggagcagagcggcgacagcagcagacacagcgtgagcagacaccacgaggccagcacccacgccgacatcagcagacacagccaggccgtgcagggccagagcgagggcagcagaagaagcagaagacagggcagcagcgtgagccaggacagcgacagcgagggccacagcgaggacagcgagagatggagcggcagcgccagcagaaaccacagaggcagcgtgcaggagcagagcagacacggcagcagacaccccagaagccaccacgaggacagagccggccacggccacagcgccgacagaagcagacagagcggcaccagacacgccgagaccagcagcggcggccaggccgccagcagccacgagcaggccagaagcagccccggcgagagacacggcagcagacaccagcagagcgccgacagcagcagacacagcggcatccccagaggccaggccagcagcgccgtgagagacagcagacactggggcagcagcggcagccaggccagcgacagcgagggccacagcgaggagagcgacacccagagcgtgagcggccacggccaggccggcccccaccagcagagccaccaggagagcgccagagacagaagcggcggcagaagcggcagaagcggcagcttcctgtaccaggtgagcacccacgagcagagcgagagcgcccacggcagaaccagaaccagcaccggcagaagacagggcagccaccacgagcaggccagagacagcagcagacacagcgccagccaggagggccaggacaccatcagaggccaccccggcagcagcagaagaggcagacagggcagccactacgagcagagcgtggacagaagcggccacagcggcagccaccacagccacaccaccagccagggcagaagcgacgccagcagaggccagagcggcagcagaagcgccagcagacagaccagaaacgacgagcagagcggcgacggcagcagacacagctggagccaccaccacgaggccagcacccaggccgacagcagcagacacagccagagcggccagggccagagcgccggccccagaaccagcagaaaccagggcagcagcgtgagccaggacagcgacagccagggccacagcgaggacagcgagagatggagcggcagcgccagcagaaaccacagaggcagcgcccaggagcagagcagagacggcagcagacaccccaccagccaccacgaggacagagccggccacggccacagcgccgagagcagcagacagagcggcacccaccacgccgagaacagcagcggcggccaggccgccagcagccacgagcaggccagaagcagcgccggcgagagacacggcagccaccaccagcagagcgccgacagcagcagacacagcggcatcggccacggccaggccagcagcgccgtgagagacagcggccacagaggcagcagcggcagccaggccagcgacagcgagggccacagcgaggacagcgacacccagagcgtgagcgcccacggccaggccggcccccaccagcagagccaccaggagagcaccagaggcagaagcgccggcagaagcggcagaagcggcagcttcctgtaccaggtgagcacccacgagcagagcgagagcgcccacggcagagccggccccagcaccggcggcagacagggcagcagacacgagcaggccagagacagcagcagacacagcgccagccaggagggccaggacaccatcagaggccaccccggcagcagaagaggcggcagacagggcagctaccacgagcagagcgtggacagaagcggccacagcggcagccaccacagccacaccaccagccagggcagaagcgacgccagccacggccagagcggcagcagaagcgccagcagagagaccagaaacgaggagcagagcggcgacggcagcagacacagcggcagcagacaccacgaggccagcacccaggccgacagcagcagacacagccagagcggccagggcgagagcgccggcagcagaagaagcagaagacagggcagcagcgtgagccaggacagcgacagcgaggcctaccccgaggacagcgagagaagaagcgagagcgccagcagaaaccaccacggcagcagcagagagcagagcagagacggcagcagacaccccggcagcagccacagagacaccgccagccacgtgcagagcagccccgtgcagagcgacagcagcaccgccaaggagcacggccacttcagcagcctgagccaggacagcgcctaccacagcggcatccagagcagaggcagcccccacagcagcagcagctaccactaccagagcgagggcaccgagagacagaagggccagagcggcctggtgtggagacacggcagctacggcagcgccgactacgactacggcgagagcggcttcagacacagccagcacggcagcgtgagctacaacagcaaccccgtggtgttcaaggagagaagcgacatctgcaaggccagcgccttcggcaaggaccaccccagatactacgccacctacatcaacaaggaccccggcctgtgcggccacagcagcgacatcagcaagcagctgggcttcagccagagccagagatactactactacgagtag

SEQ ID NO: 81738 - DNA, 969 bp, Artificial Sequence
  Description of Artificial Sequence: Synthetic coding sequence
ctgtaccaggtgagcacccacgagcagcccgacagcgcccacggcagaaccggcaccagcaccggcggcagacagggcagccaccacgagcaggccagagacagcagcagacacagcgccagccaggagggccaggacaccatcagaggccaccccggcagcagcagaggcggcagacagggcagccaccacgagcagagcgtgaacagaagcggccacagcggcagccaccacagccacaccaccagccagggcagaagcgacgccagccacggccagagcggcagcagaagcgccagcagacagaccagaaacgaggagcagagcggcgacggcaccagacacagcggcagcagacaccacgaggccagcagccaggccgacagcagcagacacagccaggccggccagggccagagcgagggcagcagaaccagcagaagacagggcagcagcgtgagccaggacagcgacagcgagggccacagcgaggacagcgagagatggagcggcagcgccagcagaaaccacagaggcagcgcccaggagcagagcagacacggcagcagacaccccagaagccaccacgaggacagagccggccacggccacagcgccgacagcagcagacagagcggcaccccccacgccgagaccagcagcggcggccaggccgccagcagccacgagcaggccagaagcagccccggcgagagacacggcagcagacaccagcagagcgccgacagcagcagacacagcggcatccccagaagacaggccagcagcgccgtgagagacagcggccactggggcagcagcggcagccaggccagcgacagcgagggccacagcgaggagagcgacacccagagcgtgagcggccacggccaggacggcccccaccagcagagccaccaggagagcgccagagactggagcggcggcagaagcggcagaagcggctag

SEQ ID NO: 81739 - DNA, 3402 bp, Artificial Sequence
  Description of Artificial Sequence: Synthetic coding sequence
atgagaagcagaggcagcgacaccgagggcagcgcccagaagaagttccccagacacaccaagggccacagcttccagggccccaagaacatgaagcacagacagcaggacaaggacagccccagcgagagcgacgtgatcctgccctgccccaaggccgagaagccccacagcggcaacggccaccaggccgaggacctgagcagagacgacctgctgttcctgctgagcatcctggagggcgagctgcaggccagagacgaggtgatcggcatcctgaaggccgagaagatggacctggccctgctggaggcccagtacggcttcgtgacccccaagaaggtgctggaggccctgcagagagacgccttccaggccaagagcaccccctggcaggaggacatctacgagaagcccatgaacgagctggacaaggtggtggagaagcacaaggagagctacagaagaatcctgggccagctgctggtggccgagaagagcagaagacagaccatcctggagctggaggaggagaagagaaagcacaaggagtacatggagaagagcgacgagttcatctgcctgctggagcaggagtgcgagagactgaagaagctgatcgaccaggagatcaagagccaggaggagaaggagcaggagaaggagaagagagtgaccaccctgaaggaggagctgaccaagctgaagagcttcgccctgatggtggtggacgagcagcagagactgaccgcccagctgaccctgcagagacagaagatccaggagctgaccaccaacgccaaggagacccacaccaagctggccctggccgaggccagagtgcaggaggaggagcagaaggccaccagactggagaaggagctgcagacccagaccaccaagttccaccaggaccaggacaccatcatggccaagctgaccaacgaggacagccagaacagacagctgcagcagaagctggccgccctgagcagacagatcgacgagctggaggagaccaacagaagcctgagaaaggccgaggaggagctgcaggacatcaaggagaagatcagcaagggcgagtacggcaacgccggcatcatggccgaggtggaggagctgagaaagagagtgctggacatggagggcaaggacgaggagctgatcaagatggaggagcagtgcagagacctgaacaagagactggagagagagaccctgcagagcaaggacttcaagctggaggtggagaagctgagcaagagaatcatggccctggagaagctggaggacgccttcaacaagagcaagcaggagtgctacagcctgaagtgcaacctggagaaggagagaatgaccaccaagcagctgagccaggagctggagagcctgaaggtgagaatcaaggagctggaggccatcgagagcagactggagaagaccgagttcaccctgaaggaggacctgaccaagctgaagaccctgaccgtgatgttcgtggacgagagaaagaccatgagcgagaagctgaagaagaccgaggacaagctgcaggccgccagcagccagctgcaggtggagcagaacaaggtgaccaccgtgaccgagaagctgatcgaggagaccaagagagccctgaagagcaagaccgacgtggaggagaagatgtacagcgtgaccaaggagagagacgacctgaagaacaagctgaaggccgaggaggagaagggcaacgacctgctgagcagagtgaacatgctgaagaacagactgcagagcctggaggccatcgagaaggacttcctgaagaacaagctgaaccaggacagcggcaagagcaccaccgccctgcaccaggagaacaacaagatcaaggagctgagccaggaggtggagagactgaagctgaagctgaaggacatgaaggccatcgaggacgacctgatgaagaccgaggacgagtacgagaccctggagagaagatacgccaacgagagagacaaggcccagttcctgagcaaggagctggagcacgtgaagatggagctggccaagtacaagctggccgagaagaccgagaccagccacgagcagtggctgttcaagagactgcaggaggaggaggccaagagcggccacctgagcagagaggtggacgccctgaaggagaagatccacgagtacatggccaccgaggacctgatctgccacctgcagggcgaccacagcgtgctgcagaagaagctgaaccagcaggagaacagaaacagagacctgggcagagagatcgagaacctgaccaaggagctggagagatacagacacttcagcaagagcctgagacccagcctgaacggcagaagaatcagcgacccccaggtgttcagcaaggaggtgcagaccgaggccgtggacaacgagccccccgactacaagagcctgatccccctggagagagccgtgatcaacggccagctgtacgaggagagcgagaaccaggacgaggaccccaacgacgagggcagcgtgctgagcttcaagtgcagccagagcaccccctgccccgtgaacagaaagctgtggatcccctggatgaagagcaaggagggccacctgcagaacggcaagatgcagaccaagcccaacgccaacttcgtgcagcccggcgacctggtgctgagccacacccccggccagcccctgcacatcaaggtgacccccgaccacgtgcagaacaccgccaccctggagatcaccagccccaccaccgagagcccccacagctacaccagcaccgccgtgatccccaactgcggcacccccaagcagagaatcaccatcctgcagaacgccagcatcacccccgtgaagagcaagaccagcaccgaggacctgatgaacctggagcagggcatgagccccatcaccatggccaccttcgccagagcccagacccccgagagctgcggcagcctgacccccgagagaaccatgagccccatccaggtgctggccgtgaccggcagcgccagcagccccgagcagggcagaagccccgagcccaccgagatcagcgccaagcacgccatcttcagagtgagccccgacagacagagcagctggcagttccagagaagcaacagcaacagcagcagcgtgatcaccaccgaggacaacaagatccacatccacctgggcagcccctacatgcaggccgtggccagccccgtgagacccgccagccccagcgcccccctgcaggacaacagaacccagggcctgatcaacggcgccctgaacaagaccaccaacaaggtgaccagcagcatcaccatcacccccaccgccacccccctgcccagacagagccagatcaccgtgagcaacatctacaactag

SEQ ID NO: 81740 - DNA, 3408 bp, Artificial Sequence
  Description of Artificial Sequence: Synthetic coding sequence
atgagaagcagaggcagcgacaccgagggcagcgcccagaagaagttccccagacacaccaagggccacagcttccagggccccaagaacatgaagcacagacagcaggacaaggacagccccagcgagagcgacgtgatcctgccctgccccaaggccgagaagccccacagcggcaacggccaccaggccgaggacctgagcagagacgacctgctgttcctgctgagcatcctggagggcgagctgcaggccagagacgaggtgatcggcatcctgaaggccgagaagatggacctggccctgctggaggcccagtacggcttcgtgacccccaagaaggtgctggaggccctgcagagagacgccttccaggccaagagcaccccctggcaggaggacatctacgagaagcccatgaacgagctggacaaggtggtggagaagcacaaggagagctacagaagaatcctgggccagctgctggtggccgagaagagcagaagacagaccatcctggagctggaggaggagaagagaaagcacaaggagtacatggagaagagcgacgagttcatctgcctgctggagcaggagtgcgagagactgaagaagctgatcgaccaggagatcaagagccaggaggagaaggagcaggagaaggagaagagagtgaccaccctgaaggaggagctgaccaagctgaagagcttcgccctgatggtggtggacgagcagcagagactgaccgcccagctgaccctgcagagacagaagatccaggagctgaccaccaacgccaaggagacccacaccaagctggccctggccgaggccagagtgcaggaggaggagcagaaggccaccagactggagaaggagctgcagacccagaccaccaagttccaccaggaccaggacaccatcatggccaagctgaccaacgaggacagccagaacagacagctgcagcagaagctggccgccctgagcagacagatcgacgagctggaggagaccaacagaagcctgagaaaggccgaggaggagctgcaggacatcaaggagaagatcagcaagggcgagtacggcaacgccggcatcatggccgaggtggaggagctgagaaagagagtgctggacatggagggcaaggacgaggagctgatcaagatggaggagcagtgcagagacctgaacaagagactggagagagagaccctgcagagcaaggacttcaagctggaggtggagaagctgagcaagagaatcatggccctggagaagctggaggacgccttcaacaagagcaagcaggagtgctacagcctgaagtgcaacctggagaaggagagaatgaccaccaagcagctgagccaggagctggagagcctgaaggtgagaatcaaggagctggaggccatcgagagcagactggagaagaccgagttcaccctgaaggaggacctgaccaagctgaagaccctgaccgtgatgttcgtggacgagagaaagaccatgagcgagaagctgaagaagaccgaggacaagctgcaggccgccagcagccagctgcaggtggagcagaacaaggtgaccaccgtgaccgagaagctgatcgaggagaccaagagagccctgaagagcaagaccgacgtggaggagaagatgtacagcgtgaccaaggagagagacgacctgaagaacaagctgaaggccgaggaggagaagggcaacgacctgctgagcagagtgaacatgctgaagaacagactgcagagcctggaggccatcgagaaggacttcctgaagaacaagctgaaccaggacagcggcaagagcaccaccgccctgcaccaggagaacaacaagatcaaggagctgagccaggaggtggagagactgaagctgaagctgaaggacatgaaggccatcgaggacgacctgatgaagaccgaggacgagtacgagaccctggagagaagatacgccaacgagagagacaaggcccagttcctgagcaaggagctggagcacgtgaagatggagctggccaagtacaagctggccgagaagaccgagaccagccacgagcagtggctgttcaagagactgcaggaggaggaggccaagagcggccacctgagcagagaggtggacgccctgaaggagaagatccacgagtacatggccaccgaggacctgatctgccacctgcagggcgaccacagcgtgctgcagaagaagctgaaccagcaggagaacagaaacagagacctgggcagagagatcgagaacctgaccaaggagctggagagatacagacacttcagcaagagcctgagacccagcctgaacggcagaagaatcagcgacccccaggtgttcagcaaggaggtgcagaccgaggccgtggacaacgagccccccgactacaagagcctgatccccctggagagagccgtgatcaacggccagctgtacgaggagagcgagaaccaggacgaggaccccaacgacgagggcagcgtgctgagcttcaagtgcagccagagcaccccctgccccgtgaacagaaagctgtggatcccctggatgaagagcaaggagggccacctgcagaacggcaagatgcagaccaagcccaacgccaacttcgtgcagcccggcgacctggtgctgagccacacccccggccagcccctgcacatcaaggtgacccccgaccacgtgcagaacaccgccaccctggagatcaccagccccaccaccgagagcccccacagctacaccagcaccgccgtgatccccaactgcggcacccccaagcagagaatcaccatcctgcagaacgccagcatcacccccgtgaagagcaagaccagcaccgaggacctgatgaacctggagcagggcatgagccccatcaccatggccaccttcgccagagcccagacccccgagagctgcggcagcctgacccccgagagaaccatgagccccatccaggtgctggccgtgaccggcagcgccagcagccccgagcagggcagaagccccgagcccaccgagatcagcgccaagcacgccatcttcagagtgagccccgacagacagagcagctggcagttccagagaagcaacagcaacagcagcagcgtgatcaccaccgaggacaacaagatccacatccacctgggcagcccctacatgcaggccgtggccagccccgtgagacccgccagccccagcgcccccctgcaggacaacagaacccagggcctgatcaacggcgccctgaacaagaccaccaacaaggtgaccagcagcatcaccatcacccccaccgccacccccctgcccagacagagccagatcaccgtggagcccctgctgctgccccactag

SEQ ID NO: 81741 - DNA, 2682 bp, Artificial Sequence
  Description of Artificial Sequence: Synthetic coding sequence
atggtggtggacgagcagcagagactgaccgcccagctgaccctgcagagacagaagatccaggagctgaccaccaacgccaaggagacccacaccaagctggccctggccgaggccagagtgcaggaggaggagcagaaggccaccagactggagaaggagctgcagacccagaccaccaagttccaccaggaccaggacaccatcatggccaagctgaccaacgaggacagccagaacagacagctgcagcagaagctggccgccctgagcagacagatcgacgagctggaggagaccaacagaagcctgagaaaggccgaggaggagctgcaggacatcaaggagaagatcagcaagggcgagtacggcaacgccggcatcatggccgaggtggaggagctgagaaagagagtgctggacatggagggcaaggacgaggagctgatcaagatggaggagcagtgcagagacctgaacaagagactggagagagagaccctgcagagcaaggacttcaagctggaggtggagaagctgagcaagagaatcatggccctggagaagctggaggacgccttcaacaagagcaagcaggagtgctacagcctgaagtgcaacctggagaaggagagaatgaccaccaagcagctgagccaggagctggagagcctgaaggtgagaatcaaggagctggaggccatcgagagcagactggagaagaccgagttcaccctgaaggaggacctgaccaagctgaagaccctgaccgtgatgttcgtggacgagagaaagaccatgagcgagaagctgaagaagaccgaggacaagctgcaggccgccagcagccagctgcaggtggagcagaacaaggtgaccaccgtgaccgagaagctgatcgaggagaccaagagagccctgaagagcaagaccgacgtggaggagaagatgtacagcgtgaccaaggagagagacgacctgaagaacaagctgaaggccgaggaggagaagggcaacgacctgctgagcagagtgaacatgctgaagaacagactgcagagcctggaggccatcgagaaggacttcctgaagaacaagctgaaccaggacagcggcaagagcaccaccgccctgcaccaggagaacaacaagatcaaggagctgagccaggaggtggagagactgaagctgaagctgaaggacatgaaggccatcgaggacgacctgatgaagaccgaggacgagtacgagaccctggagagaagatacgccaacgagagagacaaggcccagttcctgagcaaggagctggagcacgtgaagatggagctggccaagtacaagctggccgagaagaccgagaccagccacgagcagtggctgttcaagagactgcaggaggaggaggccaagagcggccacctgagcagagaggtggacgccctgaaggagaagatccacgagtacatggccaccgaggacctgatctgccacctgcagggcgaccacagcgtgctgcagaagaagctgaaccagcaggagaacagaaacagagacctgggcagagagatcgagaacctgaccaaggagctggagagatacagacacttcagcaagagcctgagacccagcctgaacggcagaagaatcagcgacccccaggtgttcagcaaggaggtgcagaccgaggccgtggacaacgagccccccgactacaagagcctgatccccctggagagagccgtgatcaacggccagctgtacgaggagagcgagaaccaggacgaggaccccaacgacgagggcagcgtgctgagcttcaagtgcagccagagcaccccctgccccgtgaacagaaagctgtggatcccctggatgaagagcaaggagggccacctgcagaacggcaagatgcagaccaagcccaacgccaacttcgtgcagcccggcgacctggtgctgagccacacccccggccagcccctgcacatcaaggtgacccccgaccacgtgcagaacaccgccaccctggagatcaccagccccaccaccgagagcccccacagctacaccagcaccgccgtgatccccaactgcggcacccccaagcagagaatcaccatcctgcagaacgccagcatcacccccgtgaagagcaagaccagcaccgaggacctgatgaacctggagcagggcatgagccccatcaccatggccaccttcgccagagcccagacccccgagagctgcggcagcctgacccccgagagaaccatgagccccatccaggtgctggccgtgaccggcagcgccagcagccccgagcagggcagaagccccgagcccaccgagatcagcgccaagcacgccatcttcagagtgagccccgacagacagagcagctggcagttccagagaagcaacagcaacagcagcagcgtgatcaccaccgaggacaacaagatccacatccacctgggcagcccctacatgcaggccgtggccagccccgtgagacccgccagccccagcgcccccctgcaggacaacagaacccagggcctgatcaacggcgccctgaacaagaccaccaacaaggtgaccagcagcatcaccatcacccccaccgccacccccctgcccagacagagccagatcaccgtgagcaacatctacaactag

SEQ ID NO: 81742 - DNA, 768 bp, Artificial Sequence
  Description of Artificial Sequence: Synthetic coding sequence
atgagaagcagaggcagcgacaccgagggcagcgcccagaagaagttccccagacacaccaagggccacagcttccagggccccaagaacatgaagcacagacagcaggacaaggacagccccagcgagagcgacgtgatcctgccctgccccaaggccgagaagccccacagcggcaacggccaccaggccgaggacctgagcagagacgacctgctgttcctgctgagcatcctggagggcgagctgcaggccagagacgaggtgatcggcatcctgaaggccgagaagatggacctggccctgctggaggcccagtacggcttcgtgacccccaagaaggtgctggaggccctgcagagagacgccttccaggccaagagcaccccctggcaggaggacatctacgagaagcccatgaacgagctggacaaggtggtggagaagcacaaggagagctacagaagaatcctgggccagctgctggtggccgagaagagcagaagacagaccatcctggagctggaggaggagaagagaaagcacaaggagtacatggagaagagcgacgagttcatctgcctgctggagcaggagtgcgagagatggagcctggccctgctgcccagactggagtgcaacggcatgatcctggcccactgcaacctgtgcctgctgggcagcagcgacagccccgccagcgccttccaggtggccggcatcaccggcaccagacaccacgcccagctggtgttcgtgttcctgtag

SEQ ID NO: 81743 - DNA, 2640 bp, Artificial Sequence
  Description of Artificial Sequence: Synthetic coding sequence
atggtggtggacgagcagcagagactgaccgcccagctgaccctgcagagacagaagatccaggagctgaccaccaacgccaaggagacccacaccaagctggccctggccgaggccagagtgcaggaggaggagcagaaggccaccagactggagaaggagctgcagacccagaccaccaagttccaccaggaccaggacaccatcatggccaagctgaccaacgaggacagccagaacagacagctgcagcagaagctggccgccctgagcagacagatcgacgagctggaggagaccaacagaagcctgagaaaggccgaggaggagctgcaggacatcaaggagaagatcagcaagggcgagtacggcaacgccggcatcatggccgaggtggaggagctgatcaagatggaggagcagtgcagagacctgaacaagagactggagagagagaccctgcagagcaaggacttcaagctggaggtggagaagctgagcaagagaatcatggccctggagaagctggaggacgccttcaacaagagcaagcaggagtgctacagcctgaagtgcaacctggagaaggagagaatgaccaccaagcagctgagccaggagctggagagcctgaaggtgagaatcaaggagctggaggccatcgagagcagactggagaagaccgagttcaccctgaaggaggacctgaccaagctgaagaccctgaccgtgatgttcgtggacgagagaaagaccatgagcgagaagctgaagaagaccgaggacaagctgcaggccgccagcagccagctgcaggtggagcagaacaaggtgaccaccgtgaccgagaagctgatcgaggagaccaagagagccctgaagagcaagaccgacgtggaggagaagatgtacagcgtgaccaaggagagagacgacctgaagaacaagctgaaggccgaggaggagaagggcaacgacctgctgagcagagtgaacatgctgaagaacagactgcagagcctggaggccatcgagaaggacttcctgaagaacaagctgaaccaggacagcggcaagagcaccaccgccctgcaccaggagaacaacaagatcaaggagctgagccaggaggtggagagactgaagctgaagctgaaggacatgaaggccatcgaggacgacctgatgaagaccgaggacgagtacgagaccctggagagaagatacgccaacgagagagacaaggcccagttcctgagcaaggagctggagcacgtgaagatggagctggccaagtacaagctggccgagaagaccgagaccagccacgagcagtggctgttcaagagactgcaggaggaggaggccaagagcggccacctgagcagagaggtggacgccctgaaggagaagatccacgagtacatggccaccgaggacctgatctgccacctgcagggcgaccacagcgtgctgcagaagaagctgaaccagcaggagaacagaaacagagacctgggcagagagatcgagaacctgaccaaggagctggagagatacagacacttcagcaagagcctgagacccagcctgaacggcagaagaatcagcgacccccaggtgttcagcaaggaggtgcagaccgaggccgtggacaacgagccccccgactacaagagcctgatccccctggagagagccgtgatcaacggccagctgtacgaggagagcgagaaccaggacgaggaccccaacgacgagggcagcgtgctgagcttcaagtgcagccagagcaccccctgccccgtgaacagaaagctgtggatcccctggatgaagagcaaggagggccacctgcagaacggcaagatgcagaccaagcccaacgccaacttcgtgcagcccggcgacctggtgctgagccacacccccggccagcccctgcacatcaaggtgacccccgaccacgtgcagaacaccgccaccctggagatcaccagccccaccaccgagagcccccacagctacaccagcaccgccgtgatccccaactgcggcacccccaagcagagaatcaccatcctgcagaacgccagcatcacccccgtgaagagcaagaccagcaccgaggacctgatgaacctggagcagggcatgagccccatcaccatggccaccttcgccagagcccagacccccgagagctgcggcagcctgacccccgagagaaccatgagccccatccaggtgctggccgtgaccggcagcgccagcagccccgagcagggcagaagccccgagcccaccgagatcagcgccaagcacgccatcttcagagtgagccccgacagacagagcagctggcagttccagagaagcaacagcaacagcagcagcgtgatcaccaccgaggacaacaagatccacatccacctgggcagcccctacatgcaggccgtggccagccccgtgagacccgccagccccagcgcccccctgcaggacaacagaacccagggcctgatcaacggcgccctgaacaagaccaccaacaaggtgaccagcagcatcaccatcacccccaccgccacccccctgcccagacagagccagatcaccgtgagcaacatctacaactag

SEQ ID NO: 81744 - DNA, 2688 bp, Artificial Sequence
  Description of Artificial Sequence: Synthetic coding sequence
atggtggtggacgagcagcagagactgaccgcccagctgaccctgcagagacagaagatccaggagctgaccaccaacgccaaggagacccacaccaagctggccctggccgaggccagagtgcaggaggaggagcagaaggccaccagactggagaaggagctgcagacccagaccaccaagttccaccaggaccaggacaccatcatggccaagctgaccaacgaggacagccagaacagacagctgcagcagaagctggccgccctgagcagacagatcgacgagctggaggagaccaacagaagcctgagaaaggccgaggaggagctgcaggacatcaaggagaagatcagcaagggcgagtacggcaacgccggcatcatggccgaggtggaggagctgagaaagagagtgctggacatggagggcaaggacgaggagctgatcaagatggaggagcagtgcagagacctgaacaagagactggagagagagaccctgcagagcaaggacttcaagctggaggtggagaagctgagcaagagaatcatggccctggagaagctggaggacgccttcaacaagagcaagcaggagtgctacagcctgaagtgcaacctggagaaggagagaatgaccaccaagcagctgagccaggagctggagagcctgaaggtgagaatcaaggagctggaggccatcgagagcagactggagaagaccgagttcaccctgaaggaggacctgaccaagctgaagaccctgaccgtgatgttcgtggacgagagaaagaccatgagcgagaagctgaagaagaccgaggacaagctgcaggccgccagcagccagctgcaggtggagcagaacaaggtgaccaccgtgaccgagaagctgatcgaggagaccaagagagccctgaagagcaagaccgacgtggaggagaagatgtacagcgtgaccaaggagagagacgacctgaagaacaagctgaaggccgaggaggagaagggcaacgacctgctgagcagagtgaacatgctgaagaacagactgcagagcctggaggccatcgagaaggacttcctgaagaacaagctgaaccaggacagcggcaagagcaccaccgccctgcaccaggagaacaacaagatcaaggagctgagccaggaggtggagagactgaagctgaagctgaaggacatgaaggccatcgaggacgacctgatgaagaccgaggacgagtacgagaccctggagagaagatacgccaacgagagagacaaggcccagttcctgagcaaggagctggagcacgtgaagatggagctggccaagtacaagctggccgagaagaccgagaccagccacgagcagtggctgttcaagagactgcaggaggaggaggccaagagcggccacctgagcagagaggtggacgccctgaaggagaagatccacgagtacatggccaccgaggacctgatctgccacctgcagggcgaccacagcgtgctgcagaagaagctgaaccagcaggagaacagaaacagagacctgggcagagagatcgagaacctgaccaaggagctggagagatacagacacttcagcaagagcctgagacccagcctgaacggcagaagaatcagcgacccccaggtgttcagcaaggaggtgcagaccgaggccgtggacaacgagccccccgactacaagagcctgatccccctggagagagccgtgatcaacggccagctgtacgaggagagcgagaaccaggacgaggaccccaacgacgagggcagcgtgctgagcttcaagtgcagccagagcaccccctgccccgtgaacagaaagctgtggatcccctggatgaagagcaaggagggccacctgcagaacggcaagatgcagaccaagcccaacgccaacttcgtgcagcccggcgacctggtgctgagccacacccccggccagcccctgcacatcaaggtgacccccgaccacgtgcagaacaccgccaccctggagatcaccagccccaccaccgagagcccccacagctacaccagcaccgccgtgatccccaactgcggcacccccaagcagagaatcaccatcctgcagaacgccagcatcacccccgtgaagagcaagaccagcaccgaggacctgatgaacctggagcagggcatgagccccatcaccatggccaccttcgccagagcccagacccccgagagctgcggcagcctgacccccgagagaaccatgagccccatccaggtgctggccgtgaccggcagcgccagcagccccgagcagggcagaagccccgagcccaccgagatcagcgccaagcacgccatcttcagagtgagccccgacagacagagcagctggcagttccagagaagcaacagcaacagcagcagcgtgatcaccaccgaggacaacaagatccacatccacctgggcagcccctacatgcaggccgtggccagccccgtgagacccgccagccccagcgcccccctgcaggacaacagaacccagggcctgatcaacggcgccctgaacaagaccaccaacaaggtgaccagcagcatcaccatcacccccaccgccacccccctgcccagacagagccagatcaccgtggagcccctgctgctgccccactag

SEQ ID NO: 81745 - DNA, 2136 bp, Artificial Sequence
  Description of Artificial Sequence: Synthetic coding sequence
atggccctggagaagctggaggacgccttcaacaagagcaagcaggagtgctacagcctgaagtgcaacctggagaaggagagaatgaccaccaagcagctgagccaggagctggagagcctgaaggtgagaatcaaggagctggaggccatcgagagcagactggagaagaccgagttcaccctgaaggaggacctgaccaagctgaagaccctgaccgtgatgttcgtggacgagagaaagaccatgagcgagaagctgaagaagaccgaggacaagctgcaggccgccagcagccagctgcaggtggagcagaacaaggtgaccaccgtgaccgagaagctgatcgaggagaccaagagagccctgaagagcaagaccgacgtggaggagaagatgtacagcgtgaccaaggagagagacgacctgaagaacaagctgaaggccgaggaggagaagggcaacgacctgctgagcagagtgaacatgctgaagaacagactgcagagcctggaggccatcgagaaggacttcctgaagaacaagctgaaccaggacagcggcaagagcaccaccgccctgcaccaggagaacaacaagatcaaggagctgagccaggaggtggagagactgaagctgaagctgaaggacatgaaggccatcgaggacgacctgatgaagaccgaggacgagtacgagaccctggagagaagatacgccaacgagagagacaaggcccagttcctgagcaaggagctggagcacgtgaagatggagctggccaagtacaagctggccgagaagaccgagaccagccacgagcagtggctgttcaagagactgcaggaggaggaggccaagagcggccacctgagcagagaggtggacgccctgaaggagaagatccacgagtacatggccaccgaggacctgatctgccacctgcagggcgaccacagcgtgctgcagaagaagctgaaccagcaggagaacagaaacagagacctgggcagagagatcgagaacctgaccaaggagctggagagatacagacacttcagcaagagcctgagacccagcctgaacggcagaagaatcagcgacccccaggtgttcagcaaggaggtgcagaccgaggccgtggacaacgagccccccgactacaagagcctgatccccctggagagagccgtgatcaacggccagctgtacgaggagagcgagaaccaggacgaggaccccaacgacgagggcagcgtgctgagcttcaagtgcagccagagcaccccctgccccgtgaacagaaagctgtggatcccctggatgaagagcaaggagggccacctgcagaacggcaagatgcagaccaagcccaacgccaacttcgtgcagcccggcgacctggtgctgagccacacccccggccagcccctgcacatcaaggtgacccccgaccacgtgcagaacaccgccaccctggagatcaccagccccaccaccgagagcccccacagctacaccagcaccgccgtgatccccaactgcggcacccccaagcagagaatcaccatcctgcagaacgccagcatcacccccgtgaagagcaagaccagcaccgaggacctgatgaacctggagcagggcatgagccccatcaccatggccaccttcgccagagcccagacccccgagagctgcggcagcctgacccccgagagaaccatgagccccatccaggtgctggccgtgaccggcagcgccagcagccccgagcagggcagaagccccgagcccaccgagatcagcgccaagcacgccatcttcagagtgagccccgacagacagagcagctggcagttccagagaagcaacagcaacagcagcagcgtgatcaccaccgaggacaacaagatccacatccacctgggcagcccctacatgcaggccgtggccagccccgtgagacccgccagccccagcgcccccctgcaggacaacagaacccagggcctgatcaacggcgccctgaacaagaccaccaacaaggtgaccagcagcatcaccatcacccccaccgccacccccctgcccagacagagccagatcaccgtggagcccctgctgctgccccactag

SEQ ID NO: 81746 - DNA, 2514 bp, Artificial Sequence
  Description of Artificial Sequence: Synthetic coding sequence
atggtggtggacgagcagcagagactgaccgcccagctgaccctgcagagacagaagatccaggagctgaccaccaacgccaaggagacccacaccaagctggccctggccgaggccagagtgcaggaggaggagcagaaggccaccagactggagaaggagctgcagacccagaccaccaagttccaccaggaccaggacaccatcatggccaagctgaccaacgaggacagccagaacagacagctgcagcagaagctggccgccctgagcagacagatcgacgagctggaggagaccaacagaagcctgagaaaggccgaggaggagctgcaggacatcaaggagaagatcagcaagggcgagtacggcaacgccggcatcatggccgaggtggaggagctgagaaagagagtgctggacatggagggcaaggacgaggagctgatcaagatggaggagcagtgcagagacctgaacaagagactggagagagagaccctgcagagcaaggacttcaagctggaggtggagaagctgagcaagagaatcatggccctggagaagctggaggacgccttcaacaagagcaagcaggagtgctacagcctgaagtgcaacctggagaaggagagaatgaccaccaagcagctgagccaggagctggagagcctgaaggtgagaatcaaggagctggaggccatcgagagcagactggagaagaccgagttcaccctgaaggaggacctgaccaagctgaagaccctgaccgtgatgttcgtggacgagagaaagaccatgagcgagaagctgaagaagaccgaggacaagctgcaggccgccagcagccagctgcaggtggagcagaacaaggtgaccaccgtgaccgagaagctgatcgaggagaccaagagagccctgaagagcaagaccgacgtggaggagaagatgtacagcgtgaccaaggagagagacgacctgaagaacaagctgaaggccgaggaggagaagggcaacgacctgctgagcagagtgaacatgctgaagaacagactgcagagcctggaggccatcgagaaggacttcctgaagaacaagctgaaccaggacagcggcaagagcaccaccgccctgcaccaggagaacaacaagatcaaggagctgagccaggaggtggagagactgaagctgaagctgaaggacatgaaggccatcgaggacgacctgatgaagaccgaggacgagtacgagaccctggagagaagatacgccaacgagagagacaaggcccagttcctgagcaaggagctggagcacgtgaagatggagctggccaagtacaagctggccgagaagaccgagaccagccacgagcagtggctgttcaagagactgcaggaggaggaggccaagagcggccacctgagcagagaggtggacgccctgaaggagaagatccacgagtacatggccaccgaggacctgatctgccacctgcagggcgaccacagcgtgctgcagaagaagctgaaccagcaggagaacagaaacagagacctgggcagagagatcgagaacctgaccaaggagctggagagatacagacacttcagcaagagcctgagacccagcctgaacggcagaagaatcagcgacccccaggtgttcagcaaggaggtgcagaccgaggccgtggacaacgagccccccgactacaagagcctgatccccctggagagagccgtgatcaacggccagctgtacgaggagagcgagaaccaggacgaggaccccaacgacgagggcagcgtgctgagcttcaagtgcagccagagcaccccctgccccgtgaacagaaagctgtggatcccctggatgaagagcaaggagggccacctgcagaacggcaagatgcagaccaagcccaacgccaacttcgtgcagcccggcgacctggtgctgagccacacccccggccagcccctgcacatcaaggtgacccccgaccacgtgcagaacaccgccaccctggagatcaccagccccaccaccgagagcccccacagctacaccagcaccgccgtgatccccaactgcggcacccccaagcagagaatcaccatcctgcagaacgccagcatcacccccgtgaagagcaagaccagcaccgaggacctgatgaacctggagcagggcatgagccccatcaccatggccaccttcgccagagcccagacccccgagagctgcggcagcctgacccccgagagaaccatgagccccatccaggtgctggccgtgaccggcagcgccagcagccccgagcagggcagaagccccgagcccaccgagatcagcgccaagcacgccatcttcagagtgagccccgacagacagagcagctggcagttccagagaagcaacagcaacagcagcagcgtgatcaccaccgaggacaacaagatccacatccacctgggcagcccctacatgcaggccgtggccagcccctag

SEQ ID NO: 81747 - DNA, 7944 bp, Artificial Sequence
  Description of Artificial Sequence: Synthetic coding sequence
atgagcagcagccacagcagagccggccagagcgccgccggcgccgcccccggcggcggcgtggacaccagagacgccgagatgcccgccaccgagaaggacctggccgaggacgccccctggaagaagatccagcagaacaccttcaccagatggtgcaacgagcacctgaagtgcgtgagcaagagaatcgccaacctgcagaccgacctgagcgacggcctgagactgatcgccctgctggaggtgctgagccagaagaagatgcacagaaagcacaaccagagacccaccttcagacagatgcagctggagaacgtgagcgtggccctggagttcctggacagagagagcatcaagctggtgagcatcgacagcaaggccatcgtggacggcaacctgaagctgatcctgggcctgatctggaccctgatcctgcactacagcatcagcatgcccatgtgggacgaggaggaggacgaggaggccaagaagcagacccccaagcagagactgctgggctggatccagaacaagctgccccagctgcccatcaccaacttcagcagagactggcagagcggcagagccctgggcgccctggtggacagctgcgcccccggcctgtgccccgactgggacagctgggacgccagcaagcccgtgaccaacgccagagaggccatgcagcaggccgacgactggctgggcatcccccaggtgatcacccccgaggagatcgtggaccccaacgtggacgagcacagcgtgatgacctacctgagccagttccccaaggccaagctgaagcccggcgcccccctgagacccaagctgaaccccaagaaggccagagcctacggccccggcatcgagcccaccggcaacatggtgaagaagagagccgagttcaccgtggagaccagaagcgccggccagggcgaggtgctggtgtacgtggaggaccccgccggccaccaggaggaggccaaggtgaccgccaacaacgacaagaacagaaccttcagcgtgtggtacgtgcccgaggtgaccggcacccacaaggtgaccgtgctgttcgccggccagcacatcgccaagagccccttcgaggtgtacgtggacaagagccagggcgacgccagcaaggtgaccgcccagggccccggcctggagcccagcggcaacatcgccaacaagaccacctacttcgagatcttcaccgccggcgccggcaccggcgaggtggaggtggtgatccaggaccccatgggccagaagggcaccgtggagccccagctggaggccagaggcgacagcacctacagatgcagctaccagcccaccatggagggcgtgcacaccgtgcacgtgaccttcgccggcgtgcccatccccagaagcccctacaccgtgaccgtgggccaggcctgcaaccccagcgcctgcagagccgtgggcagaggcctgcagcccaagggcgtgagagtgaaggagaccgccgacttcaaggtgtacaccaagggcgccggcagcggcgagctgaaggtgaccgtgaagggccccaagggcgaggagagagtgaagcagaaggacctgggcgacggcgtgtacggcttcgagtactaccccatggtgcccggcacctacatcgtgaccatcacctggggcggccagaacatcggcagaagccccttcgaggtgaaggtgggcaccgagtgcggcaaccagaaggtgagagcctggggccccggcctggagggcggcgtggtgggcaagagcgccgacttcgtggtggaggccatcggcgacgacgtgggcaccctgggcttcagcgtggagggccccagccaggccaagatcgagtgcgacgacaagggcgacggcagctgcgacgtgagatactggccccaggaggccggcgagtacgccgtgcacgtgctgtgcaacagcgaggacatcagactgagccccttcatggccgacatcagagacgccccccaggacttccaccccgacagagtgaaggccagaggccccggcctggagaagaccggcgtggccgtgaacaagcccgccgagttcaccgtggacgccaagcacggcggcaaggcccccctgagagtgcaggtgcaggacaacgagggctgccccgtggaggccctggtgaaggacaacggcaacggcacctacagctgcagctacgtgcccagaaagcccgtgaagcacaccgccatggtgagctggggcggcgtgagcatccccaacagccccttcagagtgaacgtgggcgccggcagccaccccaacaaggtgaaggtgtacggccccggcgtggccaagaccggcctgaaggcccacgagcccacctacttcaccgtggactgcgccgaggccggccagggcgacgtgagcatcggcatcaagtgcgcccccggcgtggtgggccccgccgaggccgacatcgacttcgacatcatcagaaacgacaacgacaccttcaccgtgaagtacacccccagaggcgccggcagctacaccatcatggtgctgttcgccgaccaggccacccccaccagccccatcagagtgaaggtggagcccagccacgacgccagcaaggtgaaggccgagggccccggcctgagcagaaccggcgtggagctgggcaagcccacccacttcaccgtgaacgccaaggccgccggcaagggcaagctggacgtgcagttcagcggcctgaccaagggcgacgccgtgagagacgtggacatcatcgaccaccacgacaacacctacaccgtgaagtacacccccgtgcagcagggccccgtgggcgtgaacgtgacctacggcggcgaccccatccccaagagccccttcagcgtggccgtgagccccagcctggacctgagcaagatcaaggtgagcggcctgggcgagaaggtggacgtgggcaaggaccaggagttcaccgtgaagagcaagggcgccggcggccagggcaaggtggccagcaagatcgtgggccccagcggcgccgccgtgccctgcaaggtggagcccggcctgggcgccgacaacagcgtggtgagattcctgcccagagaggagggcccctacgaggtggaggtgacctacgacggcgtgcccgtgcccggcagccccttccccctggaggccgtggcccccaccaagcccagcaaggtgaaggccttcggccccggcctgcagggcggcagcgccggcagccccgccagattcaccatcgacaccaagggcgccggcaccggcggcctgggcctgaccgtggagggcccctgcgaggcccagctggagtgcctggacaacggcgacggcacctgcagcgtgagctacgtgcccaccgagcccggcgactacaacatcaacatcctgttcgccgacacccacatccccggcagccccttcaaggcccacgtggtgccctgcttcgacgccagcaaggtgaagtgcagcggccccggcctggagagagccaccgccggcgaggtgggccagttccaggtggactgcagcagcgccggcagcgccgagctgaccatcgagatctgcagcgaggccggcctgcccgccgaggtgtacatccaggaccacggcgacggcacccacaccatcacctacatccccctgtgccccggcgcctacaccgtgaccatcaagtacggcggccagcccgtgcccaacttccccagcaagctgcaggtggagcccgccgtggacaccagcggcgtgcagtgctacggccccggcatcgagggccagggcgtgttcagagaggccaccaccgagttcagcgtggacgccagagccctgacccagaccggcggcccccacgtgaaggccagagtggccaaccccagcggcaacctgaccgagacctacgtgcaggacagaggcgacggcatgtacaaggtggagtacaccccctacgaggagggcctgcacagcgtggacgtgacctacgacggcagccccgtgcccagcagccccttccaggtgcccgtgaccgagggctgcgaccccagcagagtgagagtgcacggccccggcatccagagcggcaccaccaacaagcccaacaagttcaccgtggagaccagaggcgccggcaccggcggcctgggcctggccgtggagggccccagcgaggccaagatgagctgcatggacaacaaggacggcagctgcagcgtggagtacatcccctacgaggccggcacctacagcctgaacgtgacctacggcggccaccaggtgcccggcagccccttcaaggtgcccgtgcacgacgtgaccgacgccagcaaggtgaagtgcagcggccccggcctgagccccggcatggtgagagccaacctgccccagagcttccaggtggacaccagcaaggccggcgtggcccccctgcaggtgaaggtgcagggccccaagggcctggtggagcccgtggacgtggtggacaacgccgacggcacccagaccgtgaactacgtgcccagcagagagggcccctacagcatcagcgtgctgtacggcgacgaggaggtgcccagaagccccttcaaggtgaaggtgctgcccacccacgacgccagcaaggtgaaggccagcggccccggcctgaacaccaccggcgtgcccgccagcctgcccgtggagttcaccatcgacgccaaggacgccggcgagggcctgctggccgtgcagatcaccgaccccgagggcaagcccaagaagacccacatccaggacaaccacgacggcacctacaccgtggcctacgtgcccgacgtgaccggcagatacaccatcctgatcaagtacggcggcgacgagatccccttcagcccctacagagtgagagccgtgcccaccggcgacgccagcaagtgcaccgtgaccgtgagcatcggcggccacggcctgggcgccggcatcggccccaccatccagatcggcgaggagaccgtgatcaccgtggacaccaaggccgccggcaagggcaaggtgacctgcaccgtgtgcacccccgacggcagcgaggtggacgtggacgtggtggagaacgaggacggcaccttcgacatcttctacaccgccccccagcccggcaagtacgtgatctgcgtgagattcggcggcgagcacgtgcccaacagccccttccaggtgaccgccctggccggcgaccagcccagcgtgcagccccccctgagaagccagcagctggccccccagtacacctacgcccagggcggccagcagacctgggcccccgagagacccctggtgggcgtgaacggcctggacgtgaccagcctgagacccttcgacctggtgatccccttcaccatcaagaagggcgagatcaccggcgaggtgagaatgcccagcggcaaggtggcccagcccaccatcaccgacaacaaggacggcaccgtgaccgtgagatacgcccccagcgaggccggcctgcacgagatggacatcagatacgacaacatgcacatccccggcagccccctgcagttctacgtggactacgtgaactgcggccacgtgaccgcctacggccccggcctgacccacggcgtggtgaacaagcccgccaccttcaccgtgaacaccaaggacgccggcgagggcggcctgagcctggccatcgagggccccagcaaggccgagatcagctgcaccgacaaccaggacggcacctgcagcgtgagctacctgcccgtgctgcccggcgactacagcatcctggtgaagtacaacgagcagcacgtgcccggcagccccttcaccgccagagtgaccggcgacgacagcatgagaatgagccacctgaaggtgggcagcgccgccgacatccccatcaacatcagcgagaccgacctgagcctgctgaccgccaccgtggtgccccccagcggcagagaggagccctgcctgctgaagagactgagaaacggccacgtgggcatcagcttcgtgcccaaggagaccggcgagcacctggtgcacgtgaagaagaacggccagcacgtggccagcagccccatccccgtggtgatcagccagagcgagatcggcgacgccagcagagtgagagtgagcggccagggcctgcacgagggccacaccttcgagcccgccgagttcatcatcgacaccagagacgccggctacggcggcctgagcctgagcatcgagggccccagcaaggtggacatcaacaccgaggacctggaggacggcacctgcagagtgacctactgccccaccgagcccggcaactacatcatcaacatcaagttcgccgaccagcacgtgcccggcagccccttcagcgtgaaggtgaccggcgagggcagagtgaaggagagcatcaccagaagaagaagagcccccagcgtggccaacgtgggcagccactgcgacctgagcctgaagatccccgagatcagcatccaggacatgaccgcccaggtgaccagccccagcggcaagacccacgaggccgagatcgtggagggcgagaaccacacctactgcatcagattcgtgcccgccgagatgggcacccacaccgtgagcgtgaagtacaagggccagcacgtgcccggcagccccttccagttcaccgtgggccccctgggcgagggcggcgcccacaaggtgagagccggcggccccggcctggagagagccgaggccggcgtgcccgccgagttcagcatctggaccagagaggccggcgccggcggcctggccatcgccgtggagggccccagcaaggccgagatcagcttcgaggacagaaaggacggcagctgcggcgtggcctacgtggtgcaggagcccggcgactacgaggtgagcgtgaagttcaacgaggagcacatccccgacagccccttcgtggtgcccgtggccagccccagcggcgacgccagaagactgaccgtgagcagcctgcaggagagcggcctgaaggtgaaccagcccgccagcttcgccgtgagcctgaacggcgccaagggcgccatcgacgccaaggtgcacagccccagcggcgccctggaggagtgctacgtgaccgagatcgaccaggacaagtacgccgtgagattcatccccagagagaacggcgtgtacctgatcgacgtgaagttcaacggcacccacatccccggcagccccttcaagatcagagtgggcgagcccggccacggcggcgaccccggcctggtgagcgcctacggcgccggcctggagggcggcgtgaccggcaaccccgccgagttcgtggtgaacaccagcaacgccggcgccggcgccctgagcgtgaccatcgacggccccagcaaggtgaagatggactgccaggagtgccccgagggctacagagtgacctacacccccatggcccccggcagctacctgatcagcatcaagtacggcggcccctaccacatcggcggcagccccttcaaggccaaggtgaccggccccagactggtgagcaaccacagcctgcacgagaccagcagcgtgttcgtggacagcctgaccaaggccacctgcgccccccagcacggcgcccccggccccggccccgccgacgccagcaaggtggtggccaagggcctgggcctgagcaaggcctacgtgggccagaagagcagcttcaccgtggactgcagcaaggccggcaacaacatgctgctggtgggcgtgcacggccccagaaccccctgcgaggagatcctggtgaagcacgtgggcagcagactgtacagcgtgagctacctgctgaaggacaagggcgagtacaccctggtggtgaagtggggcgacgagcacatccccggcagcccctacagagtggtggtgccctag

SEQ ID NO: 81748 - DNA, 6948 bp, Artificial Sequence
  Description of Artificial Sequence: Synthetic coding sequence
atgcccgccaccgagaaggacctggccgaggacgccccctggaagaagatccagcagaacaccttcaccagatggtgcaacgagcacctgaagtgcgtgagcaagagaatcgccaacctgcagaccgacctgagcgacggcctgagactgatcgccctgctggaggtgctgagccagaagaagatgcacagaaagcacaaccagagacccaccttcagacagatgcagctggagaacgtgagcgtggccctggagttcctggacagagagagcatcaagctggtgagcatcgacagcaaggccatcgtggacggcaacctgaagctgatcctgggcctgatctggaccctgatcctgcactacagcatcagcatgcccatgtgggacgaggaggaggacgaggaggccaagaagcagacccccaagcagagactgctgggctggatccagaacaagctgccccagctgcccatcaccaacttcagcagagactggcagagcggcagagccctgggcgccctggtggacagctgcgcccccggcctgtgccccgactgggacagctgggacgccagcaagcccgtgaccaacgccagagaggccatgcagcaggccgacgactggctgggcatcccccaggtgatcacccccgaggagatcgtggaccccaacgtggacgagcacagcgtgatgacctacctgagccagttccccaaggccaagctgaagcccggcgcccccctgagacccaagctgaaccccaagaaggccagagcctacggccccggcatcgagcccaccggcaacatggtgaagaagagagccgagttcaccgtggagaccagaagcgccggccagggcgaggtgctggtgtacgtggaggaccccgccggccaccaggaggaggccaaggtgaccgccaacaacgacaagaacagaaccttcagcgtgtggtacgtgcccgaggtgaccggcacccacaaggtgaccgtgctgttcgccggccagcacatcgccaagagccccttcgaggtgtacgtggacaagagccagggcgacgccagcaaggtgaccgcccagggccccggcctggagcccagcggcaacatcgccaacaagaccacctacttcgagatcttcaccgccggcgccggcaccggcgaggtggaggtggtgatccaggaccccatgggccagaagggcaccgtggagccccagctggaggccagaggcgacagcacctacagatgcagctaccagcccaccatggagggcgtgcacaccgtgcacgtgaccttcgccggcgtgcccatccccagaagcccctacaccgtgaccgtgggccaggcctgcaaccccagcgcctgcagagccgtgggcagaggcctgcagcccaagggcgtgagagtgaaggagaccgccgacttcaaggtgtacaccaagggcgccggcagcggcgagctgaaggtgaccgtgaagggccccaagggcgaggagagagtgaagcagaaggacctgggcgacggcgtgtacggcttcgagtactaccccatggtgcccggcacctacatcgtgaccatcacctggggcggccagaacatcggcagaagccccttcgaggtgaaggtgggcaccgagtgcggcaaccagaaggtgagagcctggggccccggcctggagggcggcgtggtgggcaagagcgccgacttcgtggtggaggccatcggcgacgacgtgggcaccctgggcttcagcgtggagggccccagccaggccaagatcgagtgcgacgacaagggcgacggcagctgcgacgtgagatactggccccaggaggccggcgagtacgccgtgcacgtgctgtgcaacagcgaggacatcagactgagccccttcatggccgacatcagagacgccccccaggacttccaccccgacagagtgaaggccagaggccccggcctggagaagaccggcgtggccgtgaacaagcccgccgagttcaccgtggacgccaagcacggcggcaaggcccccctgagagtgcaggtgcaggacaacgagggctgccccgtggaggccctggtgaaggacaacggcaacggcacctacagctgcagctacgtgcccagaaagcccgtgaagcacaccgccatggtgagctggggcggcgtgagcatccccaacagccccttcagagtgaacgtgggcgccggcagccaccccaacaaggtgaaggtgtacggccccggcgtggccaagaccggcctgaaggcccacgagcccacctacttcaccgtggactgcgccgaggccggccagggcgacgtgagcatcggcatcaagtgcgcccccggcgtggtgggccccgccgaggccgacatcgacttcgacatcatcagaaacgacaacgacaccttcaccgtgaagtacacccccagaggcgccggcagctacaccatcatggtgctgttcgccgaccaggccacccccaccagccccatcagagtgaaggtggagcccagccacgacgccagcaaggtgaaggccgagggccccggcctgagcagaaccggcgtggagctgggcaagcccacccacttcaccgtgaacgccaaggccgccggcaagggcaagctggacgtgcagttcagcggcctgaccaagggcgacgccgtgagagacgtggacatcatcgaccaccacgacaacacctacaccgtgaagtacacccccgtgcagcagggccccgtgggcgtgaacgtgacctacggcggcgaccccatccccaagagccccttcagcgtggccgtgagccccagcctggacctgagcaagatcaaggtgagcggcctgggcgagaaggtggacgtgggcaaggaccaggagttcaccgtgaagagcaagggcgccggcggccagggcaaggtggccagcaagatcgtgggccccagcggcgccgccgtgccctgcaaggtggagcccggcctgggcgccgacaacagcgtggtgagattcctgcccagagaggagggcccctacgaggtggaggtgacctacgacggcgtgcccgtgcccggcagccccttccccctggaggccgtggcccccaccaagcccagcaaggtgaaggccttcggccccggcctgcagggcggcagcgccggcagccccgccagattcaccatcgacaccaagggcgccggcaccggcggcctgggcctgaccgtggagggcccctgcgaggcccagctggagtgcctggacaacggcgacggcacctgcagcgtgagctacgtgcccaccgagcccggcgactacaacatcaacatcctgttcgccgacacccacatccccggcagccccttcaaggcccacgtggtgccctgcttcgacgccagcaaggtgaagtgcagcggccccggcctggagagagccaccgccggcgaggtgggccagttccaggtggactgcagcagcgccggcagcgccgagctgaccatcgagatctgcagcgaggccggcctgcccgccgaggtgtacatccaggaccacggcgacggcacccacaccatcacctacatccccctgtgccccggcgcctacaccgtgaccatcaagtacggcggccagcccgtgcccaacttccccagcaagctgcaggtggagcccgccgtggacaccagcggcgtgcagtgctacggccccggcatcgagggccagggcgtgttcagagaggccaccaccgagttcagcgtggacgccagagccctgacccagaccggcggcccccacgtgaaggccagagtggccaaccccagcggcaacctgaccgagacctacgtgcaggacagaggcgacggcatgtacaaggtggagtacaccccctacgaggagggcctgcacagcgtggacgtgacctacgacggcagccccgtgcccagcagccccttccaggtgcccgtgaccgagggctgcgaccccagcagagtgagagtgcacggccccggcatccagagcggcaccaccaacaagcccaacaagttcaccgtggagaccagaggcgccggcaccggcggcctgggcctggccgtggagggccccagcgaggccaagatgagctgcatggacaacaaggacggcagctgcagcgtggagtacatcccctacgaggccggcacctacagcctgaacgtgacctacggcggccaccaggtgcccggcagccccttcaaggtgcccgtgcacgacgtgaccgacgccagcaaggtgaagtgcagcggccccggcctgagccccggcatggtgagagccaacctgccccagagcttccaggtggacaccagcaaggccggcgtggcccccctgcaggtgaaggtgcagggccccaagggcctggtggagcccgtggacgtggtggacaacgccgacggcacccagaccgtgaactacgtgcccagcagagagggcccctacagcatcagcgtgctgtacggcgacgaggaggtgcccagaagccccttcaaggtgaaggtgctgcccacccacgacgccagcaaggtgaaggccagcggccccggcctgaacaccaccggcgtgcccgccagcctgcccgtggagttcaccatcgacgccaaggacgccggcgagggcctgctggccgtgcagatcaccgaccccgagggcaagcccaagaagacccacatccaggacaaccacgacggcacctacaccgtggcctacgtgcccgacgtgaccggcagatacaccatcctgatcaagtacggcggcgacgagatccccttcagcccctacagagtgagagccgtgcccaccggcgacgccagcaagtgcaccgtgaccgtgagcatcggcggccacggcctgggcgccggcatcggccccaccatccagatcggcgaggagaccgtgatcaccgtggacaccaaggccgccggcaagggcaaggtgacctgcaccgtgtgcacccccgacggcagcgaggtggacgtggacgtggtggagaacgaggacggcaccttcgacatcttctacaccgccccccagcccggcaagtacgtgatctgcgtgagattcggcggcgagcacgtgcccaacagccccttccaggtgaccgccctggccggcgaccagcccagcgtgcagccccccctgagaagccagcagctggccccccagtacacctacgcccagggcggccagcagacctgggcccccgagagacccctggtgggcgtgaacggcctggacgtgaccagcctgagacccttcgacctggtgatccccttcaccatcaagaagggcgagatcaccggcgaggtgagaatgcccagcggcaaggtggcccagcccaccatcaccgacaacaaggacggcaccgtgaccgtgagatacgcccccagcgaggccggcctgcacgagatggacatcagatacgacaacatgcacatccccggcagccccctgcagttctacgtggactacgtgaactgcggccacgtgaccgcctacggccccggcctgacccacggcgtggtgaacaagcccgccaccttcaccgtgaacaccaaggacgccggcgagggcggcctgagcctggccatcgagggccccagcaaggccgagatcagctgcaccgacaaccaggacggcacctgcagcgtgagctacctgcccgtgctgcccggcgactacagcatcctggtgaagtacaacgagcagcacgtgcccggcagccccttcaccgccagagtgaccggcgacgacagcatgagaatgagccacctgaaggtgggcagcgccgccgacatccccatcaacatcagcgagatcagcttcgaggacagaaaggacggcagctgcggcgtggcctacgtggtgcaggagcccggcgactacgaggtgagcgtgaagttcaacgaggagcacatccccgacagccccttcgtggtgcccgtggccagccccagcggcgacgccagaagactgaccgtgagcagcctgcaggagagcggcctgaaggtgaaccagcccgccagcttcgccgtgagcctgaacggcgccaagggcgccatcgacgccaaggtgcacagccccagcggcgccctggaggagtgctacgtgaccgagatcgaccaggacaagtacgccgtgagattcatccccagagagaacggcgtgtacctgatcgacgtgaagttcaacggcacccacatccccggcagccccttcaagatcagagtgggcgagcccggccacggcggcgaccccggcctggtgagcgcctacggcgccggcctggagggcggcgtgaccggcaaccccgccgagttcgtggtgaacaccagcaacgccggcgccggcgccctgagcgtgaccatcgacggccccagcaaggtgaagatggactgccaggagtgccccgagggctacagagtgacctacacccccatggcccccggcagctacctgatcagcatcaagtacggcggcccctaccacatcggcggcagccccttcaaggccaaggtgaccggccccagactggtgagcaaccacagcctgcacgagaccagcagcgtgttcgtggacagcctgaccaaggccacctgcgccccccagcacggcgcccccggccccggccccgccgacgccagcaaggtggtggccaagggcctgggcctgagcaaggcctacgtgggccagaagagcagcttcaccgtggactgcagcaaggccggcaacaacatgctgctggtgggcgtgcacggccccagaaccccctgcgaggagatcctggtgaagcacgtgggcagcagactgtacagcgtgagctacctgctgaaggacaagggcgagtacaccctggtggtgaagtggggcgacgagcacatccccggcagcccctacagagtggtggtgccctag

SEQ ID NO: 81749 - DNA, 2343 bp, Artificial Sequence
  Description of Artificial Sequence: Synthetic coding sequence
atgcccagcggcaaggtggcccagcccaccatcaccgacaacaaggacggcaccgtgaccgtgagatacgcccccagcgaggccggcctgcacgagatggacatcagatacgacaacatgcacatccccggcagccccctgcagttctacgtggactacgtgaactgcggccacgtgaccgcctacggccccggcctgacccacggcgtggtgaacaagcccgccaccttcaccgtgaacaccaaggacgccggcgagggcgacgacagcatgagaatgagccacctgaaggtgggcagcgccgccgacatccccatcaacatcagcgagaccgacctgagcctgctgaccgccaccgtggtgccccccagcggcagagaggagccctgcctgctgaagagactgagaaacggccacgtgggcatcagcttcgtgcccaaggagaccggcgagcacctggtgcacgtgaagaagaacggccagcacgtggccagcagccccatccccgtggtgatcagccagagcgagatcggcgacgccagcagagtgagagtgagcggccagggcctgcacgagggccacaccttcgagcccgccgagttcatcatcgacaccagagacgccggctacggcggcctgagcctgagcatcgagggccccagcaaggtggacatcaacaccgaggacctggaggacggcacctgcagagtgacctactgccccaccgagcccggcaactacatcatcaacatcaagttcgccgaccagcacgtgcccggcagccccttcagcgtgaaggtgaccggcgagggcagagtgaaggagagcatcaccagaagaagaagagcccccagcgtggccaacgtgggcagccactgcgacctgagcctgaagatccccgagatcagcatccaggacatgaccgcccaggtgaccagccccagcggcaagacccacgaggccgagatcgtggagggcgagaaccacacctactgcatcagattcgtgcccgccgagatgggcacccacaccgtgagcgtgaagtacaagggccagcacgtgcccggcagccccttccagttcaccgtgggccccctgggcgagggcggcgcccacaaggtgagagccggcggccccggcctggagagagccgaggccggcgtgcccgccgagttcagcatctggaccagagaggccggcgccggcggcctggccatcgccgtggagggccccagcaaggccgagatcagcttcgaggacagaaaggacggcagctgcggcgtggcctacgtggtgcaggagcccggcgactacgaggtgagcgtgaagttcaacgaggagcacatccccgacagccccttcgtggtgcccgtggccagccccagcggcgacgccagaagactgaccgtgagcagcctgcaggagagcggcctgaaggtgaaccagcccgccagcttcgccgtgagcctgaacggcgccaagggcgccatcgacgccaaggtgcacagccccagcggcgccctggaggagtgctacgtgaccgagatcgaccaggacaagtacgccgtgagattcatccccagagagaacggcgtgtacctgatcgacgtgaagttcaacggcacccacatccccggcagccccttcaagatcagagtgggcgagcccggccacggcggcgaccccggcctggtgagcgcctacggcgccggcctggagggcggcgtgaccggcaaccccgccgagttcgtggtgaacaccagcaacgccggcgccggcgccctgagcgtgaccatcgacggccccagcaaggtgaagatggactgccaggagtgccccgagggctacagagtgacctacacccccatggcccccggcagctacctgatcagcatcaagtacggcggcccctaccacatcggcggcagccccttcaaggccaaggtgaccggccccagactggtgagcaaccacagcctgcacgagaccagcagcgtgttcgtggacagcctgaccaaggccacctgcgccccccagcacggcgcccccggccccggccccgccgacgccagcaaggtggtggccaagggcctgggcctgagcaaggcctacgtgggccagaagagcagcttcaccgtggactgcagcaaggccggcaacaacatgctgctggtgggcgtgcacggccccagaaccccctgcgaggagatcctggtgaagcacgtgggcagcagactgtacagcgtgagctacctgctgaaggacaagggcgagtacaccctggtggtgaagtggggcgacgagcacatccccggcagcccctacagagtggtggtgccctag

SEQ ID NO: 81750 - DNA, 7920 bp, Artificial Sequence
  Description of Artificial Sequence: Synthetic coding sequence
atgagcagcagccacagcagagccggccagagcgccgccggcgccgcccccggcggcggcgtggacaccagagacgccgagatgcccgccaccgagaaggacctggccgaggacgccccctggaagaagatccagcagaacaccttcaccagatggtgcaacgagcacctgaagtgcgtgagcaagagaatcgccaacctgcagaccgacctgagcgacggcctgagactgatcgccctgctggaggtgctgagccagaagaagatgcacagaaagcacaaccagagacccaccttcagacagatgcagctggagaacgtgagcgtggccctggagttcctggacagagagagcatcaagctggtgagcatcgacagcaaggccatcgtggacggcaacctgaagctgatcctgggcctgatctggaccctgatcctgcactacagcatcagcatgcccatgtgggacgaggaggaggacgaggaggccaagaagcagacccccaagcagagactgctgggctggatccagaacaagctgccccagctgcccatcaccaacttcagcagagactggcagagcggcagagccctgggcgccctggtggacagctgcgcccccggcctgtgccccgactgggacagctgggacgccagcaagcccgtgaccaacgccagagaggccatgcagcaggccgacgactggctgggcatcccccaggtgatcacccccgaggagatcgtggaccccaacgtggacgagcacagcgtgatgacctacctgagccagttccccaaggccaagctgaagcccggcgcccccctgagacccaagctgaaccccaagaaggccagagcctacggccccggcatcgagcccaccggcaacatggtgaagaagagagccgagttcaccgtggagaccagaagcgccggccagggcgaggtgctggtgtacgtggaggaccccgccggccaccaggaggaggccaaggtgaccgccaacaacgacaagaacagaaccttcagcgtgtggtacgtgcccgaggtgaccggcacccacaaggtgaccgtgctgttcgccggccagcacatcgccaagagccccttcgaggtgtacgtggacaagagccagggcgacgccagcaaggtgaccgcccagggccccggcctggagcccagcggcaacatcgccaacaagaccacctacttcgagatcttcaccgccggcgccggcaccggcgaggtggaggtggtgatccaggaccccatgggccagaagggcaccgtggagccccagctggaggccagaggcgacagcacctacagatgcagctaccagcccaccatggagggcgtgcacaccgtgcacgtgaccttcgccggcgtgcccatccccagaagcccctacaccgtgaccgtgggccaggcctgcaaccccagcgcctgcagagccgtgggcagaggcctgcagcccaagggcgtgagagtgaaggagaccgccgacttcaaggtgtacaccaagggcgccggcagcggcgagctgaaggtgaccgtgaagggccccaagggcgaggagagagtgaagcagaaggacctgggcgacggcgtgtacggcttcgagtactaccccatggtgcccggcacctacatcgtgaccatcacctggggcggccagaacatcggcagaagccccttcgaggtgaaggtgggcaccgagtgcggcaaccagaaggtgagagcctggggccccggcctggagggcggcgtggtgggcaagagcgccgacttcgtggtggaggccatcggcgacgacgtgggcaccctgggcttcagcgtggagggccccagccaggccaagatcgagtgcgacgacaagggcgacggcagctgcgacgtgagatactggccccaggaggccggcgagtacgccgtgcacgtgctgtgcaacagcgaggacatcagactgagccccttcatggccgacatcagagacgccccccaggacttccaccccgacagagtgaaggccagaggccccggcctggagaagaccggcgtggccgtgaacaagcccgccgagttcaccgtggacgccaagcacggcggcaaggcccccctgagagtgcaggtgcaggacaacgagggctgccccgtggaggccctggtgaaggacaacggcaacggcacctacagctgcagctacgtgcccagaaagcccgtgaagcacaccgccatggtgagctggggcggcgtgagcatccccaacagccccttcagagtgaacgtgggcgccggcagccaccccaacaaggtgaaggtgtacggccccggcgtggccaagaccggcctgaaggcccacgagcccacctacttcaccgtggactgcgccgaggccggccagggcgacgtgagcatcggcatcaagtgcgcccccggcgtggtgggccccgccgaggccgacatcgacttcgacatcatcagaaacgacaacgacaccttcaccgtgaagtacacccccagaggcgccggcagctacaccatcatggtgctgttcgccgaccaggccacccccaccagccccatcagagtgaaggtggagcccagccacgacgccagcaaggtgaaggccgagggccccggcctgagcagaaccggcgtggagctgggcaagcccacccacttcaccgtgaacgccaaggccgccggcaagggcaagctggacgtgcagttcagcggcctgaccaagggcgacgccgtgagagacgtggacatcatcgaccaccacgacaacacctacaccgtgaagtacacccccgtgcagcagggccccgtgggcgtgaacgtgacctacggcggcgaccccatccccaagagccccttcagcgtggccgtgagccccagcctggacctgagcaagatcaaggtgagcggcctgggcgagaaggtggacgtgggcaaggaccaggagttcaccgtgaagagcaagggcgccggcggccagggcaaggtggccagcaagatcgtgggccccagcggcgccgccgtgccctgcaaggtggagcccggcctgggcgccgacaacagcgtggtgagattcctgcccagagaggagggcccctacgaggtggaggtgacctacgacggcgtgcccgtgcccggcagccccttccccctggaggccgtggcccccaccaagcccagcaaggtgaaggccttcggccccggcctgcagggcggcagcgccggcagccccgccagattcaccatcgacaccaagggcgccggcaccggcggcctgggcctgaccgtggagggcccctgcgaggcccagctggagtgcctggacaacggcgacggcacctgcagcgtgagctacgtgcccaccgagcccggcgactacaacatcaacatcctgttcgccgacacccacatccccggcagccccttcaaggcccacgtggtgccctgcttcgacgccagcaaggtgaagtgcagcggccccggcctggagagagccaccgccggcgaggtgggccagttccaggtggactgcagcagcgccggcagcgccgagctgaccatcgagatctgcagcgaggccggcctgcccgccgaggtgtacatccaggaccacggcgacggcacccacaccatcacctacatccccctgtgccccggcgcctacaccgtgaccatcaagtacggcggccagcccgtgcccaacttccccagcaagctgcaggtggagcccgccgtggacaccagcggcgtgcagtgctacggccccggcatcgagggccagggcgtgttcagagaggccaccaccgagttcagcgtggacgccagagccctgacccagaccggcggcccccacgtgaaggccagagtggccaaccccagcggcaacctgaccgagacctacgtgcaggacagaggcgacggcatgtacaaggtggagtacaccccctacgaggagggcctgcacagcgtggacgtgacctacgacggcagccccgtgcccagcagccccttccaggtgcccgtgaccgagggctgcgaccccagcagagtgagagtgcacggccccggcatccagagcggcaccaccaacaagcccaacaagttcaccgtggagaccagaggcgccggcaccggcggcctgggcctggccgtggagggccccagcgaggccaagatgagctgcatggacaacaaggacggcagctgcagcgtggagtacatcccctacgaggccggcacctacagcctgaacgtgacctacggcggccaccaggtgcccggcagccccttcaaggtgcccgtgcacgacgtgaccgacgccagcaaggtgaagtgcagcggccccggcctgagccccggcatggtgagagccaacctgccccagagcttccaggtggacaccagcaaggccggcgtggcccccctgcaggtgaaggtgcagggccccaagggcctggtggagcccgtggacgtggtggacaacgccgacggcacccagaccgtgaactacgtgcccagcagagagggcccctacagcatcagcgtgctgtacggcgacgaggaggtgcccagaagccccttcaaggtgaaggtgctgcccacccacgacgccagcaaggtgaaggccagcggccccggcctgaacaccaccggcgtgcccgccagcctgcccgtggagttcaccatcgacgccaaggacgccggcgagggcctgctggccgtgcagatcaccgaccccgagggcaagcccaagaagacccacatccaggacaaccacgacggcacctacaccgtggcctacgtgcccgacgtgaccggcagatacaccatcctgatcaagtacggcggcgacgagatccccttcagcccctacagagtgagagccgtgcccaccggcgacgccagcaagtgcaccgtgaccggcgccggcatcggccccaccatccagatcggcgaggagaccgtgatcaccgtggacaccaaggccgccggcaagggcaaggtgacctgcaccgtgtgcacccccgacggcagcgaggtggacgtggacgtggtggagaacgaggacggcaccttcgacatcttctacaccgccccccagcccggcaagtacgtgatctgcgtgagattcggcggcgagcacgtgcccaacagccccttccaggtgaccgccctggccggcgaccagcccagcgtgcagccccccctgagaagccagcagctggccccccagtacacctacgcccagggcggccagcagacctgggcccccgagagacccctggtgggcgtgaacggcctggacgtgaccagcctgagacccttcgacctggtgatccccttcaccatcaagaagggcgagatcaccggcgaggtgagaatgcccagcggcaaggtggcccagcccaccatcaccgacaacaaggacggcaccgtgaccgtgagatacgcccccagcgaggccggcctgcacgagatggacatcagatacgacaacatgcacatccccggcagccccctgcagttctacgtggactacgtgaactgcggccacgtgaccgcctacggccccggcctgacccacggcgtggtgaacaagcccgccaccttcaccgtgaacaccaaggacgccggcgagggcggcctgagcctggccatcgagggccccagcaaggccgagatcagctgcaccgacaaccaggacggcacctgcagcgtgagctacctgcccgtgctgcccggcgactacagcatcctggtgaagtacaacgagcagcacgtgcccggcagccccttcaccgccagagtgaccggcgacgacagcatgagaatgagccacctgaaggtgggcagcgccgccgacatccccatcaacatcagcgagaccgacctgagcctgctgaccgccaccgtggtgccccccagcggcagagaggagccctgcctgctgaagagactgagaaacggccacgtgggcatcagcttcgtgcccaaggagaccggcgagcacctggtgcacgtgaagaagaacggccagcacgtggccagcagccccatccccgtggtgatcagccagagcgagatcggcgacgccagcagagtgagagtgagcggccagggcctgcacgagggccacaccttcgagcccgccgagttcatcatcgacaccagagacgccggctacggcggcctgagcctgagcatcgagggccccagcaaggtggacatcaacaccgaggacctggaggacggcacctgcagagtgacctactgccccaccgagcccggcaactacatcatcaacatcaagttcgccgaccagcacgtgcccggcagccccttcagcgtgaaggtgaccggcgagggcagagtgaaggagagcatcaccagaagaagaagagcccccagcgtggccaacgtgggcagccactgcgacctgagcctgaagatccccgagatcagcatccaggacatgaccgcccaggtgaccagccccagcggcaagacccacgaggccgagatcgtggagggcgagaaccacacctactgcatcagattcgtgcccgccgagatgggcacccacaccgtgagcgtgaagtacaagggccagcacgtgcccggcagccccttccagttcaccgtgggccccctgggcgagggcggcgcccacaaggtgagagccggcggccccggcctggagagagccgaggccggcgtgcccgccgagttcagcatctggaccagagaggccggcgccggcggcctggccatcgccgtggagggccccagcaaggccgagatcagcttcgaggacagaaaggacggcagctgcggcgtggcctacgtggtgcaggagcccggcgactacgaggtgagcgtgaagttcaacgaggagcacatccccgacagccccttcgtggtgcccgtggccagccccagcggcgacgccagaagactgaccgtgagcagcctgcaggagagcggcctgaaggtgaaccagcccgccagcttcgccgtgagcctgaacggcgccaagggcgccatcgacgccaaggtgcacagccccagcggcgccctggaggagtgctacgtgaccgagatcgaccaggacaagtacgccgtgagattcatccccagagagaacggcgtgtacctgatcgacgtgaagttcaacggcacccacatccccggcagccccttcaagatcagagtgggcgagcccggccacggcggcgaccccggcctggtgagcgcctacggcgccggcctggagggcggcgtgaccggcaaccccgccgagttcgtggtgaacaccagcaacgccggcgccggcgccctgagcgtgaccatcgacggccccagcaaggtgaagatggactgccaggagtgccccgagggctacagagtgacctacacccccatggcccccggcagctacctgatcagcatcaagtacggcggcccctaccacatcggcggcagccccttcaaggccaaggtgaccggccccagactggtgagcaaccacagcctgcacgagaccagcagcgtgttcgtggacagcctgaccaaggccacctgcgccccccagcacggcgcccccggccccggccccgccgacgccagcaaggtggtggccaagggcctgggcctgagcaaggcctacgtgggccagaagagcagcttcaccgtggactgcagcaaggccggcaacaacatgctgctggtgggcgtgcacggccccagaaccccctgcgaggagatcctggtgaagcacgtgggcagcagactgtacagcgtgagctacctgctgaaggacaagggcgagtacaccctggtggtgaagtggggcgacgagcacatccccggcagcccctacagagtggtggtgccctag

SEQ ID NO: 81751 - DNA, 7809 bp, Artificial Sequence
  Description of Artificial Sequence: Synthetic coding sequence
atgcccgtgaccgagaaggacctggccgaggacgccccctggaagaagatccagcagaacaccttcaccagatggtgcaacgagcacctgaagtgcgtgaacaagagaatcggcaacctgcagaccgacctgagcgacggcctgagactgatcgccctgctggaggtgctgagccagaagagaatgtacagaaagtaccaccagagacccaccttcagacagatgcagctggagaacgtgagcgtggccctggagttcctggacagagagagcatcaagctggtgagcatcgacagcaaggccatcgtggacggcaacctgaagctgatcctgggcctggtgtggaccctgatcctgcactacagcatcagcatgcccgtgtgggaggacgagggcgacgacgacgccaagaagcagacccccaagcagagactgctgggctggatccagaacaagatcccctacctgcccatcaccaacttcaaccagaactggcaggacggcaaggccctgggcgccctggtggacagctgcgcccccggcctgtgccccgactgggagagctgggacccccagaagcccgtggacaacgccagagaggccatgcagcaggccgacgactggctgggcgtgccccaggtgatcacccccgaggagatcatccaccccgacgtggacgagcacagcgtgatgacctacctgagccagttccccaaggccaagctgaagcccggcgcccccctgaagcccaagctgaaccccaagaaggccagagcctacggcagaggcatcgagcccaccggcaacatggtgaagcagcccgccaagttcaccgtggacaccatcagcgccggccagggcgacgtgatggtgttcgtggaggaccccgagggcaacaaggaggaggcccaggtgacccccgacagcgacaagaacaagacctacagcgtggagtacctgcccaaggtgaccggcctgcacaaggtgaccgtgctgttcgccggccagcacatcagcaagagccccttcgaggtgagcgtggacaaggcccagggcgacgccagcaaggtgaccgccaagggccccggcctggaggccgtgggcaacatcgccaacaagcccacctacttcgacatctacaccgccggcgccggcgtgggcgacatcggcgtggaggtggaggacccccagggcaagaacaccgtggagctgctggtggaggacaagggcaaccaggtgtacagatgcgtgtacaagcccatgcagcccggcccccacgtggtgaagatcttcttcgccggcgacaccatccccaagagccccttcgtggtgcaggtgggcgaggcctgcaaccccaacgcctgcagagccagcggcagaggcctgcagcccaagggcgtgagaatcagagagaccaccgacttcaaggtggacaccaaggccgccggcagcggcgagctgggcgtgaccatgaagggccccaagggcctggaggagctggtgaagcagaaggacttcctggacggcgtgtacgccttcgagtactaccccagcacccccggcagatacagcatcgccatcacctggggcggccaccacatccccaagagccccttcgaggtgcaggtgggccccgaggccggcatgcagaaggtgagagcctggggccccggcctgcacggcggcatcgtgggcagaagcgccgacttcgtggtggagagcatcggcagcgaggtgggcagcctgggcttcgccatcgagggccccagccaggccaagatcgagtacaacgaccagaacgacggcagctgcgacgtgaagtactggcccaaggagcccggcgagtacgccgtgcacatcatgtgcgacgacgaggacatcaaggacagcccctacatggccttcatccaccccgccaccggcggctacaaccccgacctggtgagagcctacggccccggcctggagaagagcggctgcatcgtgaacaacctggccgagttcaccgtggaccccaaggacgccggcaaggcccccctgaagatcttcgcccaggacggcgagggccagagaatcgacatccagatgaagaacagaatggacggcacctacgcctgcagctacacccccgtgaaggccatcaagcacaccatcgccgtggtgtggggcggcgtgaacatcccccacagcccctacagagtgaacatcggccagggcagccacccccagaaggtgaaggtgttcggccccggcgtggagagaagcggcctgaaggccaacgagcccacccacttcaccgtggactgcaccgaggccggcgagggcgacgtgagcgtgggcatcaagtgcgacgccagagtgctgagcgaggacgaggaggacgtggacttcgacatcatccacaacgccaacgacaccttcaccgtgaagtacgtgccccccgccgccggcagatacaccatcaaggtgctgttcgccagccaggagatccccgccagccccttcagagtgaaggtggaccccagccacgacgccagcaaggtgaaggccgagggccccggcctgagcaaggccggcgtggagaacggcaagcccacccacttcaccgtgtacaccaagggcgccggcaaggcccccctgaacgtgcagttcaacagccccctgcccggcgacgccgtgaaggacctggacatcatcgacaactacgactacagccacaccgtgaagtacacccccacccagcagggcaacatgcaggtgctggtgacctacggcggcgaccccatccccaagagccccttcaccgtgggcgtggccgcccccctggacctgagcaagatcaagctgaacggcctggagaacagagtggaggtgggcaaggaccaggagttcaccgtggacaccagaggcgccggcggccagggcaagctggacgtgaccatcctgagccccagcagaaaggtggtgccctgcctggtgacccccgtgaccggcagagagaacagcaccgccaagttcatccccagagaggagggcctgtacgccgtggacgtgacctacgacggccaccccgtgcccggcagcccctacaccgtggaggccagcctgccccccgaccccagcaaggtgaaggcccacggccccggcctggagggcggcctggtgggcaagcccgccgagttcaccatcgacaccaagggcgccggcaccggcggcctgggcctgaccgtggagggcccctgcgaggccaagatcgagtgcagcgacaacggcgacggcacctgcagcgtgagctacctgcccaccaagcccggcgagtacttcgtgaacatcctgttcgaggaggtgcacatccccggcagccccttcaaggccgacatcgagatgcccttcgaccccagcaaggtggtggccagcggccccggcctggagcacggcaaggtgggcgaggccggcctgctgagcgtggactgcagcgaggccggccccggcgccctgggcctggaggccgtgagcgacagcggcaccaaggccgaggtgagcatccagaacaacaaggacggcacctacgccgtgacctacgtgcccctgaccgccggcatgtacaccctgaccatgaagtacggcggcgagctggtgccccacttccccgccagagtgaaggtggagcccgccgtggacaccagcagaatcaaggtgttcggccccggcatcgagggcaaggacgtgttcagagaggccaccaccgacttcaccgtggacagcagacccctgacccaggtgggcggcgaccacatcaaggcccacatcgccaaccccagcggcgccagcaccgagtgcttcgtgaccgacaacgccgacggcacctaccaggtggagtacacccccttcgagaagggcctgcacgtggtggaggtgacctacgacgacgtgcccatccccaacagccccttcaaggtggccgtgaccgagggctgccagcccagcagagtgcaggcccagggccccggcctgaaggaggccttcaccaacaagcccaacgtgttcaccgtggtgaccagaggcgccggcatcggcggcctgggcatcaccgtggagggccccagcgagagcaagatcaactgcagagacaacaaggacggcagctgcagcgccgagtacatccccttcgcccccggcgactacgacgtgaacatcacctacggcggcgcccacatccccggcagccccttcagagtgcccgtgaaggacgtggtggaccccagcaaggtgaagatcgccggccccggcctgggcagcggcgtgagagccagagtgctgcagagcttcaccgtggacagcagcaaggccggcctggcccccctggaggtgagagtgctgggccccagaggcctggtggagcccgtgaacgtggtggacaacggcgacggcacccacaccgtgacctacacccccagccaggagggcccctacatggtgagcgtgaagtacgccgacgaggagatccccagaagccccttcaaggtgaaggtgctgcccacctacgacgccagcaaggtgaccgccagcggccccggcctgagcagctacggcgtgcccgccagcctgcccgtggacttcgccatcgacgccagagacgccggcgagggcctgctggccgtgcagatcaccgaccaggagggcaagcccaagagagccatcgtgcacgacaacaaggacggcacctacgccgtgacctacatccccgacaagaccggcagatacatgatcggcgtgacctacggcggcgacgacatccccctgagcccctacagaatcagagccacccagaccggcgacgccagcaagtgcctggccaccggccccggcatcgccagcaccgtgaagaccggcgaggaggtgggcttcgtggtggacgccaagaccgccggcaagggcaaggtgacctgcaccgtgctgacccccgacggcaccgaggccgaggccgacgtgatcgagaacgaggacggcacctacgacatcttctacaccgccgccaagcccggcacctacgtgatctacgtgagattcggcggcgtggacatccccaacagccccttcaccgtgatggccaccgacggcgaggtgaccgccgtggaggaggcccccgtgaacgcctgcccccccggcttcagaccctgggtgaccgaggaggcctacgtgcccgtgagcgacatgaacggcctgggcttcaagcccttcgacctggtgatccccttcgccgtgagaaagggcgagatcaccggcgaggtgcacatgcccagcggcaagaccgccacccccgagatcgtggacaacaaggacggcaccgtgaccgtgagatacgcccccaccgaggtgggcctgcacgagatgcacatcaagtacatgggcagccacatccccgagagccccctgcagttctacgtgaactaccccaacagcggcagcgtgagcgcctacggccccggcctggtgtacggcgtggccaacaagaccgccaccttcaccatcgtgaccgaggacgccggcgagggcggcctggacctggccatcgagggccccagcaaggccgagatcagctgcatcgacaacaaggacggcacctgcaccgtgacctacctgcccaccctgcccggcgactacagcatcctggtgaagtacaacgacaagcacatccccggcagccccttcaccgccaagatcaccgacgacagcagaagatgcagccaggtgaagctgggcagcgccgccgacttcctgctggacatcagcgagaccgacctgagcagcctgaccgccagcatcaaggcccccagcggcagagacgagccctgcctgctgaagagactgcccaacaaccacatcggcatcagcttcatccccagagaggtgggcgagcacctggtgagcatcaagaagaacggcaaccacgtggccaacagccccgtgagcatcatggtggtgcagagcgagatcggcgacgccagaagagccaaggtgtacggcagaggcctgagcgagggcagaaccttcgagatgagcgacttcatcgtggacaccagagacgccggctacggcggcatcagcctggccgtggagggccccagcaaggtggacatccagaccgaggacctggaggacggcacctgcaaggtgagctacttccccaccgtgcccggcgtgtacatcgtgagcaccaagttcgccgacgagcacgtgcccggcagccccttcaccgtgaagatcagcggcgagggcagagtgaaggagagcatcaccagaaccagcagagcccccagcgtggccaccgtgggcagcatctgcgacctgaacctgaagatccccgagatcaacagcagcgacatgagcgcccacgtgaccagccccagcggcagagtgaccgaggccgagatcgtgcccatgggcaagaacagccactgcgtgagattcgtgccccaggagatgggcgtgcacaccgtgagcgtgaagtacagaggccagcacgtgaccggcagccccttccagttcaccgtgggccccctgggcgagggcggcgcccacaaggtgagagccggcggccccggcctggagagaggcgaggccggcgtgcccgccgagttcagcatctggaccagagaggccggcgccggcggcctgagcatcgccgtggagggccccagcaaggccgagatcaccttcgacgaccacaagaacggcagctgcggcgtgagctacatcgcccaggagcccggcaactacgaggtgagcatcaagttcaacgacgagcacatccccgagagcccctacctggtgcccgtgatcgcccccagcgacgacgccagaagactgaccgtgatgagcctgcaggagagcggcctgaaggtgaaccagcccgccagcttcgccatcagactgaacggcgccaagggcaagatcgacgccaaggtgcacagccccagcggcgccgtggaggagtgccacgtgagcgagctggagcccgacaagtacgccgtgagattcatcccccacgagaacggcgtgcacaccatcgacgtgaagttcaacggcagccacgtggtgggcagccccttcaaggtgagagtgggcgagcccggccaggccggcaaccccgccctggtgagcgcctacggcaccggcctggagggcggcaccaccggcatccagagcgagttcttcatcaacaccaccagagccggccccggcaccctgagcgtgaccatcgagggccccagcaaggtgaagatggactgccaggagacccccgagggctacaaggtgatgtacacccccatggcccccggcaactacctgatcagcgtgaagtacggcggccccaaccacatcgtgggcagccccttcaaggccaaggtgaccggccagagactggtgagccccggcagcgccaacgagaccagcagcatcctggtggagagcgtgaccagaagcagcaccgagacctgctacagcgccatccccaaggccagcagcgacgccagcaaggtgaccagcaagggcgccggcctgagcaaggccttcgtgggccagaagagcagcttcctggtggactgcagcaaggccggcagcaacatgctgctgatcggcgtgcacggccccaccaccccctgcgaggaggtgagcatgaagcacgtgggcaaccagcagtacaacgtgacctacgtggtgaaggagagaggcgactacgtgctggccgtgaagtggggcgaggagcacatccccggcagccccttccacgtgaccgtgccctag

SEQ ID NO: 81752 - DNA, 7686 bp, Artificial Sequence
  Description of Artificial Sequence: Synthetic coding sequence
atgcccgtgaccgagaaggacctggccgaggacgccccctggaagaagatccagcagaacaccttcaccagatggtgcaacgagcacctgaagtgcgtgaacaagagaatcggcaacctgcagaccgacctgagcgacggcctgagactgatcgccctgctggaggtgctgagccagaagagaatgtacagaaagtaccaccagagacccaccttcagacagatgcagctggagaacgtgagcgtggccctggagttcctggacagagagagcatcaagctggtgagcatcgacagcaaggccatcgtggacggcaacctgaagctgatcctgggcctggtgtggaccctgatcctgcactacagcatcagcatgcccgtgtgggaggacgagggcgacgacgacgccaagaagcagacccccaagcagagactgctgggctggatccagaacaagatcccctacctgcccatcaccaacttcaaccagaactggcaggacggcaaggccctgggcgccctggtggacagctgcgcccccggcctgtgccccgactgggagagctgggacccccagaagcccgtggacaacgccagagaggccatgcagcaggccgacgactggctgggcgtgccccaggtgatcacccccgaggagatcatccaccccgacgtggacgagcacagcgtgatgacctacctgagccagttccccaaggccaagctgaagcccggcgcccccctgaagcccaagctgaaccccaagaaggccagagcctacggcagaggcatcgagcccaccggcaacatggtgaagcagcccgccaagttcaccgtggacaccatcagcgccggccagggcgacgtgatggtgttcgtggaggaccccgagggcaacaaggaggaggcccaggtgacccccgacagcgacaagaacaagacctacagcgtggagtacctgcccaaggtgaccggcctgcacaaggtgaccgtgctgttcgccggccagcacatcagcaagagccccttcgaggtgagcgtggacaaggcccagggcgacgccagcaaggtgaccgccaagggccccggcctggaggccgtgggcaacatcgccaacaagcccacctacttcgacatctacaccgccggcgccggcgtgggcgacatcggcgtggaggtggaggacccccagggcaagaacaccgtggagctgctggtggaggacaagggcaaccaggtgtacagatgcgtgtacaagcccatgcagcccggcccccacgtggtgaagatcttcttcgccggcgacaccatccccaagagccccttcgtggtgcaggtgggcgaggcctgcaaccccaacgcctgcagagccagcggcagaggcctgcagcccaagggcgtgagaatcagagagaccaccgacttcaaggtggacaccaaggccgccggcagcggcgagctgggcgtgaccatgaagggccccaagggcctggaggagctggtgaagcagaaggacttcctggacggcgtgtacgccttcgagtactaccccagcacccccggcagatacagcatcgccatcacctggggcggccaccacatccccaagagccccttcgaggtgcaggtgggccccgaggccggcatgcagaaggtgagagcctggggccccggcctgcacggcggcatcgtgggcagaagcgccgacttcgtggtggagagcatcggcagcgaggtgggcagcctgggcttcgccatcgagggccccagccaggccaagatcgagtacaacgaccagaacgacggcagctgcgacgtgaagtactggcccaaggagcccggcgagtacgccgtgcacatcatgtgcgacgacgaggacatcaaggacagcccctacatggccttcatccaccccgccaccggcggctacaaccccgacctggtgagagcctacggccccggcctggagaagagcggctgcatcgtgaacaacctggccgagttcaccgtggaccccaaggacgccggcaaggcccccctgaagatcttcgcccaggacggcgagggccagagaatcgacatccagatgaagaacagaatggacggcacctacgcctgcagctacacccccgtgaaggccatcaagcacaccatcgccgtggtgtggggcggcgtgaacatcccccacagcccctacagagtgaacatcggccagggcagccacccccagaaggtgaaggtgttcggccccggcgtggagagaagcggcctgaaggccaacgagcccacccacttcaccgtggactgcaccgaggccggcgagggcgacgtgagcgtgggcatcaagtgcgacgccagagtgctgagcgaggacgaggaggacgtggacttcgacatcatccacaacgccaacgacaccttcaccgtgaagtacgtgccccccgccgccggcagatacaccatcaaggtgctgttcgccagccaggagatccccgccagccccttcagagtgaaggtggaccccagccacgacgccagcaaggtgaaggccgagggccccggcctgagcaaggccggcgtggagaacggcaagcccacccacttcaccgtgtacaccaagggcgccggcaaggcccccctgaacgtgcagttcaacagccccctgcccggcgacgccgtgaaggacctggacatcatcgacaactacgactacagccacaccgtgaagtacacccccacccagcagggcaacatgcaggtgctggtgacctacggcggcgaccccatccccaagagccccttcaccgtgggcgtggccgcccccctggacctgagcaagatcaagctgaacggcctggagaacagagtggaggtgggcaaggaccaggagttcaccgtggacaccagaggcgccggcggccagggcaagctggacgtgaccatcctgagccccagcagaaaggtggtgccctgcctggtgacccccgtgaccggcagagagaacagcaccgccaagttcatccccagagaggagggcctgtacgccgtggacgtgacctacgacggccaccccgtgcccggcagcccctacaccgtggaggccagcctgccccccgaccccagcaaggtgaaggcccacggccccggcctggagggcggcctggtgggcaagcccgccgagttcaccatcgacaccaagggcgccggcaccggcggcctgggcctgaccgtggagggcccctgcgaggccaagatcgagtgcagcgacaacggcgacggcacctgcagcgtgagctacctgcccaccaagcccggcgagtacttcgtgaacatcctgttcgaggaggtgcacatccccggcagccccttcaaggccgacatcgagatgcccttcgaccccagcaaggtggtggccagcggccccggcctggagcacggcaaggtgggcgaggccggcctgctgagcgtggactgcagcgaggccggccccggcgccctgggcctggaggccgtgagcgacagcggcaccaaggccgaggtgagcatccagaacaacaaggacggcacctacgccgtgacctacgtgcccctgaccgccggcatgtacaccctgaccatgaagtacggcggcgagctggtgccccacttccccgccagagtgaaggtggagcccgccgtggacaccagcagaatcaaggtgttcggccccggcatcgagggcaaggacgtgttcagagaggccaccaccgacttcaccgtggacagcagacccctgacccaggtgggcggcgaccacatcaaggcccacatcgccaaccccagcggcgccagcaccgagtgcttcgtgaccgacaacgccgacggcacctaccaggtggagtacacccccttcgagaagggcctgcacgtggtggaggtgacctacgacgacgtgcccatccccaacagccccttcaaggtggccgtgaccgagggctgccagcccagcagagtgcaggcccagggccccggcctgaaggaggccttcaccaacaagcccaacgtgttcaccgtggtgaccagaggcgccggcatcggcggcctgggcatcaccgtggagggccccagcgagagcaagatcaactgcagagacaacaaggacggcagctgcagcgccgagtacatccccttcgcccccggcgactacgacgtgaacatcacctacggcggcgcccacatccccggcagccccttcagagtgcccgtgaaggacgtggtggaccccagcaaggtgaagatcgccggccccggcctgggcagcggcgtgagagccagagtgctgcagagcttcaccgtggacagcagcaaggccggcctggcccccctggaggtgagagtgctgggccccagaggcctggtggagcccgtgaacgtggtggacaacggcgacggcacccacaccgtgacctacacccccagccaggagggcccctacatggtgagcgtgaagtacgccgacgaggagatccccagaagccccttcaaggtgaaggtgctgcccacctacgacgccagcaaggtgaccgccagcggccccggcctgagcagctacggcgtgcccgccagcctgcccgtggacttcgccatcgacgccagagacgccggcgagggcctgctggccgtgcagatcaccgaccaggagggcaagcccaagagagccatcgtgcacgacaacaaggacggcacctacgccgtgacctacatccccgacaagaccggcagatacatgatcggcgtgacctacggcggcgacgacatccccctgagcccctacagaatcagagccacccagaccggcgacgccagcaagtgcctggccaccggccccggcatcgccagcaccgtgaagaccggcgaggaggtgggcttcgtggtggacgccaagaccgccggcaagggcaaggtgacctgcaccgtgctgacccccgacggcaccgaggccgaggccgacgtgatcgagaacgaggacggcacctacgacatcttctacaccgccgccaagcccggcacctacgtgatctacgtgagattcggcggcgtggacatccccaacagccccttcaccgtgatggccaccgacggcgaggtgaccgccgtggaggaggcccccgtgaacgcctgcccccccggcttcagaccctgggtgaccgaggaggcctacgtgcccgtgagcgacatgaacggcctgggcttcaagcccttcgacctggtgatccccttcgccgtgagaaagggcgagatcaccggcgaggtgcacatgcccagcggcaagaccgccacccccgagatcgtggacaacaaggacggcaccgtgaccgtgagatacgcccccaccgaggtgggcctgcacgagatgcacatcaagtacatgggcagccacatccccgagagccccctgcagttctacgtgaactaccccaacagcggcagcgtgagcgcctacggccccggcctggtgtacggcgtggccaacaagaccgccaccttcaccatcgtgaccgaggacgccggcgagggcggcctggacctggccatcgagggccccagcaaggccgagatcagctgcatcgacaacaaggacggcacctgcaccgtgacctacctgcccaccctgcccggcgactacagcatcctggtgaagtacaacgacaagcacatccccggcagccccttcaccgccaagatcaccgacgacagcagaagatgcagccaggtgaagctgggcagcgccgccgacttcctgctggacatcagcgagaccgacctgagcagcctgaccgccagcatcaaggcccccagcggcagagacgagccctgcctgctgaagagactgcccaacaaccacatcggcatcagcttcatccccagagaggtgggcgagcacctggtgagcatcaagaagaacggcaaccacgtggccaacagccccgtgagcatcatggtggtgcagagcgagatcggcgacgccagaagagccaaggtgtacggcagaggcctgagcgagggcagaaccttcgagatgagcgacttcatcgtggacaccagagacgccggctacggcggcatcagcctggccgtggagggccccagcaaggtggacatccagaccgaggacctggaggacggcacctgcaaggtgagctacttccccaccgtgcccggcgtgtacatcgtgagcaccaagttcgccgacgagcacgtgcccgagatcaacagcagcgacatgagcgcccacgtgaccagccccagcggcagagtgaccgaggccgagatcgtgcccatgggcaagaacagccactgcgtgagattcgtgccccaggagatgggcgtgcacaccgtgagcgtgaagtacagaggccagcacgtgaccggcagccccttccagttcaccgtgggccccctgggcgagggcggcgcccacaaggtgagagccggcggccccggcctggagagaggcgaggccggcgtgcccgccgagttcagcatctggaccagagaggccggcgccggcggcctgagcatcgccgtggagggccccagcaaggccgagatcaccttcgacgaccacaagaacggcagctgcggcgtgagctacatcgcccaggagcccggcaactacgaggtgagcatcaagttcaacgacgagcacatccccgagagcccctacctggtgcccgtgatcgcccccagcgacgacgccagaagactgaccgtgatgagcctgcaggagagcggcctgaaggtgaaccagcccgccagcttcgccatcagactgaacggcgccaagggcaagatcgacgccaaggtgcacagccccagcggcgccgtggaggagtgccacgtgagcgagctggagcccgacaagtacgccgtgagattcatcccccacgagaacggcgtgcacaccatcgacgtgaagttcaacggcagccacgtggtgggcagccccttcaaggtgagagtgggcgagcccggccaggccggcaaccccgccctggtgagcgcctacggcaccggcctggagggcggcaccaccggcatccagagcgagttcttcatcaacaccaccagagccggccccggcaccctgagcgtgaccatcgagggccccagcaaggtgaagatggactgccaggagacccccgagggctacaaggtgatgtacacccccatggcccccggcaactacctgatcagcgtgaagtacggcggccccaaccacatcgtgggcagccccttcaaggccaaggtgaccggccagagactggtgagccccggcagcgccaacgagaccagcagcatcctggtggagagcgtgaccagaagcagcaccgagacctgctacagcgccatccccaaggccagcagcgacgccagcaaggtgaccagcaagggcgccggcctgagcaaggccttcgtgggccagaagagcagcttcctggtggactgcagcaaggccggcagcaacatgctgctgatcggcgtgcacggccccaccaccccctgcgaggaggtgagcatgaagcacgtgggcaaccagcagtacaacgtgacctacgtggtgaaggagagaggcgactacgtgctggccgtgaagtggggcgaggagcacatccccggcagccccttccacgtgaccgtgccctag

SEQ ID NO: 81753 - DNA, 6453 bp, Artificial Sequence
  Description of Artificial Sequence: Synthetic coding sequence
atgcccgtgaccgagaaggacctggccgaggacgccccctggaagaagatccagcagaacaccttcaccagatggtgcaacgagcacctgaagtgcgtgaacaagagaatcggcaacctgcagaccgacctgagcgacggcctgagactgatcgccctgctggaggtgctgagccagaagagaatgtacagaaagtaccaccagagacccaccttcagacagatgcagctggagaacgtgagcgtggccctggagttcctggacagagagagcatcaagctggtgagcatcgacagcaaggccatcgtggacggcaacctgaagctgatcctgggcctggtgtggaccctgatcctgcactacagcatcagcatgcccgtgtgggaggacgagggcgacgacgacgccaagaagcagacccccaagcagagactgctgggctggatccagaacaagatcccctacctgcccatcaccaacttcaaccagaactggcaggacggcaaggccctgggcgccctggtggacagctgcgcccccggcctgtgccccgactgggagagctgggacccccagaagcccgtggacaacgccagagaggccatgcagcaggccgacgactggctgggcgtgccccaggtgatcacccccgaggagatcatccaccccgacgtggacgagcacagcgtgatgacctacctgagccagttccccaaggccaagctgaagcccggcgcccccctgaagcccaagctgaaccccaagaaggccagagcctacggcagaggcatcgagcccaccggcaacatggtgaagcagcccgccaagttcaccgtggacaccatcagcgccggccagggcgacgtgatggtgttcgtggaggaccccgagggcaacaaggaggaggcccaggtgacccccgacagcgacaagaacaagacctacagcgtggagtacctgcccaaggtgaccggcctgcacaaggtgaccgtgctgttcgccggccagcacatcagcaagagccccttcgaggtgagcgtggacaaggcccagggcgacgccagcaaggtgaccgccaagggccccggcctggaggccgtgggcaacatcgccaacaagcccacctacttcgacatctacaccgccggcgccggcgtgggcgacatcggcgtggaggtggaggacccccagggcaagaacaccgtggagctgctggtggaggacaagggcaaccaggtgtacagatgcgtgtacaagcccatgcagcccggcccccacgtggtgaagatcttcttcgccggcgacaccatccccaagagccccttcgtggtgcaggtgggcgaggcctgcaaccccaacgcctgcagagccagcggcagaggcctgcagcccaagggcgtgagaatcagagagaccaccgacttcaaggtggacaccaaggccgccggcagcggcgagctgggcgtgaccatgaagggccccaagggcctggaggagctggtgaagcagaaggacttcctggacggcgtgtacgccttcgagtactaccccagcacccccggcagatacagcatcgccatcacctggggcggccaccacatccccaagagccccttcgaggtgcaggtgggccccgaggccggcatgcagaaggtgagagcctggggccccggcctgcacggcggcatcgtgggcagaagcgccgacttcgtggtggagagcatcggcagcgaggtgggcagcctgggcttcgccatcgagggccccagccaggccaagatcgagtacaacgaccagaacgacggcagctgcgacgtgaagtactggcccaaggagcccggcgagtacgccgtgcacatcatgtgcgacgacgaggacatcaaggacagcccctacatggccttcatccaccccgccaccggcggctacaaccccgacctggtgagagcctacggccccggcctggagaagagcggctgcatcgtgaacaacctggccgagttcaccgtggaccccaaggacgccggcaaggcccccctgaagatcttcgcccaggacggcgagggccagagaatcgacatccagatgaagaacagaatggacggcacctacgcctgcagctacacccccgtgaaggccatcaagcacaccatcgccgtggtgtggggcggcgtgaacatcccccacagcccctacagagtgaacatcggccagggcagccacccccagaaggtgaaggtgttcggccccggcgtggagagaagcggcctgaaggccaacgagcccacccacttcaccgtggactgcaccgaggccggcgagggcgacgtgagcgtgggcatcaagtgcgacgccagagtgctgagcgaggacgaggaggacgtggacttcgacatcatccacaacgccaacgacaccttcaccgtgaagtacgtgccccccgccgccggcagatacaccatcaaggtgctgttcgccagccaggagatccccgccagccccttcagagtgaaggtggaccccagccacgacgccagcaaggtgaaggccgagggccccggcctgagcaaggccggcgtggagaacggcaagcccacccacttcaccgtgtacaccaagggcgccggcaaggcccccctgaacgtgcagttcaacagccccctgcccggcgacgccgtgaaggacctggacatcatcgacaactacgactacagccacaccgtgaagtacacccccacccagcagggcaacatgcaggtgctggtgacctacggcggcgaccccatccccaagagccccttcaccgtgggcgtggccgcccccctggacctgagcaagatcaagctgaacggcctggagaacagagtggaggtgggcaaggaccaggagttcaccgtggacaccagaggcgccggcggccagggcaagctggacgtgaccatcctgagccccagcagaaaggtggtgccctgcctggtgacccccgtgaccggcagagagaacagcaccgccaagttcatccccagagaggagggcctgtacgccgtggacgtgacctacgacggccaccccgtgcccggcagcccctacaccgtggaggccagcctgccccccgaccccagcaaggtgaaggcccacggccccggcctggagggcggcctggtgggcaagcccgccgagttcaccatcgacaccaagggcgccggcaccggcggcctgggcctgaccgtggagggcccctgcgaggccaagatcgagtgcagcgacaacggcgacggcacctgcagcgtgagctacctgcccaccaagcccggcgagtacttcgtgaacatcctgttcgaggaggtgcacatccccggcagccccttcaaggccgacatcgagatgcccttcgaccccagcaaggtggtggccagcggccccggcctggagcacggcaaggtgggcgaggccggcctgctgagcgtggactgcagcgaggccggccccggcgccctgggcctggaggccgtgagcgacagcggcaccaaggccgaggtgagcatccagaacaacaaggacggcacctacgccgtgacctacgtgcccctgaccgccggcatgtacaccctgaccatgaagtacggcggcgagctggtgccccacttccccgccagagtgaaggtggagcccgccgtggacaccagcagaatcaaggtgttcggccccggcatcgagggcaaggacgtgttcagagaggccaccaccgacttcaccgtggacagcagacccctgacccaggtgggcggcgaccacatcaaggcccacatcgccaaccccagcggcgccagcaccgagtgcttcgtgaccgacaacgccgacggcacctaccaggtggagtacacccccttcgagaagggcctgcacgtggtggaggtgacctacgacgacgtgcccatccccaacagccccttcaaggtggccgtgaccgagggctgccagcccagcagagtgcaggcccagggccccggcctgaaggaggccttcaccaacaagcccaacgtgttcaccgtggtgaccagaggcgccggcatcggcggcctgggcatcaccgtggagggccccagcgagagcaagatcaactgcagagacaacaaggacggcagctgcagcgccgagtacatccccttcgcccccggcgactacgacgtgaacatcacctacggcggcgcccacatccccggcagccccttcagagtgcccgtgaaggacgtggtggaccccagcaaggtgaagatcgccggccccggcctgggcagcggcgtgagagccagagtgctgcagagcttcaccgtggacagcagcaaggccggcctggcccccctggaggtgagagtgctgggccccagaggcctggtggagcccgtgaacgtggtggacaacggcgacggcacccacaccgtgacctacacccccagccaggagggcccctacatggtgagcgtgaagtacgccgacgaggagatccccagaagccccttcaaggtgaaggtgctgcccacctacgacgccagcaaggtgaccgccagcggccccggcctgagcagctacggcgtgcccgccagcctgcccgtggacttcgccatcgacgccagagacgccggcgagggcctgctggccgtgcagatcaccgaccaggagggcaagcccaagagagccatcgtgcacgacaacaaggacggcacctacgccgtgacctacatccccgacaagaccggcagatacatgatcggcgtgacctacggcggcgacgacatccccctgagcccctacagaatcagagccacccagaccggcgacgccagcaagtgcctggccaccggccccggcatcgccagcaccgtgaagaccggcgaggaggtgggcttcgtggtggacgccaagaccgccggcaagggcaaggtgacctgcaccgtgctgacccccgacggcaccgaggccgaggccgacgtgatcgagaacgaggacggcacctacgacatcttctacaccgccgccaagcccggcacctacgtgatctacgtgagattcggcggcgtggacatccccaacagccccttcaccgtgatggccaccgacggcgaggtgaccgccgtggaggaggcccccgtgaacgcctgcccccccggcttcagaccctgggtgaccgaggaggcctacgtgcccgtgagcgacatgaacggcctgggcttcaagcccttcgacctggtgatccccttcgccgtgagaaagggcgagatcaccggcgaggtgcacatgcccagcggcaagaccgccacccccgagatcgtggacaacaaggacggcaccgtgaccgtgagatacgcccccaccgaggtgggcctgcacgagatgcacatcaagtacatgggcagccacatccccgagagccccctgcagttctacgtgaactaccccaacagcggcagcgtgagcgcctacggccccggcctggtgtacggcgtggccaacaagaccgccaccttcaccatcgtgaccgaggacgccggcgagggcggcctggacctggccatcgagggccccagcaaggccgagatcagctgcatcgacaacaaggacggcacctgcaccgtgacctacctgcccaccctgcccggcgactacagcatcctggtgaagtacaacgacaagcacatccccggcagccccttcaccgccaagatcaccgacgacagcagaagatgcagccaggtgaagctgggcagcgccgccgacttcctgctggacatcagcgagaccgacctgagcagcctgaccgccagcatcaaggcccccagcggcagagacgagccctgcctgctgaagagactgcccaacaaccacatcggcatcagcttcatccccagagaggtgggcgagcacctggtgagcatcaagaagaacggcaaccacgtggccaacagccccgtgagcatcatggtggtgcagagcgagatcggcgacgccagaagagccaaggtgtacggcagaggcctgagcgagggcagaaccttcgagatgagcgacttcatcgtggacaccagagacgccggctacggcggcatcagcctggccgtggagggccccagcaaggtggacatccagaccgaggacctggaggacggcacctgcaaggtgagctacttccccaccgtgcccggcgtgtacatcgtgagcaccaagttcgccgacgagcacgtgcccggcagccccttcaccgtgaagatcagcggcgagggcagagtgaaggagagcatcaccagaaccagcagagcccccagcgtggccaccgtgggcagcatctgcgacctgaacctgaagatccccggcgtgagagtgatgaactgcagcgcccagatcctgtggggctggagagtgcagttccacaccggcagcagaaaccagcagcagtag

SEQ ID NO: 81754 - DNA, 7737 bp, Artificial Sequence
  Description of Artificial Sequence: Synthetic coding sequence
atgcccgtgaccgagaaggacctggccgaggacgccccctggaagaagatccagcagaacaccttcaccagatggtgcaacgagcacctgaagtgcgtgaacaagagaatcggcaacctgcagaccgacctgagcgacggcctgagactgatcgccctgctggaggtgctgagccagaagagaatgtacagaaagtaccaccagagacccaccttcagacagatgcagctggagaacgtgagcgtggccctggagttcctggacagagagagcatcaagctggtgagcatcgacagcaaggccatcgtggacggcaacctgaagctgatcctgggcctggtgtggaccctgatcctgcactacagcatcagcatgcccgtgtgggaggacgagggcgacgacgacgccaagaagcagacccccaagcagagactgctgggctggatccagaacaagatcccctacctgcccatcaccaacttcaaccagaactggcaggacggcaaggccctgggcgccctggtggacagctgcgcccccggcctgtgccccgactgggagagctgggacccccagaagcccgtggacaacgccagagaggccatgcagcaggccgacgactggctgggcgtgccccaggtgatcacccccgaggagatcatccaccccgacgtggacgagcacagcgtgatgacctacctgagccagttccccaaggccaagctgaagcccggcgcccccctgaagcccaagctgaaccccaagaaggccagagcctacggcagaggcatcgagcccaccggcaacatggtgaagcagcccgccaagttcaccgtggacaccatcagcgccggccagggcgacgtgatggtgttcgtggaggaccccgagggcaacaaggaggaggcccaggtgacccccgacagcgacaagaacaagacctacagcgtggagtacctgcccaaggtgaccggcctgcacaaggtgaccgtgctgttcgccggccagcacatcagcaagagccccttcgaggtgagcgtggacaaggcccagggcgacgccagcaaggtgaccgccaagggccccggcctggaggccgtgggcaacatcgccaacaagcccacctacttcgacatctacaccgccggcgccggcgtgggcgacatcggcgtggaggtggaggacccccagggcaagaacaccgtggagctgctggtggaggacaagggcaaccaggtgtacagatgcgtgtacaagcccatgcagcccggcccccacgtggtgaagatcttcttcgccggcgacaccatccccaagagccccttcgtggtgcaggtgggcgaggcctgcaaccccaacgcctgcagagccagcggcagaggcctgcagcccaagggcgtgagaatcagagagaccaccgacttcaaggtggacaccaaggccgccggcagcggcgagctgggcgtgaccatgaagggccccaagggcctggaggagctggtgaagcagaaggacttcctggacggcgtgtacgccttcgagtactaccccagcacccccggcagatacagcatcgccatcacctggggcggccaccacatccccaagagccccttcgaggtgcaggtgggccccgaggccggcatgcagaaggtgagagcctggggccccggcctgcacggcggcatcgtgggcagaagcgccgacttcgtggtggagagcatcggcagcgaggtgggcagcctgggcttcgccatcgagggccccagccaggccaagatcgagtacaacgaccagaacgacggcagctgcgacgtgaagtactggcccaaggagcccggcgagtacgccgtgcacatcatgtgcgacgacgaggacatcaaggacagcccctacatggccttcatccaccccgccaccggcggctacaaccccgacctggtgagagcctacggccccggcctggagaagagcggctgcatcgtgaacaacctggccgagttcaccgtggaccccaaggacgccggcaaggcccccctgaagatcttcgcccaggacggcgagggccagagaatcgacatccagatgaagaacagaatggacggcacctacgcctgcagctacacccccgtgaaggccatcaagcacaccatcgccgtggtgtggggcggcgtgaacatcccccacagcccctacagagtgaacatcggccagggcagccacccccagaaggtgaaggtgttcggccccggcgtggagagaagcggcctgaaggccaacgagcccacccacttcaccgtggactgcaccgaggccggcgagggcgacgtgagcgtgggcatcaagtgcgacgccagagtgctgagcgaggacgaggaggacgtggacttcgacatcatccacaacgccaacgacaccttcaccgtgaagtacgtgccccccgccgccggcagatacaccatcaaggtgctgttcgccagccaggagatccccgccagccccttcagagtgaaggtggaccccagccacgacgccagcaaggtgaaggccgagggccccggcctgagcaaggccggcgtggagaacggcaagcccacccacttcaccgtgtacaccaagggcgccggcaaggcccccctgaacgtgcagttcaacagccccctgcccggcgacgccgtgaaggacctggacatcatcgacaactacgactacagccacaccgtgaagtacacccccacccagcagggcaacatgcaggtgctggtgacctacggcggcgaccccatccccaagagccccttcaccgtgggcgtggccgcccccctggacctgagcaagatcaagctgaacggcctggagaacagagtggaggtgggcaaggaccaggagttcaccgtggacaccagaggcgccggcggccagggcaagctggacgtgaccatcctgagccccagcagaaaggtggtgccctgcctggtgacccccgtgaccggcagagagaacagcaccgccaagttcatccccagagaggagggcctgtacgccgtggacgtgacctacgacggccaccccgtgcccggcagcccctacaccgtggaggccagcctgccccccgaccccagcaaggtgaaggcccacggccccggcctggagggcggcctggtgggcaagcccgccgagttcaccatcgacaccaagggcgccggcaccggcggcctgggcctgaccgtggagggcccctgcgaggccaagatcgagtgcagcgacaacggcgacggcacctgcagcgtgagctacctgcccaccaagcccggcgagtacttcgtgaacatcctgttcgaggaggtgcacatccccggcagccccttcaaggccgacatcgagatgcccttcgaccccagcaaggtggtggccagcggccccggcctggagcacggcaaggtgggcgaggccggcctgctgagcgtggactgcagcgaggccggccccggcgccctgggcctggaggccgtgagcgacagcggcaccaaggccgaggtgagcatccagaacaacaaggacggcacctacgccgtgacctacgtgcccctgaccgccggcatgtacaccctgaccatgaagtacggcggcgagctggtgccccacttccccgccagagtgaaggtggagcccgccgtggacaccagcagaatcaaggtgttcggccccggcatcgagggcaaggacgtgttcagagaggccaccaccgacttcaccgtggacagcagacccctgacccaggtgggcggcgaccacatcaaggcccacatcgccaaccccagcggcgccagcaccgagtgcttcgtgaccgacaacgccgacggcacctaccaggtggagtacacccccttcgagaagggcctgcacgtggtggaggtgacctacgacgacgtgcccatccccaacagccccttcaaggtggccgtgaccgagggctgccagcccagcagagtgcaggcccagggccccggcctgaaggaggccttcaccaacaagcccaacgtgttcaccgtggtgaccagaggcgccggcatcggcggcctgggcatcaccgtggagggccccagcgagagcaagatcaactgcagagacaacaaggacggcagctgcagcgccgagtacatccccttcgcccccggcgactacgacgtgaacatcacctacggcggcgcccacatccccggcagccccttcagagtgcccgtgaaggacgtggtggaccccagcaaggtgaagatcgccggccccggcctgggcagcggcgtgagagccagagtgctgcagagcttcaccgtggacagcagcaaggccggcctggcccccctggaggtgagagtgctgggccccagaggcctggtggagcccgtgaacgtggtggacaacggcgacggcacccacaccgtgacctacacccccagccaggagggcccctacatggtgagcgtgaagtacgccgacgaggagatccccagaagccccttcaaggtgaaggtgctgcccacctacgacgccagcaaggtgaccgccagcggccccggcctgagcagctacggcgtgcccgccagcctgcccgtggacttcgccatcgacgccagagacgccggcgagggcctgctggccgtgcagatcaccgaccaggagggcaagcccaagagagccatcgtgcacgacaacaaggacggcacctacgccgtgacctacatccccgacaagaccggcagatacatgatcggcgtgacctacggcggcgacgacatccccctgagcccctacagaatcagagccacccagaccggcgacgccagcaagtgcctggccaccggccccggcatcgccagcaccgtgaagaccggcgaggaggtgggcttcgtggtggacgccaagaccgccggcaagggcaaggtgacctgcaccgtgctgacccccgacggcaccgaggccgaggccgacgtgatcgagaacgaggacggcacctacgacatcttctacaccgccgccaagcccggcacctacgtgatctacgtgagattcggcggcgtggacatccccaacagccccttcaccgtgatggtgaccgaggaggcctacgtgcccgtgagcgacatgaacggcctgggcttcaagcccttcgacctggtgatccccttcgccgtgagaaagggcgagatcaccggcgaggtgcacatgcccagcggcaagaccgccacccccgagatcgtggacaacaaggacggcaccgtgaccgtgagatacgcccccaccgaggtgggcctgcacgagatgcacatcaagtacatgggcagccacatccccgagagccccctgcagttctacgtgaactaccccaacagcggcagcgtgagcgcctacggccccggcctggtgtacggcgtggccaacaagaccgccaccttcaccatcgtgaccgaggacgccggcgagggcggcctggacctggccatcgagggccccagcaaggccgagatcagctgcatcgacaacaaggacggcacctgcaccgtgacctacctgcccaccctgcccggcgactacagcatcctggtgaagtacaacgacaagcacatccccggcagccccttcaccgccaagatcaccgacgacagcagaagatgcagccaggtgaagctgggcagcgccgccgacttcctgctggacatcagcgagaccgacctgagcagcctgaccgccagcatcaaggcccccagcggcagagacgagccctgcctgctgaagagactgcccaacaaccacatcggcatcagcttcatccccagagaggtgggcgagcacctggtgagcatcaagaagaacggcaaccacgtggccaacagccccgtgagcatcatggtggtgcagagcgagatcggcgacgccagaagagccaaggtgtacggcagaggcctgagcgagggcagaaccttcgagatgagcgacttcatcgtggacaccagagacgccggctacggcggcatcagcctggccgtggagggccccagcaaggtggacatccagaccgaggacctggaggacggcacctgcaaggtgagctacttccccaccgtgcccggcgtgtacatcgtgagcaccaagttcgccgacgagcacgtgcccggcagccccttcaccgtgaagatcagcggcgagggcagagtgaaggagagcatcaccagaaccagcagagcccccagcgtggccaccgtgggcagcatctgcgacctgaacctgaagatccccgagatcaacagcagcgacatgagcgcccacgtgaccagccccagcggcagagtgaccgaggccgagatcgtgcccatgggcaagaacagccactgcgtgagattcgtgccccaggagatgggcgtgcacaccgtgagcgtgaagtacagaggccagcacgtgaccggcagccccttccagttcaccgtgggccccctgggcgagggcggcgcccacaaggtgagagccggcggccccggcctggagagaggcgaggccggcgtgcccgccgagttcagcatctggaccagagaggccggcgccggcggcctgagcatcgccgtggagggccccagcaaggccgagatcaccttcgacgaccacaagaacggcagctgcggcgtgagctacatcgcccaggagcccggcaactacgaggtgagcatcaagttcaacgacgagcacatccccgagagcccctacctggtgcccgtgatcgcccccagcgacgacgccagaagactgaccgtgatgagcctgcaggagagcggcctgaaggtgaaccagcccgccagcttcgccatcagactgaacggcgccaagggcaagatcgacgccaaggtgcacagccccagcggcgccgtggaggagtgccacgtgagcgagctggagcccgacaagtacgccgtgagattcatcccccacgagaacggcgtgcacaccatcgacgtgaagttcaacggcagccacgtggtgggcagccccttcaaggtgagagtgggcgagcccggccaggccggcaaccccgccctggtgagcgcctacggcaccggcctggagggcggcaccaccggcatccagagcgagttcttcatcaacaccaccagagccggccccggcaccctgagcgtgaccatcgagggccccagcaaggtgaagatggactgccaggagacccccgagggctacaaggtgatgtacacccccatggcccccggcaactacctgatcagcgtgaagtacggcggccccaaccacatcgtgggcagccccttcaaggccaaggtgaccggccagagactggtgagccccggcagcgccaacgagaccagcagcatcctggtggagagcgtgaccagaagcagcaccgagacctgctacagcgccatccccaaggccagcagcgacgccagcaaggtgaccagcaagggcgccggcctgagcaaggccttcgtgggccagaagagcagcttcctggtggactgcagcaaggccggcagcaacatgctgctgatcggcgtgcacggccccaccaccccctgcgaggaggtgagcatgaagcacgtgggcaaccagcagtacaacgtgacctacgtggtgaaggagagaggcgactacgtgctggccgtgaagtggggcgaggagcacatccccggcagccccttccacgtgaccgtgccctag

SEQ ID NO: 81755 - DNA, 7269 bp, Artificial Sequence
  Description of Artificial Sequence: Synthetic coding sequence
atgcaggagcacagcaccagaagaagaagcctgagcctgtgccccgactgggagagctgggacccccagaagcccgtggacaacgccagagaggccatgcagcaggccgacgactggctgggcgtgccccaggtgatcacccccgaggagatcatccaccccgacgtggacgagcacagcgtgatgacctacctgagccagttccccaaggccaagctgaagcccggcgcccccctgaagcccaagctgaaccccaagaaggccagagcctacggcagaggcatcgagcccaccggcaacatggtgaagcagcccgccaagttcaccgtggacaccatcagcgccggccagggcgacgtgatggtgttcgtggaggaccccgagggcaacaaggaggaggcccaggtgacccccgacagcgacaagaacaagacctacagcgtggagtacctgcccaaggtgaccggcctgcacaaggtgaccgtgctgttcgccggccagcacatcagcaagagccccttcgaggtgagcgtggacaaggcccagggcgacgccagcaaggtgaccgccaagggccccggcctggaggccgtgggcaacatcgccaacaagcccacctacttcgacatctacaccgccggcgccggcgtgggcgacatcggcgtggaggtggaggacccccagggcaagaacaccgtggagctgctggtggaggacaagggcaaccaggtgtacagatgcgtgtacaagcccatgcagcccggcccccacgtggtgaagatcttcttcgccggcgacaccatccccaagagccccttcgtggtgcaggtgggcgaggcctgcaaccccaacgcctgcagagccagcggcagaggcctgcagcccaagggcgtgagaatcagagagaccaccgacttcaaggtggacaccaaggccgccggcagcggcgagctgggcgtgaccatgaagggccccaagggcctggaggagctggtgaagcagaaggacttcctggacggcgtgtacgccttcgagtactaccccagcacccccggcagatacagcatcgccatcacctggggcggccaccacatccccaagagccccttcgaggtgcaggtgggccccgaggccggcatgcagaaggtgagagcctggggccccggcctgcacggcggcatcgtgggcagaagcgccgacttcgtggtggagagcatcggcagcgaggtgggcagcctgggcttcgccatcgagggccccagccaggccaagatcgagtacaacgaccagaacgacggcagctgcgacgtgaagtactggcccaaggagcccggcgagtacgccgtgcacatcatgtgcgacgacgaggacatcaaggacagcccctacatggccttcatccaccccgccaccggcggctacaaccccgacctggtgagagcctacggccccggcctggagaagagcggctgcatcgtgaacaacctggccgagttcaccgtggaccccaaggacgccggcaaggcccccctgaagatcttcgcccaggacggcgagggccagagaatcgacatccagatgaagaacagaatggacggcacctacgcctgcagctacacccccgtgaaggccatcaagcacaccatcgccgtggtgtggggcggcgtgaacatcccccacagcccctacagagtgaacatcggccagggcagccacccccagaaggtgaaggtgttcggccccggcgtggagagaagcggcctgaaggccaacgagcccacccacttcaccgtggactgcaccgaggccggcgagggcgacgtgagcgtgggcatcaagtgcgacgccagagtgctgagcgaggacgaggaggacgtggacttcgacatcatccacaacgccaacgacaccttcaccgtgaagtacgtgccccccgccgccggcagatacaccatcaaggtgctgttcgccagccaggagatccccgccagccccttcagagtgaaggtggaccccagccacgacgccagcaaggtgaaggccgagggccccggcctgagcaaggccggcgtggagaacggcaagcccacccacttcaccgtgtacaccaagggcgccggcaaggcccccctgaacgtgcagttcaacagccccctgcccggcgacgccgtgaaggacctggacatcatcgacaactacgactacagccacaccgtgaagtacacccccacccagcagggcaacatgcaggtgctggtgacctacggcggcgaccccatccccaagagccccttcaccgtgggcgtggccgcccccctggacctgagcaagatcaagctgaacggcctggagaacagagtggaggtgggcaaggaccaggagttcaccgtggacaccagaggcgccggcggccagggcaagctggacgtgaccatcctgagccccagcagaaaggtggtgccctgcctggtgacccccgtgaccggcagagagaacagcaccgccaagttcatccccagagaggagggcctgtacgccgtggacgtgacctacgacggccaccccgtgcccggcagcccctacaccgtggaggccagcctgccccccgaccccagcaaggtgaaggcccacggccccggcctggagggcggcctggtgggcaagcccgccgagttcaccatcgacaccaagggcgccggcaccggcggcctgggcctgaccgtggagggcccctgcgaggccaagatcgagtgcagcgacaacggcgacggcacctgcagcgtgagctacctgcccaccaagcccggcgagtacttcgtgaacatcctgttcgaggaggtgcacatccccggcagccccttcaaggccgacatcgagatgcccttcgaccccagcaaggtggtggccagcggccccggcctggagcacggcaaggtgggcgaggccggcctgctgagcgtggactgcagcgaggccggccccggcgccctgggcctggaggccgtgagcgacagcggcaccaaggccgaggtgagcatccagaacaacaaggacggcacctacgccgtgacctacgtgcccctgaccgccggcatgtacaccctgaccatgaagtacggcggcgagctggtgccccacttccccgccagagtgaaggtggagcccgccgtggacaccagcagaatcaaggtgttcggccccggcatcgagggcaaggacgtgttcagagaggccaccaccgacttcaccgtggacagcagacccctgacccaggtgggcggcgaccacatcaaggcccacatcgccaaccccagcggcgccagcaccgagtgcttcgtgaccgacaacgccgacggcacctaccaggtggagtacacccccttcgagaagggcctgcacgtggtggaggtgacctacgacgacgtgcccatccccaacagccccttcaaggtggccgtgaccgagggctgccagcccagcagagtgcaggcccagggccccggcctgaaggaggccttcaccaacaagcccaacgtgttcaccgtggtgaccagaggcgccggcatcggcggcctgggcatcaccgtggagggccccagcgagagcaagatcaactgcagagacaacaaggacggcagctgcagcgccgagtacatccccttcgcccccggcgactacgacgtgaacatcacctacggcggcgcccacatccccggcagccccttcagagtgcccgtgaaggacgtggtggaccccagcaaggtgaagatcgccggccccggcctgggcagcggcgtgagagccagagtgctgcagagcttcaccgtggacagcagcaaggccggcctggcccccctggaggtgagagtgctgggccccagaggcctggtggagcccgtgaacgtggtggacaacggcgacggcacccacaccgtgacctacacccccagccaggagggcccctacatggtgagcgtgaagtacgccgacgaggagatccccagaagccccttcaaggtgaaggtgctgcccacctacgacgccagcaaggtgaccgccagcggccccggcctgagcagctacggcgtgcccgccagcctgcccgtggacttcgccatcgacgccagagacgccggcgagggcctgctggccgtgcagatcaccgaccaggagggcaagcccaagagagccatcgtgcacgacaacaaggacggcacctacgccgtgacctacatccccgacaagaccggcagatacatgatcggcgtgacctacggcggcgacgacatccccctgagcccctacagaatcagagccacccagaccggcgacgccagcaagtgcctggccaccggccccggcatcgccagcaccgtgaagaccggcgaggaggtgggcttcgtggtggacgccaagaccgccggcaagggcaaggtgacctgcaccgtgctgacccccgacggcaccgaggccgaggccgacgtgatcgagaacgaggacggcacctacgacatcttctacaccgccgccaagcccggcacctacgtgatctacgtgagattcggcggcgtggacatccccaacagccccttcaccgtgatggccaccgacggcgaggtgaccgccgtggaggaggcccccgtgaccgaggaggcctacgtgcccgtgagcgacatgaacggcctgggcttcaagcccttcgacctggtgatccccttcgccgtgagaaagggcgagatcaccggcgaggtgcacatgcccagcggcaagaccgccacccccgagatcgtggacaacaaggacggcaccgtgaccgtgagatacgcccccaccgaggtgggcctgcacgagatgcacatcaagtacatgggcagccacatccccgagagccccctgcagttctacgtgaactaccccaacagcggcagcgtgagcgcctacggccccggcctggtgtacggcgtggccaacaagaccgccaccttcaccatcgtgaccgaggacgccggcgagggcggcctggacctggccatcgagggccccagcaaggccgagatcagctgcatcgacaacaaggacggcacctgcaccgtgacctacctgcccaccctgcccggcgactacagcatcctggtgaagtacaacgacaagcacatccccggcagccccttcaccgccaagatcaccgacgacagcagaagatgcagccaggtgaagctgggcagcgccgccgacttcctgctggacatcagcgagaccgacctgagcagcctgaccgccagcatcaaggcccccagcggcagagacgagccctgcctgctgaagagactgcccaacaaccacatcggcatcagcttcatccccagagaggtgggcgagcacctggtgagcatcaagaagaacggcaaccacgtggccaacagccccgtgagcatcatggtggtgcagagcgagatcggcgacgccagaagagccaaggtgtacggcagaggcctgagcgagggcagaaccttcgagatgagcgacttcatcgtggacaccagagacgccggctacggcggcatcagcctggccgtggagggccccagcaaggtggacatccagaccgaggacctggaggacggcacctgcaaggtgagctacttccccaccgtgcccggcgtgtacatcgtgagcaccaagttcgccgacgagcacgtgcccggcagccccttcaccgtgaagatcagcggcgagggcagagtgaaggagagcatcaccagaaccagcagagcccccagcgtggccaccgtgggcagcatctgcgacctgaacctgaagatccccgagatcaacagcagcgacatgagcgcccacgtgaccagccccagcggcagagtgaccgaggccgagatcgtgcccatgggcaagaacagccactgcgtgagattcgtgccccaggagatgggcgtgcacaccgtgagcgtgaagtacagaggccagcacgtgaccggcagccccttccagttcaccgtgggccccctgggcgagggcggcgcccacaaggtgagagccggcggccccggcctggagagaggcgaggccggcgtgcccgccgagttcagcatctggaccagagaggccggcgccggcggcctgagcatcgccgtggagggccccagcaaggccgagatcaccttcgacgaccacaagaacggcagctgcggcgtgagctacatcgcccaggagcccggcaactacgaggtgagcatcaagttcaacgacgagcacatccccgagagcccctacctggtgcccgtgatcgcccccagcgacgacgccagaagactgaccgtgatgagcctgcaggagagcggcctgaaggtgaaccagcccgccagcttcgccatcagactgaacggcgccaagggcaagatcgacgccaaggtgcacagccccagcggcgccgtggaggagtgccacgtgagcgagctggagcccgacaagtacgccgtgagattcatcccccacgagaacggcgtgcacaccatcgacgtgaagttcaacggcagccacgtggtgggcagccccttcaaggtgagagtgggcgagcccggccaggccggcaaccccgccctggtgagcgcctacggcaccggcctggagggcggcaccaccggcatccagagcgagttcttcatcaacaccaccagagccggccccggcaccctgagcgtgaccatcgagggccccagcaaggtgaagatggactgccaggagacccccgagggctacaaggtgatgtacacccccatggcccccggcaactacctgatcagcgtgaagtacggcggccccaaccacatcgtgggcagccccttcaaggccaaggtgaccggccagagactggtgagccccggcagcgccaacgagaccagcagcatcctggtggagagcgtgaccagaagcagcaccgagacctgctacagcgccatccccaaggccagcagcgacgccagcaaggtgaccagcaagggcgccggcctgagcaaggccttcgtgggccagaagagcagcttcctggtggactgcagcaaggccggcagcaacatgctgctgatcggcgtgcacggccccaccaccccctgcgaggaggtgagcatgaagcacgtgggcaaccagcagtacaacgtgacctacgtggtgaaggagagaggcgactacgtgctggccgtgaagtggggcgaggagcacatccccggcagccccttccacgtgaccgtgccctag

SEQ ID NO: 81756 - DNA, 7776 bp, Artificial Sequence
  Description of Artificial Sequence: Synthetic coding sequence
atgcccgtgaccgagaaggacctggccgaggacgccccctggaagaagatccagcagaacaccttcaccagatggtgcaacgagcacctgaagtgcgtgaacaagagaatcggcaacctgcagaccgacctgagcgacggcctgagactgatcgccctgctggaggtgctgagccagaagagaatgtacagaaagtaccaccagagacccaccttcagacagatgcagctggagaacgtgagcgtggccctggagttcctggacagagagagcatcaagctggtgagcatcgacagcaaggccatcgtggacggcaacctgaagctgatcctgggcctggtgtggaccctgatcctgcactacagcatcagcatgcccgtgtgggaggacgagggcgacgacgacgccaagaagcagacccccaagcagagactgctgggctggatccagaacaagatcccctacctgcccatcaccaacttcaaccagaactggcaggacggcaaggccctgggcgccctggtggacagctgcgcccccggcctgtgccccgactgggagagctgggacccccagaagcccgtggacaacgccagagaggccatgcagcaggccgacgactggctgggcgtgccccaggtgatcacccccgaggagatcatccaccccgacgtggacgagcacagcgtgatgacctacctgagccagttccccaaggccaagctgaagcccggcgcccccctgaagcccaagctgaaccccaagaaggccagagcctacggcagaggcatcgagcccaccggcaacatggtgaagcagcccgccaagttcaccgtggacaccatcagcgccggccagggcgacgtgatggtgttcgtggaggaccccgagggcaacaaggaggaggcccaggtgacccccgacagcgacaagaacaagacctacagcgtggagtacctgcccaaggtgaccggcctgcacaaggtgaccgtgctgttcgccggccagcacatcagcaagagccccttcgaggtgagcgtggacaaggcccagggcgacgccagcaaggtgaccgccaagggccccggcctggaggccgtgggcaacatcgccaacaagcccacctacttcgacatctacaccgccggcgccggcgtgggcgacatcggcgtggaggtggaggacccccagggcaagaacaccgtggagctgctggtggaggacaagggcaaccaggtgtacagatgcgtgtacaagcccatgcagcccggcccccacgtggtgaagatcttcttcgccggcgacaccatccccaagagccccttcgtggtgcaggtgggcgaggcctgcaaccccaacgcctgcagagccagcggcagaggcctgcagcccaagggcgtgagaatcagagagaccaccgacttcaaggtggacaccaaggccgccggcagcggcgagctgggcgtgaccatgaagggccccaagggcctggaggagctggtgaagcagaaggacttcctggacggcgtgtacgccttcgagtactaccccagcacccccggcagatacagcatcgccatcacctggggcggccaccacatccccaagagccccttcgaggtgcaggtgggccccgaggccggcatgcagaaggtgagagcctggggccccggcctgcacggcggcatcgtgggcagaagcgccgacttcgtggtggagagcatcggcagcgaggtgggcagcctgggcttcgccatcgagggccccagccaggccaagatcgagtacaacgaccagaacgacggcagctgcgacgtgaagtactggcccaaggagcccggcgagtacgccgtgcacatcatgtgcgacgacgaggacatcaaggacagcccctacatggccttcatccaccccgccaccggcggctacaaccccgacctggtgagagcctacggccccggcctggagaagagcggctgcatcgtgaacaacctggccgagttcaccgtggaccccaaggacgccggcaaggcccccctgaagatcttcgcccaggacggcgagggccagagaatcgacatccagatgaagaacagaatggacggcacctacgcctgcagctacacccccgtgaaggccatcaagcacaccatcgccgtggtgtggggcggcgtgaacatcccccacagcccctacagagtgaacatcggccagggcagccacccccagaaggtgaaggtgttcggccccggcgtggagagaagcggcctgaaggccaacgagcccacccacttcaccgtggactgcaccgaggccggcgagggcgacgtgagcgtgggcatcaagtgcgacgccagagtgctgagcgaggacgaggaggacgtggacttcgacatcatccacaacgccaacgacaccttcaccgtgaagtacgtgccccccgccgccggcagatacaccatcaaggtgctgttcgccagccaggagatccccgccagccccttcagagtgaaggtggaccccagccacgacgccagcaaggtgaaggccgagggccccggcctgagcaaggccggcgtggagaacggcaagcccacccacttcaccgtgtacaccaagggcgccggcaaggcccccctgaacgtgcagttcaacagccccctgcccggcgacgccgtgaaggacctggacatcatcgacaactacgactacagccacaccgtgaagtacacccccacccagcagggcaacatgcaggtgctggtgacctacggcggcgaccccatccccaagagccccttcaccgtgggcgtggccgcccccctggacctgagcaagatcaagctgaacggcctggagaacagagtggaggtgggcaaggaccaggagttcaccgtggacaccagaggcgccggcggccagggcaagctggacgtgaccatcctgagccccagcagaaaggtggtgccctgcctggtgacccccgtgaccggcagagagaacagcaccgccaagttcatccccagagaggagggcctgtacgccgtggacgtgacctacgacggccaccccgtgcccggcagcccctacaccgtggaggccagcctgccccccgaccccagcaaggtgaaggcccacggccccggcctggagggcggcctggtgggcaagcccgccgagttcaccatcgacaccaagggcgccggcaccggcggcctgggcctgaccgtggagggcccctgcgaggccaagatcgagtgcagcgacaacggcgacggcacctgcagcgtgagctacctgcccaccaagcccggcgagtacttcgtgaacatcctgttcgaggaggtgcacatccccggcagccccttcaaggccgacatcgagatgcccttcgaccccagcaaggtggtggccagcggccccggcctggagcacggcaaggtgggcgaggccggcctgctgagcgtggactgcagcgaggccggccccggcgccctgggcctggaggccgtgagcgacagcggcaccaaggccgaggtgagcatccagaacaacaaggacggcacctacgccgtgacctacgtgcccctgaccgccggcatgtacaccctgaccatgaagtacggcggcgagctggtgccccacttccccgccagagtgaaggtggagcccgccgtggacaccagcagaatcaaggtgttcggccccggcatcgagggcaaggacgtgttcagagaggccaccaccgacttcaccgtggacagcagacccctgacccaggtgggcggcgaccacatcaaggcccacatcgccaaccccagcggcgccagcaccgagtgcttcgtgaccgacaacgccgacggcacctaccaggtggagtacacccccttcgagaagggcctgcacgtggtggaggtgacctacgacgacgtgcccatccccaacagccccttcaaggtggccgtgaccgagggctgccagcccagcagagtgcaggcccagggccccggcctgaaggaggccttcaccaacaagcccaacgtgttcaccgtggtgaccagaggcgccggcatcggcggcctgggcatcaccgtggagggccccagcgagagcaagatcaactgcagagacaacaaggacggcagctgcagcgccgagtacatccccttcgcccccggcgactacgacgtgaacatcacctacggcggcgcccacatccccggcagccccttcagagtgcccgtgaaggacgtggtggaccccagcaaggtgaagatcgccggccccggcctgggcagcggcgtgagagccagagtgctgcagagcttcaccgtggacagcagcaaggccggcctggcccccctggaggtgagagtgctgggccccagaggcctggtggagcccgtgaacgtggtggacaacggcgacggcacccacaccgtgacctacacccccagccaggagggcccctacatggtgagcgtgaagtacgccgacgaggagatccccagaagccccttcaaggtgaaggtgctgcccacctacgacgccagcaaggtgaccgccagcggccccggcctgagcagctacggcgtgcccgccagcctgcccgtggacttcgccatcgacgccagagacgccggcgagggcctgctggccgtgcagatcaccgaccaggagggcaagcccaagagagccatcgtgcacgacaacaaggacggcacctacgccgtgacctacatccccgacaagaccggcagatacatgatcggcgtgacctacggcggcgacgacatccccctgagcccctacagaatcagagccacccagaccggcgacgccagcaagtgcctggccaccggccccggcatcgccagcaccgtgaagaccggcgaggaggtgggcttcgtggtggacgccaagaccgccggcaagggcaaggtgacctgcaccgtgctgacccccgacggcaccgaggccgaggccgacgtgatcgagaacgaggacggcacctacgacatcttctacaccgccgccaagcccggcacctacgtgatctacgtgagattcggcggcgtggacatccccaacagccccttcaccgtgatggccaccgacggcgaggtgaccgccgtggaggaggcccccgtgaccgaggaggcctacgtgcccgtgagcgacatgaacggcctgggcttcaagcccttcgacctggtgatccccttcgccgtgagaaagggcgagatcaccggcgaggtgcacatgcccagcggcaagaccgccacccccgagatcgtggacaacaaggacggcaccgtgaccgtgagatacgcccccaccgaggtgggcctgcacgagatgcacatcaagtacatgggcagccacatccccgagagccccctgcagttctacgtgaactaccccaacagcggcagcgtgagcgcctacggccccggcctggtgtacggcgtggccaacaagaccgccaccttcaccatcgtgaccgaggacgccggcgagggcggcctggacctggccatcgagggccccagcaaggccgagatcagctgcatcgacaacaaggacggcacctgcaccgtgacctacctgcccaccctgcccggcgactacagcatcctggtgaagtacaacgacaagcacatccccggcagccccttcaccgccaagatcaccgacgacagcagaagatgcagccaggtgaagctgggcagcgccgccgacttcctgctggacatcagcgagaccgacctgagcagcctgaccgccagcatcaaggcccccagcggcagagacgagccctgcctgctgaagagactgcccaacaaccacatcggcatcagcttcatccccagagaggtgggcgagcacctggtgagcatcaagaagaacggcaaccacgtggccaacagccccgtgagcatcatggtggtgcagagcgagatcggcgacgccagaagagccaaggtgtacggcagaggcctgagcgagggcagaaccttcgagatgagcgacttcatcgtggacaccagagacgccggctacggcggcatcagcctggccgtggagggccccagcaaggtggacatccagaccgaggacctggaggacggcacctgcaaggtgagctacttccccaccgtgcccggcgtgtacatcgtgagcaccaagttcgccgacgagcacgtgcccggcagccccttcaccgtgaagatcagcggcgagggcagagtgaaggagagcatcaccagaaccagcagagcccccagcgtggccaccgtgggcagcatctgcgacctgaacctgaagatccccgagatcaacagcagcgacatgagcgcccacgtgaccagccccagcggcagagtgaccgaggccgagatcgtgcccatgggcaagaacagccactgcgtgagattcgtgccccaggagatgggcgtgcacaccgtgagcgtgaagtacagaggccagcacgtgaccggcagccccttccagttcaccgtgggccccctgggcgagggcggcgcccacaaggtgagagccggcggccccggcctggagagaggcgaggccggcgtgcccgccgagttcagcatctggaccagagaggccggcgccggcggcctgagcatcgccgtggagggccccagcaaggccgagatcaccttcgacgaccacaagaacggcagctgcggcgtgagctacatcgcccaggagcccggcaactacgaggtgagcatcaagttcaacgacgagcacatccccgagagcccctacctggtgcccgtgatcgcccccagcgacgacgccagaagactgaccgtgatgagcctgcaggagagcggcctgaaggtgaaccagcccgccagcttcgccatcagactgaacggcgccaagggcaagatcgacgccaaggtgcacagccccagcggcgccgtggaggagtgccacgtgagcgagctggagcccgacaagtacgccgtgagattcatcccccacgagaacggcgtgcacaccatcgacgtgaagttcaacggcagccacgtggtgggcagccccttcaaggtgagagtgggcgagcccggccaggccggcaaccccgccctggtgagcgcctacggcaccggcctggagggcggcaccaccggcatccagagcgagttcttcatcaacaccaccagagccggccccggcaccctgagcgtgaccatcgagggccccagcaaggtgaagatggactgccaggagacccccgagggctacaaggtgatgtacacccccatggcccccggcaactacctgatcagcgtgaagtacggcggccccaaccacatcgtgggcagccccttcaaggccaaggtgaccggccagagactggtgagccccggcagcgccaacgagaccagcagcatcctggtggagagcgtgaccagaagcagcaccgagacctgctacagcgccatccccaaggccagcagcgacgccagcaaggtgaccagcaagggcgccggcctgagcaaggccttcgtgggccagaagagcagcttcctggtggactgcagcaaggccggcagcaacatgctgctgatcggcgtgcacggccccaccaccccctgcgaggaggtgagcatgaagcacgtgggcaaccagcagtacaacgtgacctacgtggtgaaggagagaggcgactacgtgctggccgtgaagtggggcgaggagcacatccccggcagccccttccacgtgaccgtgccctag

SEQ ID NO: 81757 - DNA, 408 bp, Artificial Sequence
  Description of Artificial Sequence: Synthetic coding sequence
tgactggccgtggagggccccagcaaggtggacatccagaccgaggacctggaggacggcacctgcaaggtgagctacttccccaccgtgcccggcgtgtacatcgtgagcaccaagttcgccgacgagcacgtgcccgagatcaacagcagcgacatgagcgcccacgtgaccagccccagcggcagagtgaccgaggccgagatcgtgcccatgggcaagaacagccactgcgtgagattcgtgccccaggagatgggcgtgcacaccgtgagcgtgaagtacagaggccagcacgtgaccggcagccccttccagttcaccgtgggccccctgggcgagggcggcgcccacaaggtgagagccggcggccccggcctggagagaggcgaggccggcgtgccctag

SEQ ID NO: 81758 - DNA, 7902 bp, Artificial Sequence
  Description of Artificial Sequence: Synthetic coding sequence
atgcccgtgaccgagaaggacctggccgaggacgccccctggaagaagatccagcagaacaccttcaccagatggtgcaacgagcacctgaagtgcgtgaacaagagaatcggcaacctgcagaccgacctgagcgacggcctgagactgatcgccctgctggaggtgctgagccagaagagaatgtacagaaagtaccaccagagacccaccttcagacagatgcagctggagaacgtgagcgtggccctggagttcctggacagagagagcatcaagctggtgagcatcgacagcaaggccatcgtggacggcaacctgaagctgatcctgggcctggtgtggaccctgatcctgcactacagcatcagcatgcccgtgtgggaggacgagggcgacgacgacgccaagaagcagacccccaagcagagactgctgggctggatccagaacaagatcccctacctgcccatcaccaacttcaaccagaactggcaggacggcaaggccctgggcgccctggtggacagctgcgcccccggcctgtgccccgactgggagagctgggacccccagaagcccgtggacaacgccagagaggccatgcagcaggccgacgactggctgggcgtgccccaggtgatcacccccgaggagatcatccaccccgacgtggacgagcacagcgtgatgacctacctgagccagttccccaaggccaagctgaagcccggcgcccccctgaagcccaagctgaaccccaagaaggccagagcctacggcagaggcatcgagcccaccggcaacatggtgaagcagcccgccaagttcaccgtggacaccatcagcgccggccagggcgacgtgatggtgttcgtggaggaccccgagggcaacaaggaggaggcccaggtgacccccgacagcgacaagaacaagacctacagcgtggagtacctgcccaaggtgaccggcctgcacaaggtgaccgtgctgttcgccggccagcacatcagcaagagccccttcgaggtgagcgtggacaaggcccagggcgacgccagcaaggtgaccgccaagggccccggcctggaggccgtgggcaacatcgccaacaagcccacctacttcgacatctacaccgccggcgccggcgtgggcgacatcggcgtggaggtggaggacccccagggcaagaacaccgtggagctgctggtggaggacaagggcaaccaggtgtacagatgcgtgtacaagcccatgcagcccggcccccacgtggtgaagatcttcttcgccggcgacaccatccccaagagccccttcgtggtgcaggtgggcgaggcctgcaaccccaacgcctgcagagccagcggcagaggcctgcagcccaagggcgtgagaatcagagagaccaccgacttcaaggtggacaccaaggccgccggcagcggcgagctgggcgtgaccatgaagggccccaagggcctggaggagctggtgaagcagaaggacttcctggacggcgtgtacgccttcgagtactaccccagcacccccggcagatacagcatcgccatcacctggggcggccaccacatccccaagagccccttcgaggtgcaggtgggccccgaggccggcatgcagaaggtgagagcctggggccccggcctgcacggcggcatcgtgggcagaagcgccgacttcgtggtggagagcatcggcagcgaggtgggcagcctgggcttcgccatcgagggccccagccaggccaagatcgagtacaacgaccagaacgacggcagctgcgacgtgaagtactggcccaaggagcccggcgagtacgccgtgcacatcatgtgcgacgacgaggacatcaaggacagcccctacatggccttcatccaccccgccaccggcggctacaaccccgacctggtgagagcctacggccccggcctggagaagagcggctgcatcgtgaacaacctggccgagttcaccgtggaccccaaggacgccggcaaggcccccctgaagatcttcgcccaggacggcgagggccagagaatcgacatccagatgaagaacagaatggacggcacctacgcctgcagctacacccccgtgaaggccatcaagcacaccatcgccgtggtgtggggcggcgtgaacatcccccacagcccctacagagtgaacatcggccagggcagccacccccagaaggtgaaggtgttcggccccggcgtggagagaagcggcctgaaggccaacgagcccacccacttcaccgtggactgcaccgaggccggcgagggcgacgtgagcgtgggcatcaagtgcgacgccagagtgctgagcgaggacgaggaggacgtggacttcgacatcatccacaacgccaacgacaccttcaccgtgaagtacgtgccccccgccgccggcagatacaccatcaaggtgctgttcgccagccaggagatccccgccagccccttcagagtgaaggtggaccccagccacgacgccagcaaggtgaaggccgagggccccggcctgagcaaggccggcgtggagaacggcaagcccacccacttcaccgtgtacaccaagggcgccggcaaggcccccctgaacgtgcagttcaacagccccctgcccggcgacgccgtgaaggacctggacatcatcgacaactacgactacagccacaccgtgaagtacacccccacccagcagggcaacatgcaggtgctggtgacctacggcggcgaccccatccccaagagccccttcaccgtgggcgtggccgcccccctggacctgagcaagatcaagctgaacggcctggagaacagagtggaggtgggcaaggaccaggagttcaccgtggacaccagaggcgccggcggccagggcaagctggacgtgaccatcctgagccccagcagaaaggtggtgccctgcctggtgacccccgtgaccggcagagagaacagcaccgccaagttcatccccagagaggagggcctgtacgccgtggacgtgacctacgacggccaccccgtgcccggcagcccctacaccgtggaggccagcctgccccccgaccccagcaaggtgaaggcccacggccccggcctggagggcggcctggtgggcaagcccgccgagttcaccatcgacaccaagggcgccggcaccggcggcctgggcctgaccgtggagggcccctgcgaggccaagatcgagtgcagcgacaacggcgacggcacctgcagcgtgagctacctgcccaccaagcccggcgagtacttcgtgaacatcctgttcgaggaggtgcacatccccggcagccccttcaaggccgacatcgagatgcccttcgaccccagcaaggtggtggccagcggccccggcctggagcacggcaaggtgggcgaggccggcctgctgagcgtggactgcagcgaggccggccccggcgccctgggcctggaggccgtgagcgacagcggcaccaaggccgaggtgagcatccagaacaacaaggacggcacctacgccgtgacctacgtgcccctgaccgccggcatgtacaccctgaccatgaagtacggcggcgagctggtgccccacttccccgccagagtgaaggtggagcccgccgtggacaccagcagaatcaaggtgttcggccccggcatcgagggcaaggacgtgttcagagaggccaccaccgacttcaccgtggacagcagacccctgacccaggtgggcggcgaccacatcaaggcccacatcgccaaccccagcggcgccagcaccgagtgcttcgtgaccgacaacgccgacggcacctaccaggtggagtacacccccttcgagaagggcctgcacgtggtggaggtgacctacgacgacgtgcccatccccaacagccccttcaaggtggccgtgaccgagggctgccagcccagcagagtgcaggcccagggccccggcctgaaggaggccttcaccaacaagcccaacgtgttcaccgtggtgaccagaggcgccggcatcggcggcctgggcatcaccgtggagggccccagcgagagcaagatcaactgcagagacaacaaggacggcagctgcagcgccgagtacatccccttcgcccccggcgactacgacgtgaacatcacctacggcggcgcccacatccccggcagccccttcagagtgcccgtgaaggacgtggtggaccccagcaaggtgaagatcgccggccccggcctgggcagcggcgtgagagccagagtgctgcagagcttcaccgtggacagcagcaaggccggcctggcccccctggaggtgagagtgctgggccccagagccgacgacaccgacagccagagctggagaagccccctgaaggccctgagcgagttcttcaagggcgaccccaagggcgacttcaacaagaccggcctggtggagcccgtgaacgtggtggacaacggcgacggcacccacaccgtgacctacacccccagccaggagggcccctacatggtgagcgtgaagtacgccgacgaggagatccccagaagccccttcaaggtgaaggtgctgcccacctacgacgccagcaaggtgaccgccagcggccccggcctgagcagctacggcgtgcccgccagcctgcccgtggacttcgccatcgacgccagagacgccggcgagggcctgctggccgtgcagatcaccgaccaggagggcaagcccaagagagccatcgtgcacgacaacaaggacggcacctacgccgtgacctacatccccgacaagaccggcagatacatgatcggcgtgacctacggcggcgacgacatccccctgagcccctacagaatcagagccacccagaccggcgacgccagcaagtgcctggccaccggccccggcatcgccagcaccgtgaagaccggcgaggaggtgggcttcgtggtggacgccaagaccgccggcaagggcaaggtgacctgcaccgtgctgacccccgacggcaccgaggccgaggccgacgtgatcgagaacgaggacggcacctacgacatcttctacaccgccgccaagcccggcacctacgtgatctacgtgagattcggcggcgtggacatccccaacagccccttcaccgtgatggccaccgacggcgaggtgaccgccgtggaggaggcccccgtgaacgcctgcccccccggcttcagaccctgggtgaccgaggaggcctacgtgcccgtgagcgacatgaacggcctgggcttcaagcccttcgacctggtgatccccttcgccgtgagaaagggcgagatcaccggcgaggtgcacatgcccagcggcaagaccgccacccccgagatcgtggacaacaaggacggcaccgtgaccgtgagatacgcccccaccgaggtgggcctgcacgagatgcacatcaagtacatgggcagccacatccccgagagccccctgcagttctacgtgaactaccccaacagcggcagcgtgagcgcctacggccccggcctggtgtacggcgtggccaacaagaccgccaccttcaccatcgtgaccgaggacgccggcgagggcggcctggacctggccatcgagggccccagcaaggccgagatcagctgcatcgacaacaaggacggcacctgcaccgtgacctacctgcccaccctgcccggcgactacagcatcctggtgaagtacaacgacaagcacatccccggcagccccttcaccgccaagatcaccgacgacagcagaagatgcagccaggtgaagctgggcagcgccgccgacttcctgctggacatcagcgagaccgacctgagcagcctgaccgccagcatcaaggcccccagcggcagagacgagccctgcctgctgaagagactgcccaacaaccacatcggcatcagcttcatccccagagaggtgggcgagcacctggtgagcatcaagaagaacggcaaccacgtggccaacagccccgtgagcatcatggtggtgcagagcgagatcggcgacgccagaagagccaaggtgtacggcagaggcctgagcgagggcagaaccttcgagatgagcgacttcatcgtggacaccagagacgccggctacggcggcatcagcctggccgtggagggccccagcaaggtggacatccagaccgaggacctggaggacggcacctgcaaggtgagctacttccccaccgtgcccggcgtgtacatcgtgagcaccaagttcgccgacgagcacgtgcccggcagccccttcaccgtgaagatcagcggcgagggcagagtgaaggagagcatcaccagaaccagcagagcccccagcgtggccaccgtgggcagcatctgcgacctgaacctgaagatccccgagatcaacagcagcgacatgagcgcccacgtgaccagccccagcggcagagtgaccgaggccgagatcgtgcccatgggcaagaacagccactgcgtgagattcgtgccccaggagatgggcgtgcacaccgtgagcgtgaagtacagaggccagcacgtgaccggcagccccttccagttcaccgtgggccccctgggcgagggcggcgcccacaaggtgagagccggcggccccggcctggagagaggcgaggccggcgtgcccgccgagttcagcatctggaccagagaggccggcgccggcggcctgagcatcgccgtggagggccccagcaaggccgagatcaccttcgacgaccacaagaacggcagctgcggcgtgagctacatcgcccaggagcccggcaactacgaggtgagcatcaagttcaacgacgagcacatccccgagagcccctacctggtgcccgtgatcgcccccagcgacgacgccagaagactgaccgtgatgagcctgcaggagagcggcctgaaggtgaaccagcccgccagcttcgccatcagactgaacggcgccaagggcaagatcgacgccaaggtgcacagccccagcggcgccgtggaggagtgccacgtgagcgagctggagcccgacaagtacgccgtgagattcatcccccacgagaacggcgtgcacaccatcgacgtgaagttcaacggcagccacgtggtgggcagccccttcaaggtgagagtgggcgagcccggccaggccggcaaccccgccctggtgagcgcctacggcaccggcctggagggcggcaccaccggcatccagagcgagttcttcatcaacaccaccagagccggccccggcaccctgagcgtgaccatcgagggccccagcaaggtgaagatggactgccaggagacccccgagggctacaaggtgatgtacacccccatggcccccggcaactacctgatcagcgtgaagtacggcggccccaaccacatcgtgggcagccccttcaaggccaaggtgaccggccagagactggtgagccccggcagcgccaacgagaccagcagcatcctggtggagagcgtgaccagaagcagcaccgagacctgctacagcgccatccccaaggccagcagcgacgccagcaaggtgaccagcaagggcgccggcctgagcaaggccttcgtgggccagaagagcagcttcctggtggactgcagcaaggccggcagcaacatgctgctgatcggcgtgcacggccccaccaccccctgcgaggaggtgagcatgaagcacgtgggcaaccagcagtacaacgtgacctacgtggtgaaggagagaggcgactacgtgctggccgtgaagtggggcgaggagcacatccccggcagccccttccacgtgaccgtgccctag

SEQ ID NO: 81759 - DNA, 8178 bp, Artificial Sequence
  Description of Artificial Sequence: Synthetic coding sequence
atgatgaacaacagcggctacagcgacgccggcctgggcctgggcgacgagaccgacgagatgcccagcaccgagaaggacctggccgaggacgccccctggaagaagatccagcagaacaccttcaccagatggtgcaacgagcacctgaagtgcgtgggcaagagactgaccgacctgcagagagacctgagcgacggcctgagactgatcgccctgctggaggtgctgagccagaagagaatgtacagaaagttccaccccagacccaacttcagacagatgaagctggagaacgtgagcgtggccctggagttcctggagagagagcacatcaagctggtgagcatcgacagcaaggccatcgtggacggcaacctgaagctgatcctgggcctgatctggaccctgatcctgcactacagcatcagcatgcccatgtgggaggacgaggacgacgaggacgccagaaagcagacccccaagcagagactgctgggctggatccagaacaaggtgccccagctgcccatcaccaacttcaacagagactggcaggacggcaaggccctgggcgccctggtggacaactgcgcccccggcctgtgccccgactgggaggcctgggaccccaaccagcccgtggagaacgccagagaggccatgcagcaggccgacgactggctgggcgtgccccaggtgatcgcccccgaggagatcgtggaccccaacgtggacgagcacagcgtgatgacctacctgagccagttccccaaggccaagctgaagcccggcgcccccgtgagaagcaagcagctgaaccccaagaaggccatcgcctacggccccggcatcgagccccagggcaacaccgtgctgcagcccgcccacttcaccgtgcagaccgtggacgccggcgtgggcgaggtgctggtgtacatcgaggaccccgagggccacaccgaggaggccaaggtggtgcccaacaacgacaaggacagaacctacgccgtgagctacgtgcccaaggtggccggcctgcacaaggtgaccgtgctgttcgccggccagaacatcgagagaagccccttcgaggtgaacgtgggcatggccctgggcgacgccaacaaggtgagcgccagaggccccggcctggagcccgtgggcaacgtggccaacaagcccacctacttcgacatctacaccgccggcgccggcaccggcgacgtggccgtggtgatcgtggacccccagggcagaagagacaccgtggaggtggccctggaggacaagggcgacagcaccttcagatgcacctacagacccgccatggagggcccccacaccgtgcacgtggccttcgccggcgcccccatcaccagaagccccttccccgtgcacgtgagcgaggcctgcaaccccaacgcctgcagagccagcggcagaggcctgcagcccaagggcgtgagagtgaaggaggtggccgacttcaaggtgttcaccaagggcgccggcagcggcgagctgaaggtgaccgtgaagggccccaagggcaccgaggagcccgtgaaggtgagagaggccggcgacggcgtgttcgagtgcgagtactaccccgtggtgcccggcaagtacgtggtgaccatcacctggggcggctacgccatccccagaagccccttcgaggtgcaggtgagccccgaggccggcgtgcagaaggtgagagcctggggccccggcctggagaccggccaggtgggcaagagcgccgacttcgtggtggaggccatcggcaccgaggtgggcaccctgggcttcagcatcgagggccccagccaggccaagatcgagtgcgacgacaagggcgacggcagctgcgacgtgagatactggcccaccgagcccggcgagtacgccgtgcacgtgatctgcgacgacgaggacatcagagacagccccttcatcgcccacatcctgcccgccccccccgactgcttccccgacaaggtgaaggccttcggccccggcctggagcccaccggctgcatcgtggacaagcccgccgagttcaccatcgacgccagagccgccggcaagggcgacctgaagctgtacgcccaggacgccgacggctgccccatcgacatcaaggtgatccccaacggcgacggcaccttcagatgcagctacgtgcccaccaagcccatcaagcacaccatcatcatcagctggggcggcgtgaacgtgcccaagagccccttcagagtgaacgtgggcgagggcagccaccccgagagagtgaaggtgtacggccccggcgtggagaagaccggcctgaaggccaacgagcccacctacttcaccgtggactgcagcgaggccggccagggcgacgtgagcatcggcatcaagtgcgcccccggcgtggtgggccccgccgaggccgacatcgacttcgacatcatcaagaacgacaacgacaccttcaccgtgaagtacaccccccccggcgccggcagatacaccatcatggtgctgttcgccaaccaggagatccccgccagccccttccacatcaaggtggaccccagccacgacgccagcaaggtgaaggccgagggccccggcctgaacagaaccggcgtggaggtgggcaagcccacccacttcaccgtgctgaccaagggcgccggcaaggccaagctggacgtgcagttcgccggcaccgccaagggcgaggtggtgagagacttcgagatcatcgacaaccacgactacagctacaccgtgaagtacaccgccgtgcagcagggcaacatggccgtgaccgtgacctacggcggcgaccccgtgcccaagagccccttcgtggtgaacgtggccccccccctggacctgagcaagatcaaggtgcagggcctgaacagcaaggtggccgtgggccaggagcaggccttcagcgtgaacaccagaggcgccggcggccagggccagctggacgtgagaatgaccagccccagcagaagacccatcccctgcaagctggagcccggcggcggcgccgaggcccaggccgtgagatacatgccccccgaggagggcccctacaaggtggacatcacctacgacggccaccccgtgcccggcagccccttcgccgtggagggcgtgctgccccccgaccccagcaaggtgtgcgcctacggccccggcctgaagggcggcctggtgggcacccccgcccccttcagcatcgacaccaagggcgccggcaccggcggcctgggcctgaccgtggagggcccctgcgaggccaagatcgagtgccaggacaacggcgacggcagctgcgccgtgagctacctgcccaccgagcccggcgagtacaccatcaacatcctgttcgccgaggcccacatccccggcagccccttcaaggccaccatcagacccgtgttcgaccccagcaaggtgagagccagcggccccggcctggagagaggcaaggtgggcgaggccgccaccttcaccgtggactgcagcgaggccggcgaggccgagctgaccatcgagatcctgagcgacgccggcgtgaaggccgaggtgctgatccacaacaacgccgacggcacctaccacatcacctacagccccgccttccccggcacctacaccatcaccatcaagtacggcggccaccccgtgcccaagttccccaccagagtgcacgtgcagcccgccgtggacaccagcggcgtgaaggtgagcggccccggcgtggagccccacggcgtgctgagagaggtgaccaccgagttcaccgtggacgccagaagcctgaccgccaccggcggcaaccacgtgaccgccagagtgctgaaccccagcggcgccaagaccgacacctacgtgaccgacaacggcgacggcacctacagagtgcagtacaccgcctacgaggagggcgtgcacctggtggaggtgctgtacgacgaggtggccgtgcccaagagccccttcagagtgggcgtgaccgagggctgcgaccccaccagagtgagagccttcggccccggcctggagggcggcctggtgaacaaggccaacagattcaccgtggagaccagaggcgccggcaccggcggcctgggcctggccatcgagggccccagcgaggccaagatgagctgcaaggacaacaaggacggcagctgcaccgtggagtacatccccttcacccccggcgactacgacgtgaacatcaccttcggcggcagacccatccccggcagccccttcagagtgcccgtgaaggacgtggtggaccccggcaaggtgaagtgcagcggccccggcctgggcgccggcgtgagagccagagtgccccagaccttcaccgtggactgcagccaggccggcagagcccccctgcaggtggccgtgctgggccccaccggcgtggccgagcccgtggaggtgagagacaacggcgacggcacccacaccgtgcactacacccccgccaccgacggcccctacaccgtggccgtgaagtacgccgaccaggaggtgcccagaagccccttcaagatcaaggtgctgcccgcccacgacgccagcaaggtgagagccagcggccccggcctgaacgccagcggcatccccgccagcctgcccgtggagttcaccatcgacgccagagacgccggcgagggcctgctgaccgtgcagatcctggaccccgagggcaagcccaagaaggccaacatcagagacaacggcgacggcacctacaccgtgagctacctgcccgacatgagcggcagatacaccatcaccatcaagtacggcggcgacgagatcccctacagccccttcagaatccacgccctgcccaccggcgacgccagcaagtgcctggtgaccgtgagcatcggcggccacggcctgggcgcctgcctgggccccagaatccagatcggccaggagaccgtgatcaccgtggacgccaaggccgccggcgagggcaaggtgacctgcaccgtgagcacccccgacggcgccgagctggacgtggacgtggtggagaaccacgacggcaccttcgacatctactacaccgcccccgagcccggcaagtacgtgatcaccatcagattcggcggcgagcacatccccaacagccccttccacgtgctggcctgcgaccccctgccccacgaggaggagcccagcgaggtgccccagctgagacagccctacgccccccccagacccggcgccagacccacccactgggccaccgaggagcccgtggtgcccgtggagcccatggagagcatgctgagacccttcaacctggtgatccccttcgccgtgcagaagggcgagctgaccggcgaggtgagaatgcccagcggcaagaccgccagacccaacatcaccgacaacaaggacggcaccatcaccgtgagatacgcccccaccgagaagggcctgcaccagatgggcatcaagtacgacggcaaccacatccccggcagccccctgcagttctacgtggacgccatcaacagcagacacgtgagcgcctacggccccggcctgagccacggcatggtgaacaagcccgccaccttcaccatcgtgaccaaggacgccggcgagggcggcctgagcctggccgtggagggccccagcaaggccgagatcacctgcaaggacaacaaggacggcacctgcaccgtgagctacctgcccaccgcccccggcgactacagcatcatcgtgagattcgacgacaagcacatccccggcagccccttcaccgccaagatcaccggcgacgacagcatgagaaccagccagctgaacgtgggcaccagcaccgacgtgagcctgaagatcaccgagagcgacctgagccagctgaccgccagcatcagagcccccagcggcaacgaggagccctgcctgctgaagagactgcccaacagacacatcggcatcagcttcacccccaaggaggtgggcgagcacgtggtgagcgtgagaaagagcggcaagcacgtgaccaacagccccttcaagatcctggtgggccccagcgagatcggcgacgccagcaaggtgagagtgtggggcaagggcctgagcgagggccacaccttccaggtggccgagttcatcgtggacaccagaaacgccggctacggcggcctgggcctgagcatcgagggccccagcaaggtggacatcaactgcgaggacatggaggacggcacctgcaaggtgacctactgccccaccgagcccggcacctacatcatcaacatcaagttcgccgacaagcacgtgcccggcagccccttcaccgtgaaggtgaccggcgagggcagaatgaaggagagcatcaccagaagaagacaggcccccagcatcgccaccatcggcagcacctgcgacctgaacctgaagatccccggcaactggttccagatggtgagcgcccaggagagactgaccagaaccttcaccagaagcagccacacctacaccagaaccgagagaaccgagatcagcaagaccagaggcggcgagaccaagagagaggtgagagtggaggagagcacccaggtgggcggcgaccccttccccgccgtgttcggcgacttcctgggcagagagagactgggcagcttcggcagcatcaccagacagcaggagggcgaggccagcagccaggacatgaccgcccaggtgaccagccccagcggcaaggtggaggccgccgagatcgtggagggcgaggacagcgcctacagcgtgagattcgtgccccaggagatgggcccccacaccgtggccgtgaagtacagaggccagcacgtgcccggcagccccttccagttcaccgtgggccccctgggcgagggcggcgcccacaaggtgagagccggcggcaccggcctggagagaggcgtggccggcgtgcccgccgagttcagcatctggaccagagaggccggcgccggcggcctgagcatcgccgtggagggccccagcaaggccgagatcgccttcgaggacagaaaggacggcagctgcggcgtgagctacgtggtgcaggagcccggcgactacgaggtgagcatcaagttcaacgacgagcacatccccgacagccccttcgtggtgcccgtggccagcctgagcgacgacgccagaagactgaccgtgaccagcctgcaggagaccggcctgaaggtgaaccagcccgccagcttcgccgtgcagctgaacggcgccagaggcgtgatcgacgccagagtgcacacccccagcggcgccgtggaggagtgctacgtgagcgagctggacagcgacaagcacaccatcagattcatcccccacgagaacggcgtgcacagcatcgacgtgaagttcaacggcgcccacatccccggcagccccttcaagatcagagtgggcgagcagagccaggccggcgaccccggcctggtgagcgcctacggccccggcctggagggcggcaccaccggcgtgagcagcgagttcatcgtgaacaccctgaacgccggcagcggcgccctgagcgtgaccatcgacggccccagcaaggtgcagctggactgcagagagtgccccgagggccacgtggtgacctacacccccatggcccccggcaactacctgatcgccatcaagtacggcggcccccagcacatcgtgggcagccccttcaaggccaaggtgaccggccccagactgagcggcggccacagcctgcacgagaccagcaccgtgctggtggagaccgtgaccaagagcagcagcagcagaggcagcagctacagcagcatccccaagttcagcagcgacgccagcaaggtggtgaccagaggccccggcctgagccaggccttcgtgggccagaagaacagcttcaccgtggactgcagcaaggccggcaccaacatgatgatggtgggcgtgcacggccccaagaccccctgcgaggaggtgtacgtgaagcacatgggcaacagagtgtacaacgtgacctacaccgtgaaggagaagggcgactacatcctgatcgtgaagtggggcgacgagagcgtgcccggcagccccttcaaggtgaaggtgccctag

SEQ ID NO: 81760 - DNA, 8079 bp, Artificial Sequence
  Description of Artificial Sequence: Synthetic coding sequence
atgatgaacaacagcggctacagcgacgccggcctgggcctgggcgacgagaccgacgagatgcccagcaccgagaaggacctggccgaggacgccccctggaagaagatccagcagaacaccttcaccagatggtgcaacgagcacctgaagtgcgtgggcaagagactgaccgacctgcagagagacctgagcgacggcctgagactgatcgccctgctggaggtgctgagccagaagagaatgtacagaaagttccaccccagacccaacttcagacagatgaagctggagaacgtgagcgtggccctggagttcctggagagagagcacatcaagctggtgagcatcgacagcaaggccatcgtggacggcaacctgaagctgatcctgggcctgatctggaccctgatcctgcactacagcatcagcatgcccatgtgggaggacgaggacgacgaggacgccagaaagcagacccccaagcagagactgctgggctggatccagaacaaggtgccccagctgcccatcaccaacttcaacagagactggcaggacggcaaggccctgggcgccctggtggacaactgcgcccccggcctgtgccccgactgggaggcctgggaccccaaccagcccgtggagaacgccagagaggccatgcagcaggccgacgactggctgggcgtgccccaggtgatcgcccccgaggagatcgtggaccccaacgtggacgagcacagcgtgatgacctacctgagccagttccccaaggccaagctgaagcccggcgcccccgtgagaagcaagcagctgaaccccaagaaggccatcgcctacggccccggcatcgagccccagggcaacaccgtgctgcagcccgcccacttcaccgtgcagaccgtggacgccggcgtgggcgaggtgctggtgtacatcgaggaccccgagggccacaccgaggaggccaaggtggtgcccaacaacgacaaggacagaacctacgccgtgagctacgtgcccaaggtggccggcctgcacaaggtgaccgtgctgttcgccggccagaacatcgagagaagccccttcgaggtgaacgtgggcatggccctgggcgacgccaacaaggtgagcgccagaggccccggcctggagcccgtgggcaacgtggccaacaagcccacctacttcgacatctacaccgccggcgccggcaccggcgacgtggccgtggtgatcgtggacccccagggcagaagagacaccgtggaggtggccctggaggacaagggcgacagcaccttcagatgcacctacagacccgccatggagggcccccacaccgtgcacgtggccttcgccggcgcccccatcaccagaagccccttccccgtgcacgtgagcgaggcctgcaaccccaacgcctgcagagccagcggcagaggcctgcagcccaagggcgtgagagtgaaggaggtggccgacttcaaggtgttcaccaagggcgccggcagcggcgagctgaaggtgaccgtgaagggccccaagggcaccgaggagcccgtgaaggtgagagaggccggcgacggcgtgttcgagtgcgagtactaccccgtggtgcccggcaagtacgtggtgaccatcacctggggcggctacgccatccccagaagccccttcgaggtgcaggtgagccccgaggccggcgtgcagaaggtgagagcctggggccccggcctggagaccggccaggtgggcaagagcgccgacttcgtggtggaggccatcggcaccgaggtgggcaccctgggcttcagcatcgagggccccagccaggccaagatcgagtgcgacgacaagggcgacggcagctgcgacgtgagatactggcccaccgagcccggcgagtacgccgtgcacgtgatctgcgacgacgaggacatcagagacagccccttcatcgcccacatcctgcccgccccccccgactgcttccccgacaaggtgaaggccttcggccccggcctggagcccaccggctgcatcgtggacaagcccgccgagttcaccatcgacgccagagccgccggcaagggcgacctgaagctgtacgcccaggacgccgacggctgccccatcgacatcaaggtgatccccaacggcgacggcaccttcagatgcagctacgtgcccaccaagcccatcaagcacaccatcatcatcagctggggcggcgtgaacgtgcccaagagccccttcagagtgaacgtgggcgagggcagccaccccgagagagtgaaggtgtacggccccggcgtggagaagaccggcctgaaggccaacgagcccacctacttcaccgtggactgcagcgaggccggccagggcgacgtgagcatcggcatcaagtgcgcccccggcgtggtgggccccgccgaggccgacatcgacttcgacatcatcaagaacgacaacgacaccttcaccgtgaagtacaccccccccggcgccggcagatacaccatcatggtgctgttcgccaaccaggagatccccgccagccccttccacatcaaggtggaccccagccacgacgccagcaaggtgaaggccgagggccccggcctgaacagaaccggcgtggaggtgggcaagcccacccacttcaccgtgctgaccaagggcgccggcaaggccaagctggacgtgcagttcgccggcaccgccaagggcgaggtggtgagagacttcgagatcatcgacaaccacgactacagctacaccgtgaagtacaccgccgtgcagcagggcaacatggccgtgaccgtgacctacggcggcgaccccgtgcccaagagccccttcgtggtgaacgtggccccccccctggacctgagcaagatcaaggtgcagggcctgaacagcaaggtggccgtgggccaggagcaggccttcagcgtgaacaccagaggcgccggcggccagggccagctggacgtgagaatgaccagccccagcagaagacccatcccctgcaagctggagcccggcggcggcgccgaggcccaggccgtgagatacatgccccccgaggagggcccctacaaggtggacatcacctacgacggccaccccgtgcccggcagccccttcgccgtggagggcgtgctgccccccgaccccagcaaggtgtgcgcctacggccccggcctgaagggcggcctggtgggcacccccgcccccttcagcatcgacaccaagggcgccggcaccggcggcctgggcctgaccgtggagggcccctgcgaggccaagatcgagtgccaggacaacggcgacggcagctgcgccgtgagctacctgcccaccgagcccggcgagtacaccatcaacatcctgttcgccgaggcccacatccccggcagccccttcaaggccaccatcagacccgtgttcgaccccagcaaggtgagagccagcggccccggcctggagagaggcaaggtgggcgaggccgccaccttcaccgtggactgcagcgaggccggcgaggccgagctgaccatcgagatcctgagcgacgccggcgtgaaggccgaggtgctgatccacaacaacgccgacggcacctaccacatcacctacagccccgccttccccggcacctacaccatcaccatcaagtacggcggccaccccgtgcccaagttccccaccagagtgcacgtgcagcccgccgtggacaccagcggcgtgaaggtgagcggccccggcgtggagccccacggcgtgctgagagaggtgaccaccgagttcaccgtggacgccagaagcctgaccgccaccggcggcaaccacgtgaccgccagagtgctgaaccccagcggcgccaagaccgacacctacgtgaccgacaacggcgacggcacctacagagtgcagtacaccgcctacgaggagggcgtgcacctggtggaggtgctgtacgacgaggtggccgtgcccaagagccccttcagagtgggcgtgaccgagggctgcgaccccaccagagtgagagccttcggccccggcctggagggcggcctggtgaacaaggccaacagattcaccgtggagaccagaggcgccggcaccggcggcctgggcctggccatcgagggccccagcgaggccaagatgagctgcaaggacaacaaggacggcagctgcaccgtggagtacatccccttcacccccggcgactacgacgtgaacatcaccttcggcggcagacccatccccggcagccccttcagagtgcccgtgaaggacgtggtggaccccggcaaggtgaagtgcagcggccccggcctgggcgccggcgtgagagccagagtgccccagaccttcaccgtggactgcagccaggccggcagagcccccctgcaggtggccgtgctgggccccaccggcgtggccgagcccgtggaggtgagagacaacggcgacggcacccacaccgtgcactacacccccgccaccgacggcccctacaccgtggccgtgaagtacgccgaccaggaggtgcccagaagccccttcaagatcaaggtgctgcccgcccacgacgccagcaaggtgagagccagcggccccggcctgaacgccagcggcatccccgccagcctgcccgtggagttcaccatcgacgccagagacgccggcgagggcctgctgaccgtgcagatcctggaccccgagggcaagcccaagaaggccaacatcagagacaacggcgacggcacctacaccgtgagctacctgcccgacatgagcggcagatacaccatcaccatcaagtacggcggcgacgagatcccctacagccccttcagaatccacgccctgcccaccggcgacgccagcaagtgcctggtgaccgtgagcatcggcggccacggcctgggcgcctgcctgggccccagaatccagatcggccaggagaccgtgatcaccgtggacgccaaggccgccggcgagggcaaggtgacctgcaccgtgagcacccccgacggcgccgagctggacgtggacgtggtggagaaccacgacggcaccttcgacatctactacaccgcccccgagcccggcaagtacgtgatcaccatcagattcggcggcgagcacatccccaacagccccttccacgtgctggccaccgaggagcccgtggtgcccgtggagcccatggagagcatgctgagacccttcaacctggtgatccccttcgccgtgcagaagggcgagctgaccggcgaggtgagaatgcccagcggcaagaccgccagacccaacatcaccgacaacaaggacggcaccatcaccgtgagatacgcccccaccgagaagggcctgcaccagatgggcatcaagtacgacggcaaccacatccccggcagccccctgcagttctacgtggacgccatcaacagcagacacgtgagcgcctacggccccggcctgagccacggcatggtgaacaagcccgccaccttcaccatcgtgaccaaggacgccggcgagggcggcctgagcctggccgtggagggccccagcaaggccgagatcacctgcaaggacaacaaggacggcacctgcaccgtgagctacctgcccaccgcccccggcgactacagcatcatcgtgagattcgacgacaagcacatccccggcagccccttcaccgccaagatcaccggcgacgacagcatgagaaccagccagctgaacgtgggcaccagcaccgacgtgagcctgaagatcaccgagagcgacctgagccagctgaccgccagcatcagagcccccagcggcaacgaggagccctgcctgctgaagagactgcccaacagacacatcggcatcagcttcacccccaaggaggtgggcgagcacgtggtgagcgtgagaaagagcggcaagcacgtgaccaacagccccttcaagatcctggtgggccccagcgagatcggcgacgccagcaaggtgagagtgtggggcaagggcctgagcgagggccacaccttccaggtggccgagttcatcgtggacaccagaaacgccggctacggcggcctgggcctgagcatcgagggccccagcaaggtggacatcaactgcgaggacatggaggacggcacctgcaaggtgacctactgccccaccgagcccggcacctacatcatcaacatcaagttcgccgacaagcacgtgcccggcagccccttcaccgtgaaggtgaccggcgagggcagaatgaaggagagcatcaccagaagaagacaggcccccagcatcgccaccatcggcagcacctgcgacctgaacctgaagatccccggcaactggttccagatggtgagcgcccaggagagactgaccagaaccttcaccagaagcagccacacctacaccagaaccgagagaaccgagatcagcaagaccagaggcggcgagaccaagagagaggtgagagtggaggagagcacccaggtgggcggcgaccccttccccgccgtgttcggcgacttcctgggcagagagagactgggcagcttcggcagcatcaccagacagcaggagggcgaggccagcagccaggacatgaccgcccaggtgaccagccccagcggcaaggtggaggccgccgagatcgtggagggcgaggacagcgcctacagcgtgagattcgtgccccaggagatgggcccccacaccgtggccgtgaagtacagaggccagcacgtgcccggcagccccttccagttcaccgtgggccccctgggcgagggcggcgcccacaaggtgagagccggcggcaccggcctggagagaggcgtggccggcgtgcccgccgagttcagcatctggaccagagaggccggcgccggcggcctgagcatcgccgtggagggccccagcaaggccgagatcgccttcgaggacagaaaggacggcagctgcggcgtgagctacgtggtgcaggagcccggcgactacgaggtgagcatcaagttcaacgacgagcacatccccgacagccccttcgtggtgcccgtggccagcctgagcgacgacgccagaagactgaccgtgaccagcctgcaggagaccggcctgaaggtgaaccagcccgccagcttcgccgtgcagctgaacggcgccagaggcgtgatcgacgccagagtgcacacccccagcggcgccgtggaggagtgctacgtgagcgagctggacagcgacaagcacaccatcagattcatcccccacgagaacggcgtgcacagcatcgacgtgaagttcaacggcgcccacatccccggcagccccttcaagatcagagtgggcgagcagagccaggccggcgaccccggcctggtgagcgcctacggccccggcctggagggcggcaccaccggcgtgagcagcgagttcatcgtgaacaccctgaacgccggcagcggcgccctgagcgtgaccatcgacggccccagcaaggtgcagctggactgcagagagtgccccgagggccacgtggtgacctacacccccatggcccccggcaactacctgatcgccatcaagtacggcggcccccagcacatcgtgggcagccccttcaaggccaaggtgaccggccccagactgagcggcggccacagcctgcacgagaccagcaccgtgctggtggagaccgtgaccaagagcagcagcagcagaggcagcagctacagcagcatccccaagttcagcagcgacgccagcaaggtggtgaccagaggccccggcctgagccaggccttcgtgggccagaagaacagcttcaccgtggactgcagcaaggccggcaccaacatgatgatggtgggcgtgcacggccccaagaccccctgcgaggaggtgtacgtgaagcacatgggcaacagagtgtacaacgtgacctacaccgtgaaggagaagggcgactacatcctgatcgtgaagtggggcgacgagagcgtgcccggcagccccttcaaggtgaaggtgccctag

SEQ ID NO: 81761 - DNA, 264 bp, Artificial Sequence
  Description of Artificial Sequence: Synthetic coding sequence
atgcagctgttcgtgagagcccaggagctgcacaccttcgaggtgaccggccaggagaccgtggcccagatcaaggcccacgtggccagcctggagggcatcgcccccgaggaccaggtggtgctgctggccggcgcccccctggaggacgaggccaccctgggccagtgcggcgtggaggccctgaccaccctggaggtggccggcagaatgctgggcggcggccagaccggcgaggaggaggaggaggacagaagcggctag

SEQ ID NO: 81762 - DNA, 228 bp, Artificial Sequence
  Description of Artificial Sequence: Synthetic coding sequence
atgcagctgttcgtgagagcccaggagctgcacaccttcgaggtgaccggccaggagaccgtggcccagatcaaggcccacgtggccagcctggagggcatcgcccccgaggaccaggtggtgctgctggccggcgcccccctggaggacgaggccaccctgggccagtgcggcgtggaggccctgaccaccctggaggtggccggcagaatgctgggcggcgagtag

SEQ ID NO: 81763 - DNA, 297 bp, Artificial Sequence
  Description of Artificial Sequence: Synthetic coding sequence
atgcagctgttcgtgagagcccaggagctgcacaccttcgaggtgaccggccaggagaccgtggcccagatcaaggccctgaccaccctggaggtggccggcagaatgctgggcggcaaggtgcacggcagcctggccagagccggcaaggtgagaggccagacccccaaggtggccaagcaggagaagaagaagaagaagaccggcagagccaagagaagaatgcagtacaacagaagattcgtgaacgtggtgcccaccttcggcaagaagaagggccccaacgccaacagctag

SEQ ID NO: 81764 - DNA, 330 bp, Artificial Sequence
  Description of Artificial Sequence: Synthetic coding sequence
atgcagctgttcgtgagagcccaggagctgcacaccttcgaggtgaccggccaggagaccgtggcccagatcaaggcccacgtggccagcctggagggcatcgcccccgaggaccaggtggtgctgctggccggcgcccccctggaggacgaggccaccctgggccagtgcggcgtggaggccctgaccaccctggaggtggccggcagaatgctgggcggcaaggtgcacggcagcctggccagagccggcaaggtgagaggccagacccccaaggtggccaagcaggagaagaagaagaagaagaccggcagagccaagagaagatag

SEQ ID NO: 81765 - DNA, 402 bp, Artificial Sequence
  Description of Artificial Sequence: Synthetic coding sequence
atgcagctgttcgtgagagcccaggagctgcacaccttcgaggtgaccggccaggagaccgtggcccagatcaaggcccacgtggccagcctggagggcatcgcccccgaggaccaggtggtgctgctggccggcgcccccctggaggacgaggccaccctgggccagtgcggcgtggaggccctgaccaccctggaggtggccggcagaatgctgggcggcaaggtgcacggcagcctggccagagccggcaaggtgagaggccagacccccaaggtggccaagcaggagaagaagaagaagaagaccggcagagccaagagaagaatgcagtacaacagaagattcgtgaacgtggtgcccaccttcggcaagaagaagggccccaacgccaacagctag

SEQ ID NO: 81766 - DNA, 228 bp, Artificial Sequence; identical to SEQ ID NO: 81762
  Description of Artificial Sequence: Synthetic coding sequence

SEQ ID NO: 81767 - DNA, 402 bp, Artificial Sequence; identical to SEQ ID NO: 81765
  Description of Artificial Sequence: Synthetic coding sequence

SEQ ID NO: 81768 - DNA, 402 bp, Artificial Sequence; identical to SEQ ID NO: 81765
  Description of Artificial Sequence: Synthetic coding sequence

SEQ ID NO: 81769 - DNA, 1563 bp, Artificial Sequence
  Description of Artificial Sequence: Synthetic coding sequence
atgagcgccggcgaggtggagagactggtgagcgagctgagcggcggcaccggcggcgacgaggaggaggagtggctgtacggcgacgagaacgaggtggagagacccgaggaggagaacgccagcgccaacccccccagcggcatcgaggacgagaccgccgagaacggcgtgcccaagcccaaggtgaccgagaccgaggacgacagcgacagcgacagcgacgacgacgaggacgacgtgcacgtgaccatcggcgacatcaagaccggcgccccccagtacggcagctacggcaccgcccccgtgaacctgaacatcaagaccggcggcagagtgtacggcaccaccggcaccaaggtgaagggcgtggacctggacgcccccggcagcatcaacggcgtgcccctgctggaggtggacctggacagcttcgaggacaagccctggagaaagcccggcgccgacctgagcgactacttcaactacggcttcaacgaggacacctggaaggcctactgcgagaagcagaagagaatcagaatgggcctggaggtgatccccgtgaccagcaccaccaacaagatcaccgtgcagcagggcagaaccggcaacagcgagaaggagaccgccctgcccagcaccaaggccgagttcaccagcccccccagcctgttcaagaccggcctgccccccagcagaagactgcccggcgccatcgacgtgatcggccagaccatcaccatcagcagagtggagggcagaagaagagccaacgagaacagcaacatccaggtgctgagcgagagaagcgccaccgaggtggacaacaacttcagcaagcccccccccttcttcccccccggcgccccccccacccacctgccccccccccccttcctgccccccccccccaccgtgagcaccgccccccccctgatccccccccccggcttcccccccccccccggcgcccccccccccagcctgatccccaccatcgagagcggccacagcagcggctacgacagcagaagcgccagagccttcccctacggcaacgtggccttcccccacctgcccggcagcgcccccagctggcccagcctggtggacaccagcaagcagtgggactactacgccagaagagagaaggacagagacagagagagagacagagacagagagagagacagagacagagacagagagagagagagaaccagagagagagagagagagagagaccacagccccacccccagcgtgttcaacagcgacgaggagagatacagatacagagagtacgccgagagaggctacgagagacacagagccagcagagagaaggaggagagacacagagagagaagacacagagagaaggaggagaccagacacaagagcagcagaagcaacagcagaagaagacacgagagcgaggagggcgacagccacagaagacacaagcacaagaagagcaagagaagcaaggagggcaaggaggccggcagcgagcccgcccccgagcaggagagcaccgaggccacccccgccgagtag

SEQ ID NO: 81770 - DNA, 1785 bp, Artificial Sequence
  Description of Artificial Sequence: Synthetic coding sequence
atgagcgccggcgaggtggagagactggtgagcgagctgagcggcggcaccggcggcgacgaggaggaggagtggctgtacggcggcccctgggacgtgcacgtgcacagcgacctggccaaggacctggacgagaacgaggtggagagacccgaggaggagaacgccagcgccaacccccccagcggcatcgaggacgagaccgccgagaacggcgtgcccaagcccaaggtgaccgagaccgaggacgacagcgacagcgacagcgacgacgacgaggacgacgtgcacgtgaccatcggcgacatcaagaccggcgccccccagtacggcagctacggcaccgcccccgtgaacctgaacatcaagaccggcggcagagtgtacggcaccaccggcaccaaggtgaagggcgtggacctggacgcccccggcagcatcaacggcgtgcccctgctggaggtggacctggacagcttcgaggacaagccctggagaaagcccggcgccgacctgagcgactacttcaactacggcttcaacgaggacacctggaaggcctactgcgagaagcagaagagaatcagaatgggcctggaggtgatccccgtgaccagcaccaccaacaagatcaccgccgaggactgcaccatggaggtgacccccggcgccgagatccaggacggcagattcaacctgttcaaggtgcagcagggcagaaccggcaacagcgagaaggagaccgccctgcccagcaccaaggccgagttcaccagcccccccagcctgttcaagaccggcctgccccccagcagaaacagcaccagcagccagagccagaccagcaccgccagcagaaaggccaacagcagcgtgggcaagtggcaggacagatacggcagagccgagagccccgacctgagaagactgcccggcgccatcgacgtgatcggccagaccatcaccatcagcagagtggagggcagaagaagagccaacgagaacagcaacatccaggtgctgagcgagagaagcgccaccgaggtggacaacaacttcagcaagcccccccccttcttcccccccggcgccccccccacccacctgccccccccccccttcctgccccccccccccaccgtgagcaccgccccccccctgatccccccccccggcttcccccccccccccggcgcccccccccccagcctgatccccaccatcgagagcggccacagcagcggctacgacagcagaagcgccagagccttcccctacggcaacgtggccttcccccacctgcccggcagcgcccccagctggcccagcctggtggacaccagcaagcagtgggactactacgccagaagagagaaggacagagacagagagagagacagagacagagagagagacagagacagagacagagagagagagagaaccagagagagagagagagagagagaccacagccccacccccagcgtgttcaacagcgacgaggagagatacagatacagagagtacgccgagagaggctacgagagacacagagccagcagagagaaggaggagagacacagagagagaagacacagagagaaggaggagaccagacacaagagcagcagaagcaacagcagaagaagacacgagagcgaggagggcgacagccacagaagacacaagcacaagaagagcaagagaagcaaggagggcaaggaggccggcagcgagcccgcccccgagcaggagagcaccgaggccacccccgccgagtag

SEQ ID NO: 81771 - DNA, 1767 bp, Artificial Sequence
  Description of Artificial Sequence: Synthetic coding sequence
atgagcgccggcgaggtggagagactggtgagcgagctgagcggcggcaccggcggcgacgaggaggaggagtggctgtacggcgacgagaacgaggtggagagacccgaggaggagaacgccagcgccaacccccccagcggcatcgaggacgagaccgccgagaacggcgtgcccaagcccaaggtgaccgagaccgaggacgacagcgacagcgacagcgacgacgacgaggacgacgtgcacgtgaccatcggcgacatcaagaccggcgccccccagtacggcagctacggcaccgcccccgtgaacctgaacatcaagaccggcggcagagtgtacggcaccaccggcaccaaggtgaagggcgtggacctggacgcccccggcagcatcaacggcgtgcccctgctggaggtggacctggacagcttcgaggacaagccctggagaaagcccggcgccgacctgagcgactacttcaactacggcttcaacgaggacacctggaaggcctactgcgagaagcagaagagaatcagaatgggcctggaggtgatccccgtgaccagcaccaccaacaagatcaccgccgaggactgcaccatggaggtgacccccggcgccgagatccaggacggcagattcaacctgttcaaggtgcagcagggcagaaccggcaacagcgagaaggagaccgccctgcccagcaccaaggccgagttcaccagcccccccagcctgttcaagaccggcctgccccccagcagaaacagcaccagcagccagagccagaccagcaccgccagcagaaaggccaacagcagcgtgggcaagtggcaggacagatacggcagagccgagagccccgacctgagaagactgcccggcgccatcgacgtgatcggccagaccatcaccatcagcagagtggagggcagaagaagagccaacgagaacagcaacatccaggtgctgagcgagagaagcgccaccgaggtggacaacaacttcagcaagcccccccccttcttcccccccggcgccccccccacccacctgccccccccccccttcctgccccccccccccaccgtgagcaccgccccccccctgatccccccccccggcatccccatcaccgtgcccccccccggcttcccccccccccccggcgcccccccccccagcctgatccccaccatcgagagcggccacagcagcggctacgacagcagaagcgccagagccttcccctacggcaacgtggccttcccccacctgcccggcagcgcccccagctggcccagcctggtggacaccagcaagcagtgggactactacgccagaagagagaaggacagagacagagagagagacagagacagagagagagacagagacagagacagagagagagagagaaccagagagagagagagagagagagaccacagccccacccccagcgtgttcaacagcgacgaggagagatacagatacagagagtacgccgagagaggctacgagagacacagagccagcagagagaaggaggagagacacagagagagaagacacagagagaaggaggagaccagacacaagagcagcagaagcaacagcagaagaagacacgagagcgaggagggcgacagccacagaagacacaagcacaagaagagcaagagaagcaaggagggcaaggaggccggcagcgagcccgcccccgagcaggagagcaccgaggccacccccgccgagtag

SEQ ID NO: 81772 - DNA, 366 bp, Artificial Sequence
  Description of Artificial Sequence: Synthetic coding sequence
atggtggacatgatggacctgcccagaagcagaatcaacgccggcatgctggcccagttcatcgacaagcccgtgtgcttcgtgggcagactggagaagatccaccccaccggcaagatgttcatcctgagcgacggcgagggcaagaacggcaccatcgagctgatggagcccctggacgaggagatcagcggcatcgtggaggtggtgggcagagtgaccgccaaggccaccatcctgtgcaccagctacgtgcagttcaaggaggacagccaccccttcgacctgggcctgtacaacgaggccgtgaagatcatccacgacttcccccagttctaccccctgggcatcgtgcagcacgactag

SEQ ID NO: 81773 - DNA, 1413 bp, Artificial Sequence
  Description of Artificial Sequence: Synthetic coding sequence
atgttccccgccggcccccccagccacagcctgctgagactgcccctgctgcagctgctgctgctggtggtgcaggccgtgggcagaggcctgggcagagccagccccgccggcggccccctggaggacgtggtgatcgagagataccacatccccagagcctgccccagagaggtgcagatgggcgacttcgtgagataccactacaacggcaccttcgaggacggcaagaagttcgacagcagctacgacagaaacaccctggtggccatcgtggtgggcgtgggcagactgatcaccggcatggacagaggcctgatgggcatgtgcgtgaacgagagaagaagactgatcgtgcccccccacctgggctacggcagcatcggcctggccggcctgatcccccccgacgccaccctgtacttcgacgtggtgctgctggacgtgtggaacaaggaggacaccgtgcaggtgagcaccctgctgagacccccccactgccccagaatggtgcaggacggcgacttcgtgagataccactacaacggcaccctgctggacggcaccagcttcgacaccagctacagcagaaaccacacctacaacacctacatcggccagggctacatcatccccggcatggaccagggcctgcagggcgcctgcatgggcgagagaagaagaatcaccatccccccccacctggcctacggcgagaacggcaccggcgacaagatccccggcagcgccgtgctgatcttcaacgtgcacgtgatcgacttccacaaccccgccgacgtggtggagatcagaaccctgagcagacccagcgagacctgcaacgagaccaccaagctgggcgacttcgtgagataccactacaactgcagcctgctggacggcacccagctgttcaccagccacgactacggcgccccccaggaggccaccctgggcgccaacaaggtgatcgagggcctggacaccggcctgcagggcatgtgcgtgggcgagagaagacagctgatcgtgcccccccacctggcccacggcgagagcggcgccagaggcgtgcccggcagcgccgtgctgctgttcgaggtggagctggtgagcagagaggacggcctgcccaccggctacctgttcgtgtggcacaaggacccccccgccaacctgttcgaggacatggacctgaacaaggacggcgaggtgccccccgaggagttcagcaccttcatcaaggcccaggtgagcgagggcaagggcagactgatgcccggccaggaccccgagaagaccatcggcgacatgttccagaaccaggacagaaaccaggacggcaagatcaccgtggacgagctgaagctgaagagcgacgaggacgaggagagagtgcacgaggagctgtag

SEQ ID NO: 81774 - DNA, 1749 bp, Artificial Sequence
  Description of Artificial Sequence: Synthetic coding sequence
atgttccccgccggcccccccagccacagcctgctgagactgcccctgctgcagctgctgctgctggtggtgcaggccgtgggcagaggcctgggcagagccagccccgccggcggccccctggaggacgtggtgatcgagagataccacatccccagagcctgccccagagaggtgcagatgggcgacttcgtgagataccactacaacggcaccttcgaggacggcaagaagttcgacagcagctacgacagaaacaccctggtggccatcgtggtgggcgtgggcagactgatcaccggcatggacagaggcctgatgggcatgtgcgtgaacgagagaagaagactgatcgtgcccccccacctgggctacggcagcatcggcctggccggcctgatcccccccgacgccaccctgtacttcgacgtggtgctgctggacgtgtggaacaaggaggacaccgtgcaggtgagcaccctgctgagacccccccactgccccagaatggtgcaggacggcgacttcgtgagataccactacaacggcaccctgctggacggcaccagcttcgacaccagctacagcaagggcggcacctacgacacctacgtgggcagcggctggctgatcaagggcatggaccagggcctgctgggcatgtgccccggcgagagaagaaagatcatcatcccccccttcctggcctacggcgagaagggctacggcaccgtgatccccccccaggccagcctggtgttccacgtgctgctgatcgacgtgcacaaccccaaggacgccgtgcagctggagaccctggagctgccccccggctgcgtgagaagagccggcgccggcgacttcatgagataccactacaacggcagcctgatggacggcaccctgttcgacagcagctacagcagaaaccacacctacaacacctacatcggccagggctacatcatccccggcatggaccagggcctgcagggcgcctgcatgggcgagagaagaagaatcaccatccccccccacctggcctacggcgagaacggcaccggcgacaagatccccggcagcgccgtgctgatcttcaacgtgcacgtgatcgacttccacaaccccgccgacgtggtggagatcagaaccctgagcagacccagcgagacctgcaacgagaccaccaagctgggcgacttcgtgagataccactacaactgcagcctgctggacggcacccagctgttcaccagccacgactacggcgccccccaggaggccaccctgggcgccaacaaggtgatcgagggcctggacaccggcctgcagggcatgtgcgtgggcgagagaagacagctgatcgtgcccccccacctggcccacggcgagagcggcgccagaggcgtgcccggcagcgccgtgctgctgttcgaggtggagctggtgagcagagaggacggcctgcccaccggctacctgttcgtgtggcacaaggacccccccgccaacctgttcgaggacatggacctgaacaaggacggcgaggtgccccccgaggagttcagcaccttcatcaaggcccaggtgagcgagggcaagggcagactgatgcccggccaggaccccgagaagaccatcggcgacatgttccagaaccaggacagaaaccaggacggcaagatcaccgtggacgagctgaagctgaagagcgacgaggacgaggagagagtgcacgaggagctgtag

SEQ ID NO: 81775 - DNA, 1629 bp, Artificial Sequence
  Description of Artificial Sequence: Synthetic coding sequence
atgttccccgccggcccccccagccacagcctgctgagactgcccctgctgcagctgctgctgctggtggtgcaggccgtgggcagaggcctgggcagagccagccccgccggcggccccctggaggacgtggtgatcgagagataccacatccccagagcctgccccagagaggtgcagatgggcgacttcgtgagataccactacaacggcaccttcgaggacggcaagaagttcgacagcagctacgacagaaacaccctggtggccatcgtggtgggcgtgggcagactgatcaccggcatggacagaggcctgatgggcatgtgcgtgaacgagagaagaagactgatcgtgcccccccacctgggctacggcagcatcggcctggccggcctgatcccccccgacgccaccctgtacttcgacgtggtgctgctggacgtgtggaacaaggaggacaccgtgcaggtgagcaccctgctgagacccccccactgccccagaatggtgcaggacggcgacttcgtgagataccactacaacggcaccctgctggacggcaccagcttcgacaccagctacagcaagggcggcacctacgacacctacgtgggcagcggctggctgatcaagggcatggaccagggcctgctgggcatgtgccccggcgagagaagaaagatcatcatcccccccttcctggcctacggcgagaagggctacggcaccgtgatccccccccaggccagcctggtgttccacgtgctgctgatcgacgtgcacaaccccaaggacgccgtgcagctggagaccctggagctgccccccggctgcgtgagaagagccggcgccggcgacttcatgagataccactacaacggcagcctgatggacggcaccctgttcgacagcagctacagcagaaaccacacctacaacacctacatcggccagggctacatcatccccggcatggaccagggcctgcagggcgcctgcatgggcgagagaagaagaatcaccatccccccccacctggcctacggcgagaacggcaccggcgacaagatccccggcagcgccgtgctgatcttcaacgtgcacgtgatcgacttccacaaccccgccgacgtggtggagatcagaaccctgagcagacccagcgagacctgcaacgagaccaccaagctgggcgacttcgtgagataccactacaactgcagcctgctggacggcacccagctgttcaccagccacgactacggcgccccccaggaggccaccctgggcgccaacaaggtgatcgagggcctggacaccggcctgcagggcatgtgcgtgggcgagagaagacagctgatcgtgcccccccacctggcccacggcgagagcggcgccagaggcgtgcccggcagcgccgtgctgctgttcgaggtggagctggtgagcagagaggacggcctgcccaccggctacctgttcgtgtggcacaaggacccccccgccaacctgttcgaggacatggacctgaacaaggacggcgaggtgccccccgaggagttcagcaccttcatcaaggcccaggtgagcgagggcaagggcccccacgcctgggccggcccctag

SEQ ID NO: 81776 - DNA, 246 bp, Artificial Sequence
  Description of Artificial Sequence: Synthetic coding sequence
atgggcgacttcgtgagataccactacaacggcaccttcgaggacggcaagaagttcgacagcagctacgacagaaacaccctggtggccatcgtggtgggcgtgggcagactgatcaccggcatggacagaggcctgatgggcatgtgcgtgaacgagagaagaagactgatcgtgcccccccacctgggctacggcagcatcggcctggccggcctgatcccccccgacgccaccctgtactag

SEQ ID NO: 81777 - DNA, 1161 bp, Artificial Sequence
  Description of Artificial Sequence: Synthetic coding sequence
tgaatcgacgtgcacaaccccaaggacgccgtgcagctggagaccctggagctgccccccggctgcgtgagaagagccggcgccggcgacttcatgagataccactacaacggcagcctgatggacggcaccctgttcgacagcagctacagcagaaaccacacctacaacacctacatcggccagggctacatcatccccggcatggaccagggcctgcagggcgcctgcatgggcgagagaagaagaatcaccatccccccccacctggcctacggcgagaacggcaccgacagcatcggcttcctgcagggcagcgcccccctgagacccttcagaagcggcgagggccagcccagcctgggcagagagggcggctacggcaagaccgagcccgcctacccccaggaccccgccgtgctgggcgccagcgtgagcagccccgtgaagtgggccagccacgccgacccccagggcgacaagatccccggcagcgccgtgctgatcttcaacgtgcacgtgatcgacttccacaaccccgccgacgtggtggagatcagaaccctgagcagacccagcgagacctgcaacgagaccaccaagctgggcgacttcgtgagataccactacaactgcagcctgctggacggcacccagctgttcaccagccacgactacggcgccccccaggaggccaccctgggcgccaacaaggtgatcgagggcctggacaccggcctgcagggcatgtgcgtgggcgagagaagacagctgatcgtgcccccccacctggcccacggcgagagcggcgccagaggcgtgcccggcagcgccgtgctgctgttcgaggtggagctggtgagcagagaggacggcctgcccaccggctacctgttcgtgtggcacaaggacccccccgccaacctgttcgaggacatggacctgaacaaggacggcgaggtgccccccgaggagttcagcaccttcatcaaggcccaggtgagcgagggcaagggcagactgatgcccggccaggaccccgagaagaccatcggcgacatgttccagaaccaggacagaaaccaggacggcaagatcaccgtggacgagctgaagctgaagagcgacgaggacgaggagagagtgcacgaggagctgtag

SEQ ID NO: 81778 - DNA, 1068 bp, Artificial Sequence
  Description of Artificial Sequence: Synthetic coding sequence
atgagataccactacaacggcagcctgatggacggcaccctgttcgacagcagctacagcagaaaccacacctacaacacctacatcggccagggctacatcatccccggcatggaccagggcctgcagggcgcctgcatgggcgagagaagaagaatcaccatccccccccacctggcctacggcgagaacggcaccgacagcatcggcttcctgcagggcagcgcccccctgagacccttcagaagcggcgagggccagcccagcctgggcagagagggcggctacggcaagaccgagcccgcctacccccaggaccccgccgtgctgggcgccagcgtgagcagccccgtgaagtgggccagccacgccgacccccagggcgacaagatccccggcagcgccgtgctgatcttcaacgtgcacgtgatcgacttccacaaccccgccgacgtggtggagatcagaaccctgagcagacccagcgagacctgcaacgagaccaccaagctgggcgacttcgtgagataccactacaactgcagcctgctggacggcacccagctgttcaccagccacgactacggcgccccccaggaggccaccctgggcgccaacaaggtgatcgagggcctggacaccggcctgcagggcatgtgcgtgggcgagagaagacagctgatcgtgcccccccacctggcccacggcgagagcggcgccagaggcgtgcccggcagcgccgtgctgctgttcgaggtggagctggtgagcagagaggacggcctgcccaccggctacctgttcgtgtggcacaaggacccccccgccaacctgttcgaggacatggacctgaacaaggacggcgaggtgccccccgaggagttcagcaccttcatcaaggcccaggtgagcgagggcaagggcagactgatgcccggccaggaccccgagaagaccatcggcgacatgttccagaaccaggacagaaaccaggacggcaagatcaccgtggacgagctgaagctgaagagcgacgaggacgaggagagagtgcacgaggagctgtag

SEQ ID NO: 81779 - DNA, 327 bp, Artificial Sequence
  Description of Artificial Sequence: Synthetic coding sequence
atgggcgtggagatcgagaccatcagccccggcgacggcagaaccttccccaagaagggccagacctgcgtggtgcactacaccggcatgctgcagaacggcaagaagttcgacagcagcagagacagaaacaagcccttcaagttcagaatcggcaagcaggaggtgatcaagggcttcgaggagggcgccgcccagatgagcctgggccagagagccaagctgacctgcacccccgacgtggcctacggcgccaccggccaccccggcgtgatcccccccaacgccaccctgatcttcgacgtggagctgctgaacctggagtag

SEQ ID NO: 81780 - DNA, 243 bp, Artificial Sequence
  Description of Artificial Sequence: Synthetic coding sequence
atgggcgtggagatcgagaccatcagccccggcgacggcagaaccttccccaagaagggccagacctgcgtggtgcactacaccggcatgctgcagaacggcaagaagttcgacagcagcagagacagaaacaagcccttcaagttcagaatcggcaagcaggaggtgatcaagggcttcgaggagggcgccgcccagctgggccccctgagccccctgcccatctgcccccacccctgctag

SEQ ID NO: 81781 - DNA, 429 bp, Artificial Sequence
  Description of Artificial Sequence: Synthetic coding sequence
atgagactgagctggttcagagtgctgaccgtgctgagcatctgcctgagcgccgtggccaccgccaccggcgccgagggcaagagaaagctgcagatcggcgtgaagaagagagtggaccactgccccatcaagagcagaaagggcgacgtgctgcacatgcactacaccggcaagctggaggacggcaccgagttcgacagcagcctgccccagaaccagcccttcgtgttcagcctgggcaccggccaggtgatcaagggctgggaccagggcctgctgggcatgtgcgagggcgagaagagaaagctggtgatccccagcgagctgggctacggcgagagaggcgccccccccaagatccccggcggcgccaccctggtgttcgaggtggagctgctgaagatcgagagaagaaccgagctgtag

SEQ ID NO: 81782 - DNA, 429 bp, Artificial Sequence; identical to SEQ ID NO: 81781
  Description of Artificial Sequence: Synthetic coding sequence

SEQ ID NO: 81783 - DNA, 429 bp, Artificial Sequence; identical to SEQ ID NO: 81781
  Description of Artificial Sequence: Synthetic coding sequence

SEQ ID NO: 81784 - DNA, 309 bp, Artificial Sequence
  Description of Artificial Sequence: Synthetic coding sequence
atgagactgagctggttcagagtgctgaccgtgctgagcatctgcctgagcgccgtggccaccgccaccggcgccgagggcaagagaaagctgcagatcggcgtgaagaagagagtggaccactgccccatcaagagcagaaagggcgacgtgctgcacatgcactacaccggcaagctggaggacggcaccgagttcgacagcagcctgccccagaaccagcccttcgtgttcagcctgggcaccggccaggtgatcaagggctgggaccagggcctgctgggcatgtgcgagggcgagaagagatag

SEQ ID NO: 81785 - DNA, 3144 bp, Artificial Sequence
  Description of Artificial Sequence: Synthetic coding sequence
atggccgtgaccctggacaaggacgcctactacagaagagtgaagagactgtacagcaactggagaaagggcgaggacgagtacgccaacgtggacgccatcgtggtgagcgtgggcgtggacgaggagatcgtgtacgccaagagcaccgccctgcagacctggctgttcggctacgagctgaccgacaccatcatggtgttctgcgacgacaagatcatcttcatggccagcaagaagaaggtggagttcctgaagcagatcgccaacaccaagggcaacgagaacgccaacggcgcccccgccatcaccctgctgatcagagagaagaacgagagcaacaagagcagcttcgacaagatgatcgaggccatcaaggagagcaagaacggcaagaagatcggcgtgttcagcaaggacaagttccccggcgagttcatgaagagctggaacgactgcctgaacaaggagggcttcgacaagatcgacatcagcgccgtggtggcctacaccatcgccgtgaaggaggacggcgagctgaacctgatgaagaaggccgccagcatcaccagcgaggtgttcaacaagttcttcaaggagagagtgatggagatcgtggacgccgacgagaaggtgagacacagcaagctggccgagagcgtggagaaggccatcgaggagaagaagtacctggccggcgccgaccccagcaccgtggagatgtgctacccccccatcatccagagcggcggcaactacaacctgaagttcagcgtggtgagcgacaagaaccacatgcacttcggcgccatcacctgcgccatgggcatcagattcaagagctactgcagcaacctggtgagaaccctgatggtggaccccagccaggaggtgcaggagaactacaacttcctgctgcagctgcaggaggagctgctgaaggagctgagacacggcgtgaagatctgcgacgtgtacaacgccgtgatggacgtggtgaagaagcagaagcccgagctgctgaacaagatcaccaagaacctgggcttcggcatgggcatcgagttcagagagggcagcctggtgatcaacagcaagaaccagtacaagctgaagaagggcatggtgttcagcatcaacctgggcttcagcgacctgaccaacaaggagggcaagaagcccgaggagaagacctacgccctgttcatcggcgacaccgtgctggtggacgaggacggccccgccaccgtgctgaccagcgtgaagaagaaggtgaagaacgtgggcatcttcctgaagaacgaggacgaggaggaggaggaggaggagaaggacgaggccgaggacctgctgggcagaggcagcagagccgccctgctgaccgagagaaccagaaacgagatgaccgccgaggagaagagaagagcccaccagaaggagctggccgcccagctgaacgaggaggccaagagaagactgaccgagcagaagggcgagcagcagatccagaaggccagaaagagcaacgtgagctacaagaaccccagcctgatgcccaaggagccccacatcagagagatgaagatctacatcgacaagaagtacgagaccgtgatcatgcccgtgttcggcatcgccacccccttccacatcgccaccatcaagaacatcagcatgagcgtggagggcgactacacctacctgagaatcaacttctactgccccggcagcgccctgggcagaaacgagggcaacatcttccccaaccccgaggccaccttcgtgaaggagatcacctacagagccagcaacatcaaggcccccggcgagcagaccgtgcccgccctgaacctgcagaacgccttcagaatcatcaaggaggtgcagaagagatacaagaccagagaggccgaggagaaggagaaggagggcatcgtgaagcaggacagcctggtgatcaacctgaacagaagcaaccccaagctgaaggacctgtacatcagacccaacatcgcccagaagagaatgcagggcagcctggaggcccacgtgaacggcttcagattcaccagcgtgagaggcgacaaggtggacatcctgtacaacaacatcaagcacgccctgttccagccctgcgacggcgagatgatcatcgtgctgcacttccacctgaagaacgccatcatgttcggcaagaagagacacaccgacgtgcagttctacaccgaggtgggcgagatcaccaccgacctgggcaagcaccagcacatgcacgacagagacgacctgtacgccgagcagatggagagagagatgagacacaagctgaagaccgccttcaagaacttcatcgagaaggtggaggccctgaccaaggaggagctggagttcgaggtgcccttcagagacctgggcttcaacggcgccccctacagaagcacctgcctgctgcagcccaccagcagcgccctggtgaacgccaccgagtggccccccttcgtggtgaccctggacgaggtggagctgatccacttcgagagagtgcagttccacctgaagaacttcgacatggtgatcgtgtacaaggactacagcaagaaggtgaccatgatcaacgccatccccgtggccagcctggaccccatcaaggagtggctgaacagctgcgacctgaagtacaccgagggcgtgcagagcctgaactggaccaagatcatgaagaccatcgtggacgaccccgagggcttcttcgagcagggcggctggagcttcctggagcccgagggcgagggcagcgacgccgaggagggcgacagcgagagcgagatcgaggacgagaccttcaaccccagcgaggacgactacgaggaggaggaggaggacagcgacgaggactacagcagcgaggccgaggagagcgactacagcaaggagagcctgggcagcgaggaggagagcggcaaggactgggacgagctggaggaggaggccagaaaggccgacagagagagcagatacgaggaggaggaggagcagagcagaagcatgagcagaaagagaaaggccagcgtgcacagcagcggcagaggcagcaacagaggcagcagacacagcagcgccccccccaagaagaagagaaagtag

SEQ ID NO: 81786 - DNA, 675 bp, Artificial Sequence; identical to SEQ ID NO: 75728
  Description of Artificial Sequence: Synthetic coding sequence

SEQ ID NO: 81787 - DNA, 1374 bp, Artificial Sequence
  Description of Artificial Sequence: Synthetic coding sequence
atgaccaccgacgagggcgccaagaacaacgaggagagccccaccgccaccgtggccgagcagggcgaggacatcaccagcaagaaggacagaggcgtgctgaagatcgtgaagagagtgggcaacggcgaggagacccccatgatcggcgacaaggtgtacgtgcactacaagggcaagctgagcaacggcaagaagttcgacagcagccacgacagaaacgagcccttcgtgttcagcctgggcaagggccaggtgatcaaggcctgggacatcggcgtggccaccatgaagaagggcgagatctgccacctgctgtgcaagcccgagtacgcctacggcagcgccggcagcctgcccaagatccccagcaacgccaccctgttcttcgagatcgagctgctggacttcaagggcgaggacctgttcgaggacggcggcatcatcagaagaaccaagagaaagggcgagggctacagcaaccccaacgagggcgccaccgtggagatccacctggagggcagatgcggcggcagaatgttcgactgcagagacgtggccttcaccgtgggcgagggcgaggaccacgacatccccatcggcatcgacaaggccctggagaagatgcagagagaggagcagtgcatcctgtacctgggccccagatacggcttcggcgaggccggcaagcccaagttcggcatcgagcccaacgccgagctgatctacgaggtgaccctgaagagcttcgagaaggccaaggagagctgggagatggacaccaaggagaagctggagcaggccgccatcgtgaaggagaagggcaccgtgtacttcaagggcggcaagtacatgcaggccgtgatccagtacggcaagatcgtgagctggctggagatggagtacggcctgagcgagaaggagagcaaggccagcgagagcttcctgctggccgccttcctgaacctggccatgtgctacctgaagctgagagagtacaccaaggccgtggagtgctgcgacaaggccctgggcctggacagcgccaacgagaagggcctgtacagaagaggcgaggcccagctgctgatgaacgagttcgagagcgccaagggcgacttcgagaaggtgctggaggtgaacccccagaacaaggccgccagactgcagatcagcatgtgccagaagaaggccaaggagcacaacgagagagacagaagaatctacgccaacatgttcaagaagttcgccgagcaggacgccaaggaggaggccaacaaggccatgggcaagaagaccagcgagggcgtgaccaacgagaagggcaccgacagccaggccatggaggaggagaagcccgagggccacgtgtag

SEQ ID NO: 81788 - DNA, 1374 bp, Artificial Sequence; identical to SEQ ID NO: 81787
  Description of Artificial Sequence: Synthetic coding sequence

SEQ ID NO: 81789 - DNA, 801 bp, Artificial Sequence
  Description of Artificial Sequence: Synthetic coding sequence
ctgctgatgaaggtgcccagaaccatgaagaaggccccccagcccctgctgctgagcagagagagaatcctgccccccaaggacagaggcgtgctgaagatcgtgaagagagtgggcaacggcgaggagacccccatgatcggcgacaaggtgtacgtgcactacaagggcaagctgagcaacggcaagaagttcgacagcagccacgacagaaacgagcccttcgtgttcagcctgggcaagggccaggtgatcaaggcctgggacatcggcgtggccaccatgaagaagggcgagatctgccacctgctgtgcaagcccgagtacgcctacggcagcgccggcagcctgcccaagatccccagcaacgccaccctgttcttcgagatcgagctgctggacttcaagggcgaggacctgttcgaggacggcggcatcatcagaagaaccaagagaaagggcgagggctacagcaaccccaacgagggcgccaccgtggagatccacctggagggcagatgcggcggcagaatgttcgactgcagagacgtggccttcaccgtgggcgagggcgaggaccacgacatccccatcggcatcgacaaggccctggagaagatgcagagagaggagcagtgcatcctgtacctgggccccagacccaagaaccccggcagatggatccccaagaagaactggagcagactgcccctgagcaagagaagagagccctacaccagcagatgcgtgagcccctacgccatcctgagcatcagcaagaacctgttcaagtgctggtag

SEQ ID NO: 81790 - DNA, 1374 bp, Artificial Sequence; identical to SEQ ID NO: 81787
  Description of Artificial Sequence: Synthetic coding sequence

SEQ ID NO: 81791 - DNA, 1374 bp, Artificial Sequence; identical to SEQ ID NO: 81787
  Description of Artificial Sequence: Synthetic coding sequence

SEQ ID NO: 81792 - DNA, 837 bp, Artificial Sequence
  Description of Artificial Sequence: Synthetic coding sequence
atgttcgactgcagagacgtggccttcaccgtgggcgagggcgaggaccacgacatccccatcggcatcgacaaggccctggagaagatgcagagagaggagcagtgcatcctgtacctgggccccagatacggcttcggcgaggccggcaagcccaagttcggcatcgagcccaacgccgagctgatctacgaggtgaccctgaagagcttcgagaaggccaaggagagctgggagatggacaccaaggagaagctggagcaggccgccatcgtgaaggagaagggcaccgtgtacttcaagggcggcaagtacatgcaggccgtgatccagtacggcaagatcgtgagctggctggagatggagtacggcctgagcgagaaggagagcaaggccagcgagagcttcctgctggccgccttcctgaacctggccatgtgctacctgaagctgagagagtacaccaaggccgtggagtgctgcgacaaggccctgggcctggacagcgccaacgagaagggcctgtacagaagaggcgaggcccagctgctgatgaacgagttcgagagcgccaagggcgacttcgagaaggtgctggaggtgaacccccagaacaaggccgccagactgcagatcagcatgtgccagaagaaggccaaggagcacaacgagagagacagaagaatctacgccaacatgttcaagaagttcgccgagcaggacgccaaggaggaggccaacaaggccatgggcaagaagaccagcgagggcgtgaccaacgagaagggcaccgacagccaggccatggaggaggagaagcccgagggccacgtgtag

SEQ ID NO: 81793 - DNA, 807 bp, Artificial Sequence
  Description of Artificial Sequence: Synthetic coding sequence
atgaccaccgacgagggcgccaagaacaacgaggagagccccaccgccaccgtggccgagcagggcgaggacatcaccagcaagaaggacagaggcgtgctgaagatcgtgaagagagtgggcaacggcgaggagacccccatgatcggcgacaaggtgtacgtgcactacaagggcaagctgagcaacggcaagaagttcgacagcagccacgacagaaacgagcccttcgtgttcagcctgggcaagggccaggtgatcaaggcctgggacatcggcgtggccaccatgaagaagggcgagatctgccacctgctgtgcaagcccgagtacgcctacggcagcgccggcagcctgcccaagatccccagcaacgccaccctgttcttcgagatcgagctgctggacttcaagggcgaggacctgttcgaggacggcggcatcatcagaagaaccaagagaaagggcgagggctacagcaaccccaacgagggcgccaccgtggagatccacctggagggcagatgcggcggcagaatgttcgactgcagagacgtggccttcaccgtgggcgagggcgaggaccacgacatccccatcggcatcgacaaggccctggagaagatgcagagagaggagcagtgcatcctgtacctgggccccagacccaagaaccccggcagatggatccccaagaagaactggagcagactgcccctgagcaagagaagagagccctacaccagcagatgcgtgagcccctacgccatcctgagcatcagcaagaacctgttcaagtgctggtag

SEQ ID NO: 81794 - DNA, 1263 bp, Artificial Sequence
  Description of Artificial Sequence: Synthetic coding sequence
atgaccaccgagcagggcgaggagacccccatgatcggcgacaaggtgtacgtgcactacaagggcaagctgagcaacggcaagaagttcgacagcagccacgacagaaacgagcccttcgtgttcagcctgggcaagggccaggtgatcaaggcctgggacatcggcgtggccaccatgaagaagggcgagatctgccacctgctgtgcaagcccgagtacgcctacggcagcgccggcagcctgcccaagatccccagcaacgccaccctgttcttcgagatcgagctgctggacttcaagggcgaggacctgttcgaggacggcggcatcatcagaagaaccaagagaaagggcgagggctacagcaaccccaacgagggcgccaccgtggagatccacctggagggcagatgcggcggcagaatgttcgactgcagagacgtggccttcaccgtgggcgagggcgaggaccacgacatccccatcggcatcgacaaggccctggagaagatgcagagagaggagcagtgcatcctgtacctgggccccagatacggcttcggcgaggccggcaagcccaagttcggcatcgagcccaacgccgagctgatctacgaggtgaccctgaagagcttcgagaaggccaaggagagctgggagatggacaccaaggagaagctggagcaggccgccatcgtgaaggagaagggcaccgtgtacttcaagggcggcaagtacatgcaggccgtgatccagtacggcaagatcgtgagctggctggagatggagtacggcctgagcgagaaggagagcaaggccagcgagagcttcctgctggccgccttcctgaacctggccatgtgctacctgaagctgagagagtacaccaaggccgtggagtgctgcgacaaggccctgggcctggacagcgccaacgagaagggcctgtacagaagaggcgaggcccagctgctgatgaacgagttcgagagcgccaagggcgacttcgagaaggtgctggaggtgaacccccagaacaaggccgccagactgcagatcagcatgtgccagaagaaggccaaggagcacaacgagagagacagaagaatctacgccaacatgttcaagaagttcgccgagcaggacgccaaggaggaggccaacaaggccatgggcaagaagaccagcgagggcgtgaccaacgagaagggcaccgacagccaggccatggaggaggagaagcccgagggccacgtgtag

SEQ ID NO: 81795 - DNA, 984 bp, Artificial Sequence
  Description of Artificial Sequence: Synthetic coding sequence
atgggcggcagcgccctgaaccagggcgtgctggagggcgacgacgcccccggccagagcctgtacgagagactgagccagagaatgctggacatcagcggcgacagaggcgtgctgaaggacgtgatcagagagggcgccggcgacctggtggcccccgacgccagcgtgctggtgaagtacagcggctacctggagcacatggacagacccttcgacagcaactacttcagaaagacccccagactgatgaagctgggcgaggacatcaccctgtggggcatggagctgggcctgctgagcatgagaagaggcgagctggccagattcctgttcaagcccaactacgcctacggcaccctgggctgcccccccctgatcccccccaacaccaccgtgctgttcgagatcgagctgctggacttcctggactgcgccgagagcgacaagttctgcgccctgagcgccgagcagcaggaccagttccccctgcagaaggtgctgaaggtggccgccaccgagagagagttcggcaactacctgttcagacagaacagattctacgacgccaaggtgagatacaagagagccctgctgctgctgagaagaagaagcgccccccccgaggagcagcacctggtggaggccgccaagctgcccgtgctgctgaacctgagcttcacctacctgaagctggacagacccaccatcgccctgtgctacggcgagcaggccctgatcatcgaccagaagaacgccaaggccctgttcagatgcggccaggcctgcctgctgctgaccgagtaccagaaggccagagacttcctggtgagagcccagaaggagcagcccttcaaccacgacatcaacaacgagctgaagaagctggccagctgctacagagactacgtggacaaggagaaggagatgtggcacagaatgttcgccccctgcggcgacggcagcaccgccggcgagagctag

SEQ ID NO: 81796 - DNA, 969 bp, Artificial Sequence
  Description of Artificial Sequence: Synthetic coding sequence
atgagcgccagcagctggccccagaacggcatgccccccagcagcctgtacgagagactgagccagagaatgctggacatcagcggcgacagaggcgtgctgaaggacgtgatcagagagggcgccggcgacctggtggcccccgacgccagcgtgctggtgaagtacagcggctacctggagcacatggacagacccttcgacagcaactacttcagaaagacccccagactgatgaagctgggcgaggacatcaccctgtggggcatggagctgggcctgctgagcatgagaagaggcgagctggccagattcctgttcaagcccaactacgcctacggcaccctgggctgcccccccctgatcccccccaacaccaccgtgctgttcgagatcgagctgctggacttcctggactgcgccgagagcgacaagttctgcgccctgagcgccgagcagcaggaccagttccccctgcagaaggtgctgaaggtggccgccaccgagagagagttcggcaactacctgttcagacagaacagattctacgacgccaaggtgagatacaagagagccctgctgctgctgagaagaagaagcgccccccccgaggagcagcacctggtggaggccgccaagctgcccgtgctgctgaacctgagcttcacctacctgaagctggacagacccaccatcgccctgtgctacggcgagcaggccctgatcatcgaccagaagaacgccaaggccctgttcagatgcggccaggcctgcctgctgctgaccgagtaccagaaggccagagacttcctggtgagagcccagaaggagcagcccttcaaccacgacatcaacaacgagctgaagaagctggccagctgctacagagactacgtggacaaggagaaggagatgtggcacagaatgttcgccccctgcggcgacggcagcaccgccggcgagagctag

SEQ ID NO: 81797 - DNA, 531 bp, Artificial Sequence
  Description of Artificial Sequence: Synthetic coding sequence
atggacctgcccgacagcgccagcagagtgttctgcggcagaatcctgagcatggtgaacaccgacgacgtgaacgccatcatcctggcccagaagaacatgctggacagattcgagaagaccaacgagatgctgctgaacttcaacaacctgagcagcgccagactgcagcagatgagcgagagattcctgcaccacaccagaaccctggtggagatgaagagagacctggacagcatcttcagaagaatcagaaccctgaagggcaagctggccagacagcaccccgaggccttcagccacatccccgaggccagcttcctggaggaggaggacgaggaccccatcccccccagcaccaccaccaccatcgccaccagcgagcagagcaccggcagctgcgacaccagccccgacaccgtgagccccagcctgagccccggcttcgaggacctgagccacgtgcagcccggcagccccgccatcaacggcagaagccagaccgacgacgaggagatgaccggcgagtag

SEQ ID NO: 81798 - DNA, 1326 bp, Artificial Sequence
  Description of Artificial Sequence: Synthetic coding sequence
atgggcgtgggcgccggcagagtgagccagagcggcgcccccagccccggcggcgccggcagagccaacagctgcccccccagcagcatggccagctgcgccgagcccagcgagcccagcgcccccctgcccgccggcgtgccccccctggaggacttcgaggtgctggacggcgtggaggacgccgagggcgaggaggaggaggaggaggaggaggaggaggaggacgacctgagcgagctgccccccctggaggacatgggccagccccccgccgaggaggccgagcagcccggcgccctggccagagagttcctggccgccatggagcccgagcccgcccccgcccccgcccccgaggagtggctggacatcctgggcaacggcctgctgagaaagaagaccctggtgcccggcccccccggcagcagcagacccgtgaagggccaggtggtgaccgtgcacctgcagaccagcctggagaacggcaccagagtgcaggaggagcccgagctggtgttcaccctgggcgactgcgacgtgatccaggccctggacctgagcgtgcccctgatggacgtgggcgagaccgccatggtgaccgccgacagcaagtactgctacggcccccagggcagaagcccctacatccccccccacgccgccctgtgcctggaggtgaccctgaagaccgccgtggacggccccgacctggagatgctgaccggccaggagagagtggccctggccaacagaaagagagagtgcggcaacgcccactaccagagagccgacttcgtgctggccgccaacagctacgacctggccatcaaggccatcaccagcagcgccaaggtggacatgaccttcgaggaggaggcccagctgctgcagctgaaggtgaagtgcctgaacaacctggccgccagccagctgaagctggaccactacagagccgccctgagaagctgcagcctggtgctggagcaccagcccgacaacatcaaggccctgttcagaaagggcaaggtgctggcccagcagggcgagtacagcgaggccatccccatcctgagagccgccctgaagctggagcccagcaacaagaccatccacgccgagctgagcaagctggtgaagaagcacgccgcccagagaagcaccgagaccgccctgtacagaaagatgctgggcaaccccagcagactgcccgccaagtgccccggcaagggcgcctggagcatcccctggaagtggctgttcggcgccaccgccgtggccctgggcggcgtggccctgagcgtggtgatcgccgccagaaactag

SEQ ID NO: 81799 - DNA, 762 bp, Artificial Sequence
  Description of Artificial Sequence: Synthetic coding sequence
atggccagctgcgccgagcccagcgagcccagcgcccccctgcccgccggcgtgccccccctggaggacttcgaggtgctggacggcgtggaggacgccgagggcgaggaggaggaggaggaggaggaggaggaggaggacgacctgagcgagctgccccccctggaggacatgggccagccccccgccgaggaggccgagcagcccggcgccctggccagagagttcctggccgccatggagcccgagcccgcccccgcccccgcccccgaggagtggctggacatcctggtggacatgaccttcgaggaggaggcccagctgctgcagctgaaggtgaagtgcctgaacaacctggccgccagccagctgaagctggaccactacagagccgccctgagaagctgcagcctggtgctggagcaccagcccgacaacatcaaggccctgttcagaaagggcaaggtgctggcccagcagggcgagtacagcgaggccatccccatcctgagagccgccctgaagctggagcccagcaacaagaccatccacgccgagctgagcaagctggtgaagaagcacgccgcccagagaagcaccgagaccgccctgtacagaaagatgctgggcaaccccagcagactgcccgccaagtgccccggcaagggcgcctggagcatcccctggaagtggctgttcggcgccaccgccgtggccctgggcggcgtggccctgagcgtggtgatcgccgccagaaactag

SEQ ID NO: 81800 - DNA, 1599 bp, Artificial Sequence
  Description of Artificial Sequence: Synthetic coding sequence
atggccaagagagtggccatcgtgggcgccggcgtgagcggcctggccagcatcaagtgctgcctggaggagggcctggagcccacctgcttcgagagaagcgacgacctgggcggcctgtggagattcaccgagcacgtggaggagggcagagccagcctgtacaagagcgtggtgagcaacagctgcaaggagatgagctgctacagcgacttccccttccccgaggactaccccaactacgtgcccaacagccagttcctggagtacctgaagatgtacgccaaccacttcgacctgctgaagcacatccagttcaagaccaaggtgtgcagcgtgaccaagtgcagcgacagcgccgtgagcggccagtgggaggtggtgaccatgcacgaggagaagcaggagagcgccatcttcgacgccgtgatggtgtgcaccggcttcctgaccaacccctacctgcccctggacagcttccccggcatcaacgccttcaagggccagtacttccacagcagacagtacaagcaccccgacatcttcaaggacaagagagtgctggtgatcggcatgggcaacagcggcaccgacatcgccgtggaggccagccacctggccgagaaggtgttcctgagcaccaccggcggcggctgggtgatcagcagaatcttcgacagcggctacccctgggacatggtgttcatgaccagattccagaacatgctgagaaacagcctgcccacccccatcgtgacctggctgatggagagaaagatcaacaactggctgaaccacgccaactacggcctgatccccgaggacagaacccagctgaaggagttcgtgctgaacgacgagctgcccggcagaatcatcaccggcaaggtgttcatcagacccagcatcaaggaggtgaaggagaacagcgtgatcttcaacaacaccagcaaggaggagcccatcgacatcatcgtgttcgccaccggctacaccttcgccttccccttcctggacgagagcgtggtgaaggtggaggacggccaggccagcctgtacaagtacatcttccccgcccacctgcagaagcccaccctggccatcatcggcctgatcaagcccctgggcagcatgatccccaccggcgagacccaggccagatgggccgtgagagtgctgaagggcgtgaacaagctgcccccccccagcgtgatgatcgaggagatcaacgccagaaaggagaacaagcccagctggttcggcctgtgctactgcaaggccctgcagagcgactacatcacctacatcgacgagctgctgacctacatcaacgccaagcccaacctgttcagcatgctgctgaccgacccccacctggccctgaccgtgttcttcggcccctgcagcccctaccagttcagactgaccggccccggcaagtgggagggcgccagaaacgccatcatgacccagtgggacagaaccttcaaggtgatcaaggccagagtggtgcaggagagccccagccccttcgagagcttcctgaaggtgttcagcttcctggccctgctggtggccatcttcctgatcttcctgtag

SEQ ID NO: 81801 - DNA, 1599 bp, Artificial Sequence; identical to SEQ ID NO: 81800
  Description of Artificial Sequence: Synthetic coding sequence

SEQ ID NO: 81802 - DNA, 1410 bp, Artificial Sequence
  Description of Artificial Sequence: Synthetic coding sequence
atggccaagagagtggccatcgtgggcgccggcgtgagcggcctggccagcatcaagtgctgcctggaggagggcctggagcccacctgcttcgagagaagcgacgacctgggcggcctgtggagattcaccaccaaggtgtgcagcgtgaccaagtgcagcgacagcgccgtgagcggccagtgggaggtggtgaccatgcacgaggagaagcaggagagcgccatcttcgacgccgtgatggtgtgcaccggcttcctgaccaacccctacctgcccctggacagcttccccggcatcaacgccttcaagggccagtacttccacagcagacagtacaagcaccccgacatcttcaaggacaagagagtgctggtgatcggcatgggcaacagcggcaccgacatcgccgtggaggccagccacctggccgagaaggtgttcctgagcaccaccggcggcggctgggtgatcagcagaatcttcgacagcggctacccctgggacatggtgttcatgaccagattccagaacatgctgagaaacagcctgcccacccccatcgtgacctggctgatggagagaaagatcaacaactggctgaaccacgccaactacggcctgatccccgaggacagaacccagctgaaggagttcgtgctgaacgacgagctgcccggcagaatcatcaccggcaaggtgttcatcagacccagcatcaaggaggtgaaggagaacagcgtgatcttcaacaacaccagcaaggaggagcccatcgacatcatcgtgttcgccaccggctacaccttcgccttccccttcctggacgagagcgtggtgaaggtggaggacggccaggccagcctgtacaagtacatcttccccgcccacctgcagaagcccaccctggccatcatcggcctgatcaagcccctgggcagcatgatccccaccggcgagacccaggccagatgggccgtgagagtgctgaagggcgtgaacaagctgcccccccccagcgtgatgatcgaggagatcaacgccagaaaggagaacaagcccagctggttcggcctgtgctactgcaaggccctgcagagcgactacatcacctacatcgacgagctgctgacctacatcaacgccaagcccaacctgttcagcatgctgctgaccgacccccacctggccctgaccgtgttcttcggcccctgcagcccctaccagttcagactgaccggccccggcaagtgggagggcgccagaaacgccatcatgacccagtgggacagaaccttcaaggtgatcaaggccagagtggtgcaggagagccccagccccttcgagagcttcctgaaggtgttcagcttcctggccctgctggtggccatcttcctgatcttcctgtag

SEQ ID NO: 81803 - DNA, 627 bp, Artificial Sequence
  Description of Artificial Sequence: Synthetic coding sequence
atggccaagagagtggccatcgtgggcgccggcgtgagcggcctggccagcatcaagtgctgcctggaggagggcctggagcccacctgcttcgagagaagcgacgacctgggcggcctgtggagattcaccgagcacgtggaggagggcagagccagcctgtacaagagcgtggtgagcaacagctgcaaggagatgagctgctacagcgacttccccttccccgaggactaccccaactacgtgcccaacagccagttcctggagtacctgaagatgtacgccaaccacttcgacctgctgaagcacatccagttcaagaccaaggtgtgcagcgtgaccaagtgcagcgacagcgccgtgagcggccagtgggaggtggtgaccatgcacgaggagaagcaggagagcgccatcttcgacgccgtgatggtgtgcaccggcttcctgaccaacccctacctgcccctggacagcttccccggcatcaacgccttcaagggccagtacttccacagcagacagtacaagcaccccgacatcttcaaggacaagagagtgctggtgatcggcatgggcaacagcggcaccgacatcgccgtggaggccagccacctggccgagtag

SEQ ID NO: 81804 - DNA, 1830 bp, Artificial Sequence
  Description of Artificial Sequence: Synthetic coding sequence
atggagggcaagcccatgagaagatgcaccaacatcagacccggcgagaccggcatggacgtgaccagcagatgcaccctgggcgaccccaacaagctgcccgagggcgtgccccagcccgccagaatgccctacatcagcgacaagcaccccagacagaccctggaggtgatcaacctgctgagaaagcacagagagctgtgcgacgtggtgctggtggtgggcgccaagaagatctacgcccacagagtgatcctgagcgcctgcagcccctacttcagagccatgttcaccggcgagctggccgagagcagacagaccgaggtggtgatcagagacatcgacgagagagccatggagctgctgatcgacttcgcctacaccagccagatcaccgtggaggagggcaacgtgcagaccctgctgcccgccgcctgcctgctgcagctggccgagatccaggaggcctgctgcgagttcctgaagagacagctggaccccagcaactgcctgggcatcagagccttcgccgacacccacagctgcagagagctgctgagaatcgccgacaagttcacccagcacaacttccaggaggtgatggagagcgaggagttcatgctgctgcccgccaaccagctgatcgacatcatcagcagcgacgagctgaacgtgagaagcgaggagcaggtgttcaacgccgtgatggcctgggtgaagtacagcatccaggagagaagaccccagctgccccaggtgctgcagcacgtgagactgcccctgctgagccccaagttcctggtgggcaccgtgggcagcgaccccctgatcaagagcgacgaggagtgcagagacctggtggacgaggccaagaactacctgctgctgccccaggagagacccctgatgcagggccccagaaccagacccagaaagcccatcagatgcggcgaggtgctgttcgccgtgggcggctggtgcagcggcgacgccatcagcagcgtggagagatacgacccccagaccaacgagtggagaatggtggccagcatgagcaagagaagatgcggcgtgggcgtgagcgtgctggacgacctgctgtacgccgtgggcggccacgacggcagcagctacctgaacagcgtggagagatacgaccccaagaccaaccagtggagcagcgacgtggcccccaccagcacctgcagaaccagcgtgggcgtggccgtgctgggcggcttcctgtacgccgtgggcggccaggacggcgtgagctgcctgaacatcgtggagagatacgaccccaaggagaacaagtggaccagagtggccagcatgagcaccagaagactgggcgtggccgtggccgtgctgggcggcttcctgtacgccgtgggcggcagcgacggcaccagccccctgaacaccgtggagagatacaacccccaggagaacagatggcacaccatcgcccccatgggcaccagaagaaagcacctgggctgcgccgtgtaccaggacatgatctacgccgtgggcggcagagacgacaccaccgagctgagcagcgccgagagatacaaccccagaaccaaccagtggagccccgtggtggccatgaccagcagaagaagcggcgtgggcctggccgtggtgaacggccagctgatggccgtgggcggcttcgacggcaccacctacctgaagaccatcgaggtgttcgaccccgacgccaacacctggagactgtacggcggcatgaactacagaagactgggcggcggcgtgggcgtgatcaagatgacccactgcgagagccacatctggtag

SEQ ID NO: 81805 - DNA, 1416 bp, Artificial Sequence; identical to SEQ ID NO: 79002
  Description of Artificial Sequence: Synthetic coding sequence

SEQ ID NO: 81806 - DNA, 1599 bp, Artificial Sequence
  Description of Artificial Sequence: Synthetic coding sequence
atgggcaagaaggtggccatcatcggcgccggcgtgagcggcctggccagcatcagaagctgcctggaggagggcctggagcccacctgcttcgagaagagcaacgacatcggcggcctgtggaagttcagcgaccacgccgaggagggcagagccagcatctacaagagcgtgttcagcaacagcagcaaggagatgatgtgcttccccgacttccccttccccgacgacttccccaacttcatgcacaacagcaagatccaggagtacatcatcgccttcgccaaggagaagaacctgctgaagtacatccagttcaagaccttcgtgagcagcgtgaacaagcaccccgacttcgccaccaccggccagtgggacgtgaccaccgagagagacggcaagaaggagagcgccgtgttcgacgccgtgatggtgtgcagcggccaccacgtgtaccccaacctgcccaaggagagcttccccggcctgaaccacttcaagggcaagtgcttccacagcagagactacaaggagcccggcgtgttcaacggcaagagagtgctggtggtgggcctgggcaacagcggctgcgacatcgccaccgagctgagcagaaccgccgagcaggtgatgatcagcagcagaagcggcagctgggtgatgagcagagtgtgggacaacggctacccctgggacatgctgctggtgaccagattcggcaccttcctgaagaacaacctgcccaccgccatcagcgactggctgtacgtgaagcagatgaacgccagattcaagcacgagaactacggcctgatgcccctgaacggcgtgctgagaaaggagcccgtgttcaacgacgagctgcccgccagcatcctgtgcggcatcgtgagcgtgaagcccaacgtgaaggagttcaccgagaccagcgccatcttcgaggacggcaccatcttcgagggcatcgactgcgtgatcttcgccaccggctacagcttcgcctaccccttcctggacgagagcatcatcaagagcagaaacaacgagatcatcctgttcaagggcgtgttcccccccctgctggagaagagcaccatcgccgtgatcggcttcgtgcagagcctgggcgccgccatccccaccgtggacctgcagagcagatgggccgcccaggtgatcaagggcacctgcaccctgcccagcatggaggacatgatgaacgacatcaacgagaagatggagaagaagagaaagtggttcggcaagagcgagaccatccagaccgactacatcgtgtacatggacgagctgagcagcttcatcggcgccaagcccaacatcccctggctgttcctgaccgaccccaagctggccatggaggtgtacttcggcccctgcagcccctaccagttcagactggtgggccccggccagtggcccggcgccagaaacgccatcctgacccagtgggacagaagcctgaagcccatgcagaccagagtggtgggcagactgcagaagccctgcttcttcttccactggctgaagctgttcgccatccccatcctgctgatcgccgtgttcctggtgctgacctag

SEQ ID NO: 81807 - DNA, 1599 bp, Artificial Sequence; identical to SEQ ID NO: 81806
  Description of Artificial Sequence: Synthetic coding sequence

SEQ ID NO: 81808 - DNA, 1410 bp, Artificial Sequence
  Description of Artificial Sequence: Synthetic coding sequence
atgggcaagaaggtggccatcatcggcgccggcgtgagcggcctggccagcatcagaagctgcctggaggagggcctggagcccacctgcttcgagaagagcaacgacatcggcggcctgtggaagttcagcaccttcgtgagcagcgtgaacaagcaccccgacttcgccaccaccggccagtgggacgtgaccaccgagagagacggcaagaaggagagcgccgtgttcgacgccgtgatggtgtgcagcggccaccacgtgtaccccaacctgcccaaggagagcttccccggcctgaaccacttcaagggcaagtgcttccacagcagagactacaaggagcccggcgtgttcaacggcaagagagtgctggtggtgggcctgggcaacagcggctgcgacatcgccaccgagctgagcagaaccgccgagcaggtgatgatcagcagcagaagcggcagctgggtgatgagcagagtgtgggacaacggctacccctgggacatgctgctggtgaccagattcggcaccttcctgaagaacaacctgcccaccgccatcagcgactggctgtacgtgaagcagatgaacgccagattcaagcacgagaactacggcctgatgcccctgaacggcgtgctgagaaaggagcccgtgttcaacgacgagctgcccgccagcatcctgtgcggcatcgtgagcgtgaagcccaacgtgaaggagttcaccgagaccagcgccatcttcgaggacggcaccatcttcgagggcatcgactgcgtgatcttcgccaccggctacagcttcgcctaccccttcctggacgagagcatcatcaagagcagaaacaacgagatcatcctgttcaagggcgtgttcccccccctgctggagaagagcaccatcgccgtgatcggcttcgtgcagagcctgggcgccgccatccccaccgtggacctgcagagcagatgggccgcccaggtgatcaagggcacctgcaccctgcccagcatggaggacatgatgaacgacatcaacgagaagatggagaagaagagaaagtggttcggcaagagcgagaccatccagaccgactacatcgtgtacatggacgagctgagcagcttcatcggcgccaagcccaacatcccctggctgttcctgaccgaccccaagctggccatggaggtgtacttcggcccctgcagcccctaccagttcagactggtgggccccggccagtggcccggcgccagaaacgccatcctgacccagtgggacagaagcctgaagcccatgcagaccagagtggtgggcagactgcagaagccctgcttcttcttccactggctgaagctgttcgccatccccatcctgctgatcgccgtgttcctggtgctgacctag

SEQ ID NO: 81809 - DNA, 1539 bp, Artificial Sequence
  Description of Artificial Sequence: Synthetic coding sequence
atgcccgccagcaccagaagccagaagagacagggcatggacagcctgctggagcccctgaagatgaacatggaccacgccgaggagggcagagccagcatctacaagagcgtgttcagcaacagcagcaaggagatgatgtgcttccccgacttccccttccccgacgacttccccaacttcatgcacaacagcaagatccaggagtacatcatcgccttcgccaaggagaagaacctgctgaagtacatccagttcaagaccttcgtgagcagcgtgaacaagcaccccgacttcgccaccaccggccagtgggacgtgaccaccgagagagacggcaagaaggagagcgccgtgttcgacgccgtgatggtgtgcagcggccaccacgtgtaccccaacctgcccaaggagagcttccccggcctgaaccacttcaagggcaagtgcttccacagcagagactacaaggagcccggcgtgttcaacggcaagagagtgctggtggtgggcctgggcaacagcggctgcgacatcgccaccgagctgagcagaaccgccgagcaggtgatgatcagcagcagaagcggcagctgggtgatgagcagagtgtgggacaacggctacccctgggacatgctgctggtgaccagattcggcaccttcctgaagaacaacctgcccaccgccatcagcgactggctgtacgtgaagcagatgaacgccagattcaagcacgagaactacggcctgatgcccctgaacggcgtgctgagaaaggagcccgtgttcaacgacgagctgcccgccagcatcctgtgcggcatcgtgagcgtgaagcccaacgtgaaggagttcaccgagaccagcgccatcttcgaggacggcaccatcttcgagggcatcgactgcgtgatcttcgccaccggctacagcttcgcctaccccttcctggacgagagcatcatcaagagcagaaacaacgagatcatcctgttcaagggcgtgttcccccccctgctggagaagagcaccatcgccgtgatcggcttcgtgcagagcctgggcgccgccatccccaccgtggacctgcagagcagatgggccgcccaggtgatcaagggcacctgcaccctgcccagcatggaggacatgatgaacgacatcaacgagaagatggagaagaagagaaagtggttcggcaagagcgagaccatccagaccgactacatcgtgtacatggacgagctgagcagcttcatcggcgccaagcccaacatcccctggctgttcctgaccgaccccaagctggccatggaggtgtacttcggcccctgcagcccctaccagttcagactggtgggccccggccagtggcccggcgccagaaacgccatcctgacccagtgggacagaagcctgaagcccatgcagaccagagtggtgggcagactgcagaagccctgcttcttcttccactggctgaagctgttcgccatccccatcctgctgatcgccgtgttcctggtgctgacctag

SEQ ID NO: 81810 - DNA, 1677 bp, Artificial Sequence
  Description of Artificial Sequence: Synthetic coding sequence
atggccaagaaggtggccgtgatcggcgccggcgtgagcggcctgagcagcatcaagtgctgcgtggacgaggacctggagcccacctgcttcgagagaagcgacgacatcggcggcctgtggaagttcaccgagagcagcaaggacggcatgaccagagtgtacaagagcctggtgaccaacgtgtgcaaggagatgagctgctacagcgacttccccttccacgaggactaccccaacttcatgaaccacgagaagttctgggactacctgcaggagttcgccgagcacttcgacctgctgaagtacatccagttcaagaccaccgtgtgcagcatcaccaagagacccgacttcagcgagaccggccagtgggacgtggtgaccgagaccgagggcaagcagaacagagccgtgttcgacgccgtgatggtgtgcaccggccacttcctgaacccccacctgcccctggaggccttccccggcatccacaagttcaagggccagatcctgcacagccaggagtacaagatccccgagggcttccagggcaagagagtgctggtgatcggcctgggcaacaccggcggcgacatcgccgtggagctgagcagaaccgccgcccaggtgctgctgagcaccagaaccggcacctgggtgctgggcagaagcagcgactggggctacccctacaacatgatggtgaccagaagatgctgcagcttcatcgcccaggtgctgcccagcagattcctgaactggatccaggagagaaagctgaacaagagattcaaccacgaggactacggcctgagcatcaccaagggcaagaaggccaagttcatcgtgaacgacgagctgcccaactgcatcctgtgcggcgccatcaccatgaagaccagcgtgatcgagttcaccgagaccagcgccgtgttcgaggacggcaccgtggaggagaacatcgacgtggtgatcttcaccaccggctacaccttcagcttccccttcttcgaggagcccctgaagagcctgtgcaccaagaagatcttcctgtacaagcaggtgttccccctgaacctggagagagccaccctggccatcatcggcctgatcggcctgaagggcagcatcctgagcggcaccgagctgcaggccagatgggtgaccagagtgttcaagggcctgtgcaagatcccccccagccagaagctgatgatggaggccaccgagaaggagcagctgatcaagagaggcgtgttcaaggacaccagcaaggacaagttcgactacatcgcctacatggacgacatcgccgcctgcatcggcaccaagcccagcatccccctgctgttcctgaaggaccccagactggcctgggaggtgttcttcggcccctgcaccccctaccagtacagactgatgggccccggcaagtgggacggcgccagaaacgccatcctgacccagtgggacagaaccctgaagcccctgaagaccagaatcgtgcccgacagcagcaagcccgccagcatgagccactacctgaaggcctggggcgcccccgtgctgctggccagcctgctgctgatctgcaagagcagcctgttcctgaagctggtgagagacaagctgcaggacagaatgagcccctacctggtgagcctgtggagaggctag

SEQ ID NO: 81811 - DNA, 1602 bp, Artificial Sequence
  Description of Artificial Sequence: Synthetic coding sequence
atgaccaagaagagaatcgccgtgatcggcggcggcgtgagcggcctgagcagcatcaagtgctgcgtggaggagggcctggagcccgtgtgcttcgagagaaccgacgacatcggcggcctgtggagattccaggagaaccccgaggagggcagagccagcatctacaagagcgtgatcatcaacaccagcaaggagatgatgtgcttcagcgactaccccatccccgaccactaccccaacttcatgcacaacgcccaggtgctggagtacttcagaatgtacgccaaggagttcgacctgctgaagtacatcagattcaagaccaccgtgtgcagcgtgaagaagcagcccgacttcgccaccagcggccagtgggaggtggtgaccgagagcgagggcaagaaggagatgaacgtgttcgacggcgtgatggtgtgcaccggccaccacaccaacgcccacctgcccctggagagcttccccggcatcgagaagttcaagggccagtacttccacagcagagactacaagaaccccgagggcttcaccggcaagagagtgatcatcatcggcatcggcaacagcggcggcgacctggccgtggagatcagccagaccgccaagcaggtgttcctgagcaccagaagaggcgcctggatcctgaacagagtgggcgactacggctaccccgccgacgtgctgttcagcagcagactgacccacttcatctggaagatctgcggccagagcctggccaacaagtacctggagaagaagatcaaccagagattcgaccacgagatgttcggcctgaagcccaagcacagagccctgagccagcaccccaccctgaacgacgacctgcccaacagaatcatcagcggcctggtgaaggtgaagggcaacgtgaaggagttcaccgagaccgccgccatcttcgaggacggcagcagagaggacgacatcgacgccgtgatcttcgccaccggctacagcttcgacttccccttcctggaggacagcgtgaaggtggtgaagaacaagatcagcctgtacaagaaggtgttcccccccaacctggagagacccaccctggccatcatcggcctgatccagcccctgggcgccatcatgcccatcagcgagctgcagggcagatgggccacccaggtgttcaagggcctgaagaccctgcccagccagagcgagatgatggccgagatcagcaaggcccaggaggagatcgacaagagatacgtggagagccagagacacaccatccagggcgactacatcgacaccatggaggagctggccgacctggtgggcgtgagacccaacctgctgagcctggccttcaccgaccccaagctggccctgcacctgctgctgggcccctgcacccccatccactacagagtgcagggccccggcaagtgggacggcgccagaaaggccatcctgaccaccgacgacagaatcagaaagcccctgatgaccagagtggtggagagaagcagcagcatgaccagcaccatgaccatcggcaagttcatgctggccctggccttcttcgccatcatcatcgcctacttctag

SEQ ID NO: 81812 - DNA, 858 bp, Artificial Sequence
  Description of Artificial Sequence: Synthetic coding sequence
atgaccaagaagagaatcgccgtgatcggcggcggcgtgagcggcctgagcagcatcaagtgctgcgtggaggagggcctggagcccgtgtgcttcgagagaaccgacgacatcggcggcctgtggagattccaggagaaccccgaggagggcagagccagcatctacaagagcgtgatcatcaacaccagcaaggagatgatgtgcttcagcgactaccccatccccgaccactaccccaacttcatgcacaacgcccaggtgctggagtacttcagaatgtacgccaaggagttcgacctgctgaagtacatcagattcaagaccaccgtgtgcagcgtgaagaagcagcccgacttcgccaccagcggccagtgggaggtggtgaccgagagcgagggcaagaaggagatgaacgtgttcgacggcgtgatggtgtgcaccggccaccacaccaacgcccacctgcccctggagagcttccccggcatcgagaagttcaagggccagtacttccacagcagagactacaagaaccccgagggcttcaccggcaagagagtgatcatcatcggcatcggcaacagcggcggcgacctggccgtggagatcagccagaccgccaagcaggtgttcctgagcaccagaagaggcgcctggatcctgaacagagtgggcgactacggctaccccgccgacgtgctgttcagcagcagactgacccacttcatctggaagatctgcggccagagcctggccaacaagtacctggagaagaagatcaaccagagattcgaccacgagatgttcggcctgaagcccaagcacagaagcaaggacatcgccctgaccgagtag

SEQ ID NO: 81813 - DNA, 1395 bp, Artificial Sequence
  Description of Artificial Sequence: Synthetic coding sequence
atgaccaagaagagaatcgccgtgatcggcggcggcgtgagcggcctgagcagcatcaagtgctgcgtggaggagggcctggagcccgtgtgcttcgagagaaccgacgacatcggcggcctgtggagattccaggagaaccccgaggagggcagagccagcatctacaagagcgtgatcatcaacaccagcaaggagatgatgtgcttcagcgactaccccatccccgaccactaccccaacttcatgcacaacgcccaggtgctggagtacttcagaatgtacgccaaggagttcgacctgctgaagtacatcagattcaagaccaccgtgtgcagcgtgaagaagcagcccgacttcgccaccagcggccagtgggaggtggtgaccgagagcgagggcaagaaggagatgaacgtgttcgacggcgtgatggtgtgcaccggccaccacaccaacgcccacctgcccctggagagcttccccggcatcgagaagttcaagggccagtacttccacagcagagactacaagaaccccgagggcttcaccggcaagagagtgatcatcatcggcatcggcaacagcggcggcgacctggccgtggagatcagccagaccgccaagcaggtgttcctgagcaccagaagaggcgcctggatcctgaacagagtgggcgactacggctaccccgccgacgtgctgttcagcagcagactgacccacttcatctggaagatctgcggccagagcctggccaacaagtacctggagaagaagatcaaccagagattcgaccacgagatgttcggcctgaagcccaagcacagagccctgagccagcaccccaccctgaacgacgacctgcccaacagaatcatcagcggcctggtgaaggtgaagggcaacgtgaaggagttcaccgagaccgccgccatcttcgaggacggcagcagagaggacgacatcgacgccgtgatcttcgccaccggctacagcttcgacttccccttcctggaggacagcgtgaaggtggtgaagaacaagatcagcctgtacaagaaggtgttcccccccaacctggagagacccaccctggccatcatcggcctgatccagcccctgggcgccatcatgcccatcagcgagctgcagggcagatgggccacccaggtgttcaagggcctgaagaccctgcccagccagagcgagatgatggccgagatcagcaaggcccaggaggagatcgacaagagcctgaccatgagaaagaccagcgacaagcccaagctgaagaacatcctgcagatccccgactacctgaagaccgtgaagatcatcaacaaggagagcctgagaaactgccccggcatcaagggccccaaggagacctag

SEQ ID NO: 81814 - DNA, 579 bp, Artificial Sequence
  Description of Artificial Sequence: Synthetic coding sequence
atgaccaagaagagaatcgccgtgatcggcggcggcgtgagcggcctgagcagcatcaagtgctgcgtggaggagggcctggagcccgtgtgcttcgagagaaccgacgacatcggcggcctgtggagattccaggagaaccccgaggagggcagagccagcatctacaagagcgtgatcatcaacaccagcaaggagatgatgtgcttcagcgactaccccatccccgaccactaccccaacttcatgcacaacgcccaggtgctggagtacttcagaatgtacgccaaggagttcgacctgctgaagtacatcagattcaagaccaccgtgtgcagcgtgaagaagcagcccgacttcgccaccagcggccagtgggaggtggtgaccgagagcgagggcaagaaggagatgaacgtgttcgacggcgtgatggtgtgcaccggccaccacaccaacgcccacctgcccctggagagcttccccggcatcgagaagttcaagggccagtacttccacagcagagactacaagaaccccgagggcttcaccggcaagagagtgatcatcatcggctag

SEQ ID NO: 81815 - DNA, 438 bp, Artificial Sequence
  Description of Artificial Sequence: Synthetic coding sequence
atgaccaagaagagaatcgccgtgatcggcggcggcgtgagcggcctgagcagcatcaagtgctgcgtggaggagggcctggagcccgtgtgcttcgagagaaccgacgacatcggcggcctgtggagattccaggagaaccccgaggagggcagagccagcatctacaagagcgtgatcatcaacaccagcaaggagatgatgtgcttcagcgactaccccatccccgaccactaccccaacttcatgcacaacgcccaggtgctggagtacttcagaatgtacgccaaggagttcgacctgctgaagtacatcagattcaagaccaccgtgtgcagcgtgaagaagcagcccgacttcgccaccagcggccagtgggaggtggtgaccgagagcgagggcaagaaggagatgaacgtgttcgacggcgtgatgtag

SEQ ID NO: 81816 - DNA, 3810 bp, Artificial Sequence
  Description of Artificial Sequence: Synthetic coding sequence
atggaggccaccggcgtgctgcccttcgtgagaggcgtggacctgagcggcaacgacttcaagggcggctacttccccgagaacgtgaaggccatgaccagcctgagatggctgaagctgaacagaaccggcctgtgctacctgcccgaggagctggccgccctgcagaagctggagcacctgagcgtgagccacaacaacctgaccaccctgcacggcgagctgagcagcctgcccagcctgagagccatcgtggccagagccaacagcctgaagaacagcggcgtgcccgacgacatcttcaagctggacgacctgagcgtgctggacctgagccacaaccagctgaccgagtgccccagagagctggagaacgccaagaacatgctggtgctgaacctgagccacaacagcatcgacaccatccccaaccagctgttcatcaacctgaccgacctgctgtacctggacctgagcgagaacagactggagagcctgcccccccagatgagaagactggtgcacctgcagaccctggtgctgaacggcaaccccctgctgcacgcccagctgagacagctgcccgccatgaccgccctgcagaccctgcacctgagaagcacccagagaacccagagcaacctgcccaccagcctggagggcctgagcaacctggccgacgtggacctgagctgcaacgacctgaccagagtgcccgagtgcctgtacaccctgcccagcctgagaagactgaacctgagcagcaaccagatcaccgagctgagcctgtgcatcgaccagtgggtgcacgtggagaccctgaacctgagcagaaaccagctgaccagcctgcccagcgccatctgcaagctgagcaagctgaagaagctgtacctgaacagcaacaagctggacttcgacggcctgcccagcggcatcggcaagctgaccaacctggaggagttcatggccgccaacaacaacctggagctggtgcccgagagcctgtgcagatgccccaagctgagaaagctggtgctgaacaagaaccacctggtgaccctgcccgaggccatccacttcctgaccgagatcgaggtgctggacgtgagagagaaccccaacctggtgatgccccccaagcccgccgacagagccgccgagtggtacaacatcgacttcagcctgcagaaccagctgagactggccggcgccagccccgccaccgtggccgccgccgccgccgccggcagcggccccaaggaccccatggccagaaagatgagactgagaagaagaaaggacagcgcccaggacgaccaggccaagcaggtgctgaagggcatgagcgacgtggcccaggagaagaacaagaagcaggaggagagcgccgacgccagagcccccagcggcaaggtgagaagatgggaccagggcctggagaagcccagactggactacagcgagttcttcaccgaggacgtgggccagctgcccggcctgaccatctggcagatcgagaacttcgtgcccgtgctggtggaggaggccttccacggcaagttctacgaggccgactgctacatcgtgctgaagaccttcctggacgacagcggcagcctgaactgggagatctactactggatcggcggcgaggccaccctggacaagaaggcctgcagcgccatccacgccgtgaacctgagaaactacctgggcgccgagtgcagaaccgtgagagaggagatgggcgacgagagcgaggagttcctgcaggtgttcgacaacgacatcagctacatcgagggcggcaccgccagcggcttctacaccgtggaggacacccactacgtgaccagaatgtacagagtgtacggcaagaagaacatcaagctggagcccgtgcccctgaagggcaccagcctggaccccagattcgtgttcctgctggacagaggcctggacatctacgtgtggagaggcgcccaggccaccctgagcagcaccaccaaggccagactgttcgccgagaagatcaacaagaacgagagaaagggcaaggccgagatcaccctgctggtgcagggccaggagctgcccgagttctgggaggccctgggcggcgagcccagcgagatcaagaagcacgtgcccgaggacttctggcccccccagcccaagctgtacaaggtgggcctgggcctgggctacctggagctgccccagatcaactacaagctgagcgtggagcacaagcagagacccaaggtggagctgatgcccagaatgagactgctgcagagcctgctggacaccagatgcgtgtacatcctggactgctggagcgacgtgttcatctggctgggcagaaagagccccagactggtgagagccgccgccctgaagctgggccaggagctgtgcggcatgctgcacagacccagacacgccaccgtgagcagaagcctggagggcaccgaggcccaggtgttcaaggccaagttcaagaactgggacgacgtgctgaccgtggactacaccagaaacgccgaggccgtgctgcagagccccggcctgagcggcaaggtgaagagagacgccgagaagaaggaccagatgaaggccgacctgaccgccctgttcctgcccagacagccccccatgagcctggccgaggccgagcagctgatggaggagtggaacgaggacctggacggcatggagggcttcgtgctggagggcaagaagttcgccagactgcccgaggaggagttcggccacttctacacccaggactgctacgtgttcctgtgcagatactgggtgcccgtggagtacgaggaggaggagaagaaggaggacaaggaggagaaggccgagggcaaggagggcgaggaggccaccgccgaggccgaggagaagcagcccgaggaggacttccagtgcatcgtgtacttctggcagggcagagaggccagcaacatgggctggctgaccttcaccttcagcctgcagaagaagttcgagagcctgttccccggcaagctggaggtggtgagaatgacccagcagcaggagaaccccaagttcctgagccacttcaagagaaagttcatcatccacagaggcaagagaaaggccgtgcagggcgcccagcagcccagcctgtaccagatcagaaccaacggcagcgccctgtgcaccagatgcatccagatcaacaccgacagcagcctgctgaacagcgagttctgcttcatcctgaaggtgcccttcgagagcgaggacaaccagggcatcgtgtacgcctgggtgggcagagccagcgaccccgacgaggccaagctggccgaggacatcctgaacaccatgttcgacaccagctacagcaagcaggtgatcaacgagggcgaggagcccgagaacttcttctgggtgggcatcggcgcccagaagccctacgacgacgacgccgagtacatgaagcacaccagactgttcagatgcagcaacgagaagggctacttcgccgtgaccgagaagtgcagcgacttctgccaggacgacctggccgacgacgacatcatgctgctggacaacggccaggaggtgtacatgtgggtgggcacccagaccagccaggtggagatcaagctgagcctgaaggcctgccaggtgtacatccagcacatgagaagcaaggagcacgagagacccagaagactgagactggtgagaaagggcaacgagcagcacgccttcaccagatgcttccacgcctggagcgccttctgcaaggccctggcctag

SEQ ID NO: 81817 - DNA, 3552 bp, Artificial Sequence
  Description of Artificial Sequence: Synthetic coding sequence
atgaccagcctgagatggctgaagctgaacagaaccggcctgtgctacctgcccgaggagctggccgccctgcagaagctggagcacctgagcgtgagccacaacaacctgaccaccctgcacggcgagctgagcagcctgcccagcctgagagccatcgtggccagagccaacagcctgaagaacagcggcgtgcccgacgacatcttcaagctggacgacctgagcgtgctggacctgagccacaaccagctgaccgagtgccccagagagctggagaacgccaagaacatgctggtgctgaacctgagccacaacagacagctgcccgccatgaccgccctgcagaccctgcacctgagaagcacccagagaacccagagcaacctgcccaccagcctggagggcctgagcaacctggccgacgtggacctgagctgcaacgacctgaccagagtgcccgagtgcctgtacaccctgcccagcctgagaagactgaacctgagcagcaaccagatcaccgagctgagcctgtgcatcgaccagtgggtgcacgtggagaccctgaacctgagcagaaaccagctgaccagcctgcccagcgccatctgcaagctgagcaagctgaagaagctgtacctgaacagcaacaagctggacttcgacggcctgcccagcggcatcggcaagctgaccaacctggaggagttcatggccgccaacaacaacctggagctggtgcccgagagcctgtgcagatgccccaagctgagaaagctggtgctgaacaagaaccacctggtgaccctgcccgaggccatccacttcctgaccgagatcgaggtgctggacgtgagagagaaccccaacctggtgatgccccccaagcccgccgacagagccgccgagtggtacaacatcgacttcagcctgcagaaccagctgagactggccggcgccagccccgccaccgtggccgccgccgccgccggcagcggccccaaggaccccatggccagaaagatgagactgagaagaagaaaggacagcgcccaggacgaccaggccaagcaggtgctgaagggcatgagcgacgtggcccaggagaagaacaagaagcaggaggagagcgccgacgccagagcccccagcggcaaggtgagaagatgggaccagggcctggagaagcccagactggactacagcgagttcttcaccgaggacgtgggccagctgcccggcctgaccatctggcagatcgagaacttcgtgcccgtgctggtggaggaggccttccacggcaagttctacgaggccgactgctacatcgtgctgaagaccttcctggacgacagcggcagcctgaactgggagatctactactggatcggcggcgaggccaccctggacaagaaggcctgcagcgccatccacgccgtgaacctgagaaactacctgggcgccgagtgcagaaccgtgagagaggagatgggcgacgagagcgaggagttcctgcaggtgttcgacaacgacatcagctacatcgagggcggcaccgccagcggcttctacaccgtggaggacacccactacgtgaccagaatgtacagagtgtacggcaagaagaacatcaagctggagcccgtgcccctgaagggcaccagcctggaccccagattcgtgttcctgctggacagaggcctggacatctacgtgtggagaggcgcccaggccaccctgagcagcaccaccaaggccagactgttcgccgagaagatcaacaagaacgagagaaagggcaaggccgagatcaccctgctggtgcagggccaggagctgcccgagttctgggaggccctgggcggcgagcccagcgagatcaagaagcacgtgcccgaggacttctggcccccccagcccaagctgtacaaggtgggcctgggcctgggctacctggagctgccccagatcaactacaagctgagcgtggagcacaagcagagacccaaggtggagctgatgcccagaatgagactgctgcagagcctgctggacaccagatgcgtgtacatcctggactgctggagcgacgtgttcatctggctgggcagaaagagccccagactggtgagagccgccgccctgaagctgggccaggagctgtgcggcatgctgcacagacccagacacgccaccgtgagcagaagcctggagggcaccgaggcccaggtgttcaaggccaagttcaagaactgggacgacgtgctgaccgtggactacaccagaaacgccgaggccgtgctgcagagccccggcctgagcggcaaggtgaagagagacgccgagaagaaggaccagatgaaggccgacctgaccgccctgttcctgcccagacagccccccatgagcctggccgaggccgagcagctgatggaggagtggaacgaggacctggacggcatggagggcttcgtgctggagggcaagaagttcgccagactgcccgaggaggagttcggccacttctacacccaggactgctacgtgttcctgtgcagatactgggtgcccgtggagtacgaggaggaggagaagaaggaggacaaggaggagaaggccgagggcaaggagggcgaggaggccaccgccgaggccgaggagaagcagcccgaggaggacttccagtgcatcgtgtacttctggcagggcagagaggccagcaacatgggctggctgaccttcaccttcagcctgcagaagaagttcgagagcctgttccccggcaagctggaggtggtgagaatgacccagcagcaggagaaccccaagttcctgagccacttcaagagaaagttcatcatccacagaggcaagagaaaggccgtgcagggcgcccagcagcccagcctgtaccagatcagaaccaacggcagcgccctgtgcaccagatgcatccagatcaacaccgacagcagcctgctgaacagcgagttctgcttcatcctgaaggtgcccttcgagagcgaggacaaccagggcatcgtgtacgcctgggtgggcagagccagcgaccccgacgaggccaagctggccgaggacatcctgaacaccatgttcgacaccagctacagcaagcaggtgatcaacgagggcgaggagcccgagaacttcttctgggtgggcatcggcgcccagaagccctacgacgacgacgccgagtacatgaagcacaccagactgttcagatgcagcaacgagaagggctacttcgccgtgaccgagaagtgcagcgacttctgccaggacgacctggccgacgacgacatcatgctgctggacaacggccaggaggtgtacatgtgggtgggcacccagaccagccaggtggagatcaagctgagcctgaaggcctgccaggtgtacatccagcacatgagaagcaaggagcacgagagacccagaagactgagactggtgagaaagggcaacgagcagcacgccttcaccagatgcttccacgcctggagcgccttctgcaaggccctggcctag

SEQ ID NO: 81818 - DNA, 3447 bp, Artificial Sequence
  Description of Artificial Sequence: Synthetic coding sequence
atggaggccaccggcgtgctgcccttcgtgagaggcgtggacctgagcggcaacgacttcaagggcggctacttccccgagaacgtgaaggccatgaccagcctgagatggctgaagctgaacagaaccggcctgtgctacctgcccgaggagctggccgccctgcagaagctggagcacctgagcgtgagccacaacaacctgaccaccctgcacggcgagctgagcagcctgcccagcctgagagccatcgtggccagagccaacagcctgaagaacagcggcgtgcccgacgacatcttcaagctggacgacctgagcgtgctggacctgagccacaaccagctgaccgagtgccccagagagctggagaacgccaagaacatgctggtgctgaacctgagccacaacagcatcgacaccatccccaaccagctgttcatcaacctgaccgacctgctgtacctggacctgagcgagaacagactggagagcctgcccccccagatgagaagactggtgcacctgcagaccctggtgctgaacggcaaccccctgctgcacgcccagctgagacagctgcccgccatgaccgccctgcagaccctgcacctgagaagcacccagagaacccagagcaacctgcccaccagcctggagggcctgagcaacctggccgacgtggacctgagctgcaacgacctgaccagagtgcccgagtgcctgtacaccctgcccagcctgagaagactgaacctgagcagcaaccagatcaccgagctgagcctgtgcatcgaccagtgggtgcacgtggagaccctgaacctgagcagaaaccagctgaccagcctgcccagcgccatctgcaagctgagcaagctgaagaagctgtacctgaacagcaacaagctggacttcgacggcctgcccagcggcatcggcaagctgaccaacctggaggagttcatggccgccaacaacaacctggagctggtgcccgagagcctgtgcagatgccccaagctgagaaagctggtgctgaacaagaaccacctggtgaccctgcccgaggccatccacttcctgaccgagatcgaggtgctggacgtgagagagaaccccaacctggtgatgccccccaagcccgccgacagagccgccgagtggtacaacatcgacttcagcctgcagaaccagctgagactggccggcgccagccccgccaccgtggccgccgccgccgccgccggcagcggccccaaggaccccatggccagaaagatgagactgagaagaagaaaggacagcgcccaggacgaccaggccaagcaggtgctgaagggcatgagcgacgtggcccaggagaagaacaagaagcaggaggagagcgccgacgccagagcccccagcggcaaggtgagaagatgggaccagggcctggagaagcccagactggactacagcgagttcttcaccgaggacgtgggccagctgcccggcctgaccatctggcagatcgagaacttcgtgcccgtgctggtggaggaggccttccacggcaagttctacgaggccgactgctacatcgtgctgaagaccttcctggacgacagcggcagcctgaactgggagatctactactggatcggcggcgaggccaccctggacaagaaggcctgcagcgccatccacgccgtgaacctgagaaactacctgggcgccgagtgcagaaccgtgagagaggagatgggcgacgagagcgaggagttcctgcaggtgttcgacaacgacatcagctacatcgagggcggcaccgccagcggcttctacaccgtggaggacacccactacgtgaccagaatgtacagagtgtacggcaagaagaacatcaagctggagcccgtgcccctgaagggcaccagcctggaccccagattcgtgttcctgctggacagaggcctggacatctacgtgtggagaggcgcccaggccaccctgagcagcaccaccaaggccagactgttcgccgagaagatcaacaagaacgagagaaagggcaaggccgagatcaccctgctggtgcagggccaggagctgcccgagttctgggaggccctgggcggcgagcccagcgagatcaagaagaactgggacgacgtgctgaccgtggactacaccagaaacgccgaggccgtgctgcagagccccggcctgagcggcaaggtgaagagagacgccgagaagaaggaccagatgaaggccgacctgaccgccctgttcctgcccagacagccccccatgagcctggccgaggccgagcagctgatggaggagtggaacgaggacctggacggcatggagggcttcgtgctggagggcaagaagttcgccagactgcccgaggaggagttcggccacttctacacccaggactgctacgtgttcctgtgcagatactgggtgcccgtggagtacgaggaggaggagaagaaggaggacaaggaggagaaggccgagggcaaggagggcgaggaggccaccgccgaggccgaggagaagcagcccgaggaggacttccagtgcatcgtgtacttctggcagggcagagaggccagcaacatgggctggctgaccttcaccttcagcctgcagaagaagttcgagagcctgttccccggcaagctggaggtggtgagaatgacccagcagcaggagaaccccaagttcctgagccacttcaagagaaagttcatcatccacagaggcaagagaaaggccgtgcagggcgcccagcagcccagcctgtaccagatcagaaccaacggcagcgccctgtgcaccagatgcatccagatcaacaccgacagcagcctgctgaacagcgagttctgcttcatcctgaaggtgcccttcgagagcgaggacaaccagggcatcgtgtacgcctgggtgggcagagccagcgaccccgacgaggccaagctggccgaggacatcctgaacaccatgttcgacaccagctacagcaagcaggtgatcaacgagggcgaggagcccgagaacttcttctgggtgggcatcggcgcccagaagccctacgacgacgacgccgagtacatgaagcacaccagactgttcagatgcagcaacgagaagggctacttcgccgtgaccgagaagtgcagcgacttctgccaggacgacctggccgacgacgacatcatgctgctggacaacggccaggaggtgtacatgtgggtgggcacccagaccagccaggtggagatcaagctgagcctgaaggcctgccaggtgtacatccagcacatgagaagcaaggagcacgagagacccagaagactgagactggtgagaaagggcaacgagcagcacgccttcaccagatgcttccacgcctggagcgccttctgcaaggccctggcctag

SEQ ID NO: 81819 - DNA, 1284 bp, Artificial Sequence
  Description of Artificial Sequence: Synthetic coding sequence
atgttcttcacctgcggccccaacgaggccatggtggtgagcggcttctgcagaagcccccccgtgatggtggccggcggcagagtgttcgtgctgccctgcatccagcagatccagagaatcagcctgaacaccctgaccctgaacgtgaagagcgagaaggtgtacaccagacacggcgtgcccatcagcgtgaccggcatcgcccaggtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgcaggtggccaagaccaagcagcagatcgaggagcagagagtgcaggtgcaggtggtggagagagcccagcaggtggccgtgcaggagcaggagatcgccagaagagagaaggagctggaggccagagtgagaaagcccgccgaggccgagagatacaagctggagagactggccgaggccgagaagagccagctgatcatgcaggccgaggccgaggccgccagcgtgagaatgagaggcgaggccgaggccttcgccatcggcgccagagccagagccgaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgaccggcgaggtgctggacatcctgaccagactgcccgagagcgtggagagactgaccggcgtgagcatcagccaggtgaaccacaagcccctgagaaccgcctag

SEQ ID NO: 81820 - DNA, 1284 bp, Artificial Sequence; identical to SEQ ID NO: 81819
  Description of Artificial Sequence: Synthetic coding sequence

SEQ ID NO: 81821 - DNA, 1284 bp, Artificial Sequence; identical to SEQ ID NO: 81819
  Description of Artificial Sequence: Synthetic coding sequence

SEQ ID NO: 81822 - DNA, 438 bp, Artificial Sequence
  Description of Artificial Sequence: Synthetic coding sequence
atgggcgtggagggcaccggcagaggcggctgcagactgggcggccccgacggcaagggcaagggctgggcccccgtggacgccaccgccagactgccccacccccagagactgagcctgcccctgctgcagctgcagcccgagccctgcttcagcctggtggcccagatgagaccctggtggagccccgactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgtag

SEQ ID NO: 81823 - DNA, 579 bp, Artificial Sequence
  Description of Artificial Sequence: Synthetic coding sequence
atgttcttcacctgcggccccaacgaggccatggtggtgagcggcttctgcagaagcccccccgtgatggtggccggcggcagagtgttcgtgctgccctgcatccagcagatccagagaatcagcctgaacaccctgaccctgaacgtgaagagcgagaaggtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagtag

SEQ ID NO: 81824 - DNA, 579 bp, Artificial Sequence; identical to SEQ ID NO: 81823
  Description of Artificial Sequence: Synthetic coding sequence

SEQ ID NO: 81825 - DNA, 717 bp, Artificial Sequence
  Description of Artificial Sequence: Synthetic coding sequence
atgagaccctggtggagccccgtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgcaggtggccaagaccaagcagcagatcgaggagcagagagtgcaggtgcaggtggtggagagagcccagcaggtggccgtgcaggagcaggagatcgccagaagagagaaggagctggaggccagagtgagaaagcccgccgaggccgagagatacaagctggagagactggccgaggccgagtag

SEQ ID NO: 81826 - DNA, 579 bp, Artificial Sequence; identical to SEQ ID NO: 81823
  Description of Artificial Sequence: Synthetic coding sequence

SEQ ID NO: 81827 - DNA, 579 bp, Artificial Sequence; identical to SEQ ID NO: 81823
  Description of Artificial Sequence: Synthetic coding sequence

SEQ ID NO: 81828 - DNA, 438 bp, Artificial Sequence; identical to SEQ ID NO: 81822
  Description of Artificial Sequence: Synthetic coding sequence

SEQ ID NO: 81829 - DNA, 273 bp, Artificial Sequence
  Description of Artificial Sequence: Synthetic coding sequence
tgagccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgaccggcgaggtgctggacatcctgaccagactgcccgagagcgtggagagactgaccggcgtgagcatcagccaggtgaaccacaagcccctgagaaccgcctag

SEQ ID NO: 81830 - DNA, 708 bp, Artificial Sequence
  Description of Artificial Sequence: Synthetic coding sequence
atgttcttcacctgcggccccaacgaggccatggtggtgagcggcttctgcagaagcccccccgtgatggtggccggcggcagagtgttcgtgctgccctgcatccagcagatccagagaatcagcctgaacaccctgaccctgaacgtgaagagcgagaaggtgtacaccagacacggcgtgcccatcagcgtgaccggcatcgcccaggtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgactag

SEQ ID NO: 81831 - DNA, 717 bp, Artificial Sequence; identical to SEQ ID NO: 81825
  Description of Artificial Sequence: Synthetic coding sequence

SEQ ID NO: 81832 - DNA, 417 bp, Artificial Sequence
  Description of Artificial Sequence: Synthetic coding sequence
gtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagtag

SEQ ID NO: 81833 - DNA, 558 bp, Artificial Sequence
  Description of Artificial Sequence: Synthetic coding sequence
atgttcttcacctgcggccccaacgaggccatggtggtgagcggcttctgcagaagcccccccgtgatggtggccggcggcagagtgttcgtgctgccctgcatccagcagatccagagaatcagcctgaacaccctgaccctgaacgtgaagagcgagaaggtgtacaccagacacggcgtgcccatcagcgtgaccggcatcgcccaggtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagatag

SEQ ID NO: 81834 - DNA, 348 bp, Artificial Sequence
  Description of Artificial Sequence: Synthetic coding sequence
atgggcgtggagggcaccggcagaggcggctgcagactgggcggccccgacggcaagggcaagggctgggcccccgtggacgccaccgccagactgccccacccccagagactgagcctgcccctgctgcagctgcagcccgagccctgcttcagcctggtggcccagatgagaccctggtggagccccgactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggcctag

SEQ ID NO: 81835 - DNA, 561 bp, Artificial Sequence
  Description of Artificial Sequence: Synthetic coding sequence
gtggccaagaccaagcagcagatcgaggagcagagagtgcaggtgcaggtggtggagagagcccagcaggtggccgtgcaggagcaggagatcgccagaagagagaaggagctggaggccagagtgagaaagcccgccgaggccgagagatacaagctggagagactggccgaggccgagaagagccagctgatcatgcaggccgaggccgaggccgccagcgtgagaatgagaggcgaggccgaggccttcgccatcggcgccagagccagagccgaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgaccggcgaggtgctggacatcctgaccagactgcccgagagcgtggagagactgaccggcgtgagcatcagccaggtgaaccacaagcccctgagaaccgcctag

SEQ ID NO: 81836 - DNA, 438 bp, Artificial Sequence; identical to SEQ ID NO: 81822
  Description of Artificial Sequence: Synthetic coding sequence

SEQ ID NO: 81837 - DNA, 558 bp, Artificial Sequence; identical to SEQ ID NO: 81833
  Description of Artificial Sequence: Synthetic coding sequence

SEQ ID NO: 81838 - DNA, 633 bp, Artificial Sequence
  Description of Artificial Sequence: Synthetic coding sequence
atgttcttcacctgcggccccaacgaggccatggtggtgagcggcttctgcagaagcccccccgtgatggtggccggcggcagagtgttcgtgctgccctgcatccagcagatccagagaatcagcctgaacaccctgaccctgaacgtgaagagcgagaaggtgtacaccagacacggcgtgcccatcagcgtgaccggcatcgcccaggtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggcctag

SEQ ID NO: 81839 - DNA, 633 bp, Artificial Sequence; identical to SEQ ID NO: 81838
  Description of Artificial Sequence: Synthetic coding sequence

SEQ ID NO: 81840 - DNA, 759 bp, Artificial Sequence
  Description of Artificial Sequence: Synthetic coding sequence
atgttcttcacctgcggccccaacgaggccatggtggtgagcggcttctgcagaagcccccccgtgatggtggccggcggcagagtgttcgtgctgccctgcatccagcagatccagagaatcagcctgaacaccctgaccctgaacgtgaagagcgagaaggtgtacaccagacacggcgtgcccatcagcgtgaccggcatcgcccaggtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgcaggtggccaagaccaagcagcagatcgaggagcagtag

SEQ ID NO: 81841 - DNA, 444 bp, Artificial Sequence
  Description of Artificial Sequence: Synthetic coding sequence
atgagaccctggtggagccccgtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggcctag

SEQ ID NO: 81842 - DNA, 549 bp, Artificial Sequence
  Description of Artificial Sequence: Synthetic coding sequence
gtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgcaggtggccaagaccaagcagcagatcgaggagcagtag

SEQ ID NO: 81843 - DNA, 348 bp, Artificial Sequence
  Description of Artificial Sequence: Synthetic coding sequence
gtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagatag

SEQ ID NO: 81844 - DNA, 708 bp, Artificial Sequence; identical to SEQ ID NO: 81830
  Description of Artificial Sequence: Synthetic coding sequence

SEQ ID NO: 81845 - DNA, 1284 bp, Artificial Sequence; identical to SEQ ID NO: 81819
  Description of Artificial Sequence: Synthetic coding sequence

SEQ ID NO: 81846 - DNA, 498 bp, Artificial Sequence
  Description of Artificial Sequence: Synthetic coding sequence
gtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgactag

SEQ ID NO: 81847 - DNA, 438 bp, Artificial Sequence; identical to SEQ ID NO: 81822
  Description of Artificial Sequence: Synthetic coding sequence

SEQ ID NO: 81848 - DNA, 759 bp, Artificial Sequence; identical to SEQ ID NO: 81840
  Description of Artificial Sequence: Synthetic coding sequence

SEQ ID NO: 81849 - DNA, 759 bp, Artificial Sequence; identical to SEQ ID NO: 81840
  Description of Artificial Sequence: Synthetic coding sequence

SEQ ID NO: 81850 - DNA, 249 bp, Artificial Sequence
  Description of Artificial Sequence: Synthetic coding sequence
gactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgtag

SEQ ID NO: 81851 - DNA, 558 bp, Artificial Sequence; identical to SEQ ID NO: 81833
  Description of Artificial Sequence: Synthetic coding sequence

SEQ ID NO: 81852 - DNA, 759 bp, Artificial Sequence; identical to SEQ ID NO: 81840
  Description of Artificial Sequence: Synthetic coding sequence

SEQ ID NO: 81853 - DNA, 558 bp, Artificial Sequence; identical to SEQ ID NO: 81833
  Description of Artificial Sequence: Synthetic coding sequence

SEQ ID NO: 81854 - DNA, 717 bp, Artificial Sequence; identical to SEQ ID NO: 81825
  Description of Artificial Sequence: Synthetic coding sequence

SEQ ID NO: 81855 - DNA, 1284 bp, Artificial Sequence; identical to SEQ ID NO: 81819
  Description of Artificial Sequence: Synthetic coding sequence

SEQ ID NO: 81856 - DNA, 579 bp, Artificial Sequence; identical to SEQ ID NO: 81823
  Description of Artificial Sequence: Synthetic coding sequence

SEQ ID NO: 81857 - DNA, 708 bp, Artificial Sequence; identical to SEQ ID NO: 81830
  Description of Artificial Sequence: Synthetic coding sequence

SEQ ID NO: 81858 - DNA, 183 bp, Artificial Sequence
  Description of Artificial Sequence: Synthetic coding sequence
gtggccaagaccaagcagcagatcgaggagcagagagtgcaggtgcaggtggtggagagagcccagcaggtggccgtgcaggagcaggagatcgccagaagagagaaggagctggaggccagagtgagaaagcccgccgaggccgagagatacaagctggagagactggccgaggccgagtag

SEQ ID NO: 81859 - DNA, 717 bp, Artificial Sequence; identical to SEQ ID NO: 81825
  Description of Artificial Sequence: Synthetic coding sequence

SEQ ID NO: 81860 - DNA, 708 bp, Artificial Sequence; identical to SEQ ID NO: 81830
  Description of Artificial Sequence: Synthetic coding sequence

SEQ ID NO: 81861 - DNA, 1074 bp, Artificial Sequence
  Description of Artificial Sequence: Synthetic coding sequence
gtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgcaggtggccaagaccaagcagcagatcgaggagcagagagtgcaggtgcaggtggtggagagagcccagcaggtggccgtgcaggagcaggagatcgccagaagagagaaggagctggaggccagagtgagaaagcccgccgaggccgagagatacaagctggagagactggccgaggccgagaagagccagctgatcatgcaggccgaggccgaggccgccagcgtgagaatgagaggcgaggccgaggccttcgccatcggcgccagagccagagccgaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgaccggcgaggtgctggacatcctgaccagactgcccgagagcgtggagagactgaccggcgtgagcatcagccaggtgaaccacaagcccctgagaaccgcctag

SEQ ID NO: 81862 - DNA, 36 bp, Artificial Sequence
  Description of Artificial Sequence: Synthetic coding sequence
gtggccaagaccaagcagcagatcgaggagcagtag

SEQ ID NO: 81863 - DNA, 759 bp, Artificial Sequence; identical to SEQ ID NO: 81840
  Description of Artificial Sequence: Synthetic coding sequence

SEQ ID NO: 81864 - DNA, 708 bp, Artificial Sequence; identical to SEQ ID NO: 81830
  Description of Artificial Sequence: Synthetic coding sequence

SEQ ID NO: 81865 - DNA, 558 bp, Artificial Sequence; identical to SEQ ID NO: 81833
  Description of Artificial Sequence: Synthetic coding sequence

SEQ ID NO: 81866 - DNA, 438 bp, Artificial Sequence; identical to SEQ ID NO: 81822
  Description of Artificial Sequence: Synthetic coding sequence

SEQ ID NO: 81867 - DNA, 717 bp, Artificial Sequence; identical to SEQ ID NO: 81825
  Description of Artificial Sequence: Synthetic coding sequence

SEQ ID NO: 81868 - DNA, 1140 bp, Artificial Sequence
  Description of Artificial Sequence: Synthetic coding sequence
atgttcttcacctgcggccccaacgaggccatggtggtgagcggcttctgcagaagcccccccgtgatggtggccggcggcagagtgttcgtgctgccctgcatccagcagatccagagaatcagcctgaacaccctgaccctgaacgtgaagagcgagaaggtgtacaccagacacggcgtgcccatcagcgtgaccggcatcgcccaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgcaggtggccaagaccaagcagcagatcgaggagcagagagtgcaggtgcaggtggtggagagagcccagcaggtggccgtgcaggagcaggagatcgccagaagagagaaggagctggaggccagagtgagaaagcccgccgaggccgagagatacaagctggagagactggccgaggccgagaagagccagctgatcatgcaggccgaggccgaggccgccagcgtgagaatgagaggcgaggccgaggccttcgccatcggcgccagagccagagccgaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgaccggcgaggtgctggacatcctgaccagactgcccgagagcgtggagagactgaccggcgtgagcatcagccaggtgaaccacaagcccctgagaaccgcctag

SEQ ID NO: 81869 - DNA, 558 bp, Artificial Sequence; identical to SEQ ID NO: 81833
  Description of Artificial Sequence: Synthetic coding sequence

SEQ ID NO: 81870 - DNA, 696 bp, Artificial Sequence
  Description of Artificial Sequence: Synthetic coding sequence
gtgaagatccagggccagaacaaggagatgctggccgccgcctgccagatgttcctgggcaagaccgaggccgagatcgcccacatcgccctggagaccctggagggccaccagagagccatcatggcccacatgaccgtggaggagatctacaaggacagacagaagttcagcgagcaggtgttcaaggtggccagcagcgacctggtgaacatgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgcaggtggccaagaccaagcagcagatcgaggagcagagagtgcaggtgcaggtggtggagagagcccagcaggtggccgtgcaggagcaggagatcgccagaagagagaaggagctggaggccagagtgagaaagcccgccgaggccgagagatacaagctggagagactggccgaggccgagtag

SEQ ID NO: 81871 - DNA, 633 bp, Artificial Sequence; identical to SEQ ID NO: 81838
  Description of Artificial Sequence: Synthetic coding sequence

SEQ ID NO: 81872 - DNA, 579 bp, Artificial Sequence; identical to SEQ ID NO: 81823
  Description of Artificial Sequence: Synthetic coding sequence

SEQ ID NO: 81873 - DNA, 1140 bp, Artificial Sequence; identical to SEQ ID NO: 81868
  Description of Artificial Sequence: Synthetic coding sequence

SEQ ID NO: 81874 - DNA, 1140 bp, Artificial Sequence; identical to SEQ ID NO: 81868
  Description of Artificial Sequence: Synthetic coding sequence

SEQ ID NO: 81875 - DNA, 1140 bp, Artificial Sequence; identical to SEQ ID NO: 81868
  Description of Artificial Sequence: Synthetic coding sequence

SEQ ID NO: 81876 - DNA, 1140 bp, Artificial Sequence; identical to SEQ ID NO: 81868
  Description of Artificial Sequence: Synthetic coding sequence

SEQ ID NO: 81877 - DNA, 861 bp, Artificial Sequence
  Description of Artificial Sequence: Synthetic coding sequence
atgggcatcagcgtggtgagctacaccctgaaggacatccacgacgaccaggactacctgcacagcctgggcaaggccagaaccgcccaggtgcagaaggacgccagaatcggcgaggccgaggccaagagagacgccggcatcagagaggccaaggccaagcaggagaaggtgagcgcccagtacctgagcgagatcgagatggccaaggcccagagagactacgagctgaagaaggccgcctacgacatcgaggtgaacaccagaagagcccaggccgacctggcctaccagctgcaggtggccaagaccaagcagcagatcgaggagcagagagtgcaggtgcaggtggtggagagagcccagcaggtggccgtgcaggagcaggagatcgccagaagagagaaggagctggaggccagagtgagaaagcccgccgaggccgagagatacaagctggagagactggccgaggccgagaagagccagctgatcatgcaggccgaggccgaggccgccagcgtgagaatgagaggcgaggccgaggccttcgccatcggcgccagagccagagccgaggccgagcagatggccaagaaggccgaggccttccagctgtaccaggaggccgcccagctggacatgctgctggagaagctgccccaggtggccgaggagatcagcggccccctgaccagcgccaacaagatcaccctggtgagcagcggcagcggcaccatgggcgccgccaaggtgaccggcgaggtgctggacatcctgaccagactgcccgagagcgtggagagactgaccggcgtgagcatcagccaggtgaaccacaagcccctgagaaccgcctag

SEQ ID NO: 81878 - DNA, 1452 bp, Artificial Sequence
  Description of Artificial Sequence: Synthetic coding sequence
atgggcaactgccacaccgtgggccccaacgaggccctggtggtgagcggcggctgctgcggcagcgactacaagcagtacgtgttcggcggctgggcctgggcctggtggtgcatcagcgacacccagagactgagcctggaggtgatgaccatcctgtgcagatgcgagaacatcgagaccagcgagggcgtgcccctgttcgtgaccggcgtggcccaggtgccctgcccctgcctgctggactgcaagtggggcaacagcaagggcttctggaagctgtgccaggtgtgccagatcagcctggagatcatgaccctgcagcccagatgcgaggacgtggagaccgccgagggcgtggccctgaccgtgaccggcgtggcccaggtgaagatcatgaccgagaaggagctgctggccgtggcctgcgagcagttcctgggcaagaacgtgcaggacatcaagaacgtggtgctgcagaccctggagggccacctgagaagcatcctgggcaccctgaccgtggagcagatctaccaggacagagaccagttcgccaagctggtgagagaggtggccgcccccgacgtgggcagaatgggcatcgagatcctgagcttcaccatcaaggacgtgtacgacaaggtggactacctgagcagcctgggcaagacccagaccgccgtggtgcagagagacgccgacatcggcgtggccgaggccgagagagacgccggcatcagagaggccgagtgcaagaaggagatgctggacgtgaagttcatggccgacaccaagatcgccgacagcaagagagccttcgagctgcagaagagcgccttcagcgaggaggtgaacatcaagaccgccgaggcccagctggcctacgagctgcagggcgccagagagcagcagaagatcagacaggaggagatcgagatcgaggtggtgcagagaaagaagcagatcgccgtggaggcccaggagatcctgagaaccgacaaggagctgatcgccaccgtgagaagacccgccgaggccgaggcccacagaatccagcagatcgccgagggcgagaaggtgaagcaggtgctgctggcccaggccgaggccgagaagatcagaaagatcggcgaggccgaggccgccgtgatcgaggccatgggcaaggccgaggccgagagaatgaagctgaaggccgaggcctaccagaagtacggcgacgccgccaagatggccctggtgctggaggccctgccccagatcgccgccaagatcgccgcccccctgaccaaggtggacgagatcgtggtgctgagcggcgacaacagcaaggtgaccagcgaggtgaacagactgctggccgagctgcccgccagcgtgcacgccctgaccggcgtggacctgagcaagatccccctgatcaagaaggccaccggcgtgcaggtgtag

SEQ ID NO: 81879 - DNA, 1287 bp, Artificial Sequence
  Description of Artificial Sequence: Synthetic coding sequence
atgggcaactgccacaccgtgggccccaacgaggccctggtggtgagcggcggctgctgcggcagcgactacaagcagtacgtgttcggcggctgggcctgggcctggtggtgcatcagcgacacccagagaatcagcctggagatcatgaccctgcagcccagatgcgaggacgtggagaccgccgagggcgtggccctgaccgtgaccggcgtggcccaggtgaagatcatgaccgagaaggagctgctggccgtggcctgcgagcagttcctgggcaagaacgtgcaggacatcaagaacgtggtgctgcagaccctggagggccacctgagaagcatcctgggcaccctgaccgtggagcagatctaccaggacagagaccagttcgccaagctggtgagagaggtggccgcccccgacgtgggcagaatgggcatcgagatcctgagcttcaccatcaaggacgtgtacgacaaggtggactacctgagcagcctgggcaagacccagaccgccgtggtgcagagagacgccgacatcggcgtggccgaggccgagagagacgccggcatcagagaggccgagtgcaagaaggagatgctggacgtgaagttcatggccgacaccaagatcgccgacagcaagagagccttcgagctgcagaagagcgccttcagcgaggaggtgaacatcaagaccgccgaggcccagctggcctacgagctgcagggcgccagagagcagcagaagatcagacaggaggagatcgagatcgaggtggtgcagagaaagaagcagatcgccgtggaggcccaggagatcctgagaaccgacaaggagctgatcgccaccgtgagaagacccgccgaggccgaggcccacagaatccagcagatcgccgagggcgagaaggtgaagcaggtgctgctggcccaggccgaggccgagaagatcagaaagatcggcgaggccgaggccgccgtgatcgaggccatgggcaaggccgaggccgagagaatgaagctgaaggccgaggcctaccagaagtacggcgacgccgccaagatggccctggtgctggaggccctgccccagatcgccgccaagatcgccgcccccctgaccaaggtggacgagatcgtggtgctgagcggcgacaacagcaaggtgaccagcgaggtgaacagactgctggccgagctgcccgccagcgtgcacgccctgaccggcgtggacctgagcaagatccccctgatcaagaaggccaccggcgtgcaggtgtag

SEQ ID NO: 81880 - DNA, 2982 bp, Artificial Sequence
  Description of Artificial Sequence: Synthetic coding sequence
atgcccgccctggccagagacggcggccagctgcccctgctggtggtgttcagcgccatgatcttcggcaccatcaccaaccaggacctgcccgtgatcaagtgcgtgctgatcaaccacaagaacaacgacagcagcgtgggcaagagcagcagctaccccatggtgagcgagagccccgaggacctgggctgcgccctgagaccccagagcagcggcaccgtgtacgaggccgccgccgtggaggtggacgtgagcgccagcatcaccctgcaggtgctggtggacgcccccggcaacatcagctgcctgtgggtgttcaagcacagcagcctgaactgccagccccacttcgacctgcagaacagaggcgtggtgagcatggtgatcctgaagatgaccgagacccaggccggcgagtacctgctgttcatccagagcgaggccaccaactacaccatcctgttcaccgtgagcatcagaaacaccctgctgtacaccctgagaagaccctacttcagaaagatggagaaccaggacgccctggtgtgcatcagcgagagcgtgcccgagcccatcgtggagtgggtgctgtgcgacagccagggcgagagctgcaaggaggagagccccgccgtggtgaagaaggaggagaaggtgctgcacgagctgttcggcaccgacatcagatgctgcgccagaaacgagctgggcagagagtgcaccagactgttcaccatcgacctgaaccagaccccccagaccaccctgccccagctgttcctgaaggtgggcgagcccctgtggatcagatgcaaggccgtgcacgtgaaccacggcttcggcctgacctgggagctggagaacaaggccctggaggagggcaactacttcgagatgagcacctacagcaccaacagaaccatgatcagaatcctgttcgccttcgtgagcagcgtggccagaaacgacaccggctactacacctgcagcagcagcaagcaccccagccagagcgccctggtgaccatcgtggagaagggcttcatcaacgccaccaacagcagcgaggactacgagatcgaccagtacgaggagttctgcttcagcgtgagattcaaggcctacccccagatcagatgcacctggaccttcagcagaaagagcttcccctgcgagcagaagggcctggacaacggctacagcatcagcaagttctgcaaccacaagcaccagcccggcgagtacatcttccacgccgagaacgacgacgcccagttcaccaagatgttcaccctgaacatcagaagaaagccccaggtgctggccgaggccagcgccagccaggccagctgcttcagcgacggctaccccctgcccagctggacctggaagaagtgcagcgacaagagccccaactgcaccgaggagatcaccgagggcgtgtggaacagaaaggccaacagaaaggtgttcggccagtgggtgagcagcagcaccctgaacatgagcgaggccatcaagggcttcctggtgaagtgctgcgcctacaacagcctgggcaccagctgcgagaccatcctgctgaacagccccggccccttccccttcatccaggacaacatcagcttctacgccaccatcggcgtgtgcctgctgttcatcgtggtgctgaccctgctgatctgccacaagtacaagaagcagttcagatacgagagccagctgcagatggtgcaggtgaccggcagcagcgacaacgagtacttctacgtggacttcagagagtacgagtacgacctgaagtgggagttccccagagagaacctggagttcggcaaggtgctgggcagcggcgccttcggcaaggtgatgaacgccaccgcctacggcatcagcaagaccggcgtgagcatccaggtggccgtgaagatgctgaaggagaaggccgacagcagcgagagagaggccctgatgagcgagctgaagatgatgacccagctgggcagccacgagaacatcgtgaacctgctgggcgcctgcaccctgagcggccccatctacctgatcttcgagtactgctgctacggcgacctgctgaactacctgagaagcaagagagagaagttccacagaacctggaccgagatcttcaaggagcacaacttcagcttctaccccaccttccagagccaccccaacagcagcatgcccggcagcagagaggtgcagatccaccccgacagcgaccagatcagcggcctgcacggcaacagcttccacagcgaggacgagatcgagtacgagaaccagaagagactggaggaggaggaggacctgaacgtgctgaccttcgaggacctgctgtgcttcgcctaccaggtggccaagggcatggagttcctggagttcaagagctgcgtgcacagagacctggccgccagaaacgtgctggtgacccacggcaaggtggtgaagatctgcgacttcggcctggccagagacatcatgagcgacagcaactacgtggtgagaggcaacgccagactgcccgtgaagtggatggcccccgagagcctgttcgagggcatctacaccatcaagagcgacgtgtggagctacggcatcctgctgtgggagatcttcagcctgggcgtgaacccctaccccggcatccccgtggacgccaacttctacaagctgatccagaacggcttcaagatggaccagcccttctacgccaccgaggagatctacatcatcatgcagagctgctgggccttcgacagcagaaagagacccagcttccccaacctgaccagcttcctgggctgccagctggccgacgccgaggaggccatgtaccagaacgtggacggcagagtgagcgagtgcccccacacctaccagaacagaagacccttcagcagagagatggacctgggcctgctgagcccccaggcccaggtggaggacagctag

SEQ ID NO: 81881 - DNA, 2991 bp, Artificial Sequence
  Description of Artificial Sequence: Synthetic coding sequence
atgcccgccctggccagagacggcggccagctgcccctgctggtggtgttcagcgccatgatcttcggcaccatcaccaaccaggacctgcccgtgatcaagtgcgtgctgatcaaccacaagaacaacgacagcagcgtgggcaagagcagcagctaccccatggtgagcgagagccccgaggacctgggctgcgccctgagaccccagagcagcggcaccgtgtacgaggccgccgccgtggaggtggacgtgagcgccagcatcaccctgcaggtgctggtggacgcccccggcaacatcagctgcctgtgggtgttcaagcacagcagcctgaactgccagccccacttcgacctgcagaacagaggcgtggtgagcatggtgatcctgaagatgaccgagacccaggccggcgagtacctgctgttcatccagagcgaggccaccaactacaccatcctgttcaccgtgagcatcagaaacaccctgctgtacaccctgagaagaccctacttcagaaagatggagaaccaggacgccctggtgtgcatcagcgagagcgtgcccgagcccatcgtggagtgggtgctgtgcgacagccagggcgagagctgcaaggaggagagccccgccgtggtgaagaaggaggagaaggtgctgcacgagctgttcggcaccgacatcagatgctgcgccagaaacgagctgggcagagagtgcaccagactgttcaccatcgacctgaaccagaccccccagaccaccctgccccagctgttcctgaaggtgggcgagcccctgtggatcagatgcaaggccgtgcacgtgaaccacggcttcggcctgacctgggagctggagaacaaggccctggaggagggcaactacttcgagatgagcacctacagcaccaacagaaccatgatcagaatcctgttcgccttcgtgagcagcgtggccagaaacgacaccggctactacacctgcagcagcagcaagcaccccagccagagcgccctggtgaccatcgtggagaagggcttcatcaacgccaccaacagcagcgaggactacgagatcgaccagtacgaggagttctgcttcagcgtgagattcaaggcctacccccagatcagatgcacctggaccttcagcagaaagagcttcccctgcgagcagaagggcctggacaacggctacagcatcagcaagttctgcaaccacaagcaccagcccggcgagtacatcttccacgccgagaacgacgacgcccagttcaccaagatgttcaccctgaacatcagaagaaagccccaggtgctggccgaggccagcgccagccaggccagctgcttcagcgacggctaccccctgcccagctggacctggaagaagtgcagcgacaagagccccaactgcaccgaggagatcaccgagggcgtgtggaacagaaaggccaacagaaaggtgttcggccagtgggtgagcagcagcaccctgaacatgagcgaggccatcaagggcttcctggtgaagtgctgcgcctacaacagcctgggcaccagctgcgagaccatcctgctgaacagccccggccccttccccttcatccaggacaacatcagcttctacgccaccatcggcgtgtgcctgctgttcatcgtggtgctgaccctgctgatctgccacaagtacaagaagcagttcagatacgagagccagctgcagatggtgcaggtgaccggcagcagcgacaacgagtacttctacgtggacttcagagagtacgagtacgacctgaagtgggagttccccagagagaacctggagttcggcaaggtgctgggcagcggcgccttcggcaaggtgatgaacgccaccgcctacggcatcagcaagaccggcgtgagcatccaggtggccgtgaagatgctgaaggagaaggccgacagcagcgagagagaggccctgatgagcgagctgaagatgatgacccagctgggcagccacgagaacatcgtgaacctgctgggcgcctgcaccctgagcggccccatctacctgatcttcgagtactgctgctacggcgacctgctgaactacctgagaagcaagagagagaagttccacagaacctggaccgagatcttcaaggagcacaacttcagcttctaccccaccttccagagccaccccaacagcagcatgcccggcagcagagaggtgcagatccaccccgacagcgaccagatcagcggcctgcacggcaacagcttccacagcgaggacgagatcgagtacgagaaccagaagagactggaggaggaggaggacctgaacgtgctgaccttcgaggacctgctgtgcttcgcctaccaggtggccaagggcatggagttcctggagttcaagagctgcgtgcacagagacctggccgccagaaacgtgctggtgacccacggcaaggtggtgaagatctgcgacttcggcctggccagagacatcatgagcgacagcaactacgtggtgagaggcaacgtgagactggccagactgcccgtgaagtggatggcccccgagagcctgttcgagggcatctacaccatcaagagcgacgtgtggagctacggcatcctgctgtgggagatcttcagcctgggcgtgaacccctaccccggcatccccgtggacgccaacttctacaagctgatccagaacggcttcaagatggaccagcccttctacgccaccgaggagatctacatcatcatgcagagctgctgggccttcgacagcagaaagagacccagcttccccaacctgaccagcttcctgggctgccagctggccgacgccgaggaggccatgtaccagaacgtggacggcagagtgagcgagtgcccccacacctaccagaacagaagacccttcagcagagagatggacctgggcctgctgagcccccaggcccaggtggaggacagctag

SEQ ID NO: 81882 - DNA, 2859 bp, Artificial Sequence
  Description of Artificial Sequence: Synthetic coding sequence
atgcccgccctggccagagacggcggccagctgcccctgctggtggtgttcagcgccatgatcttcggcaccatcaccaaccaggacctgcccgtgatcaagtgcgtgctgatcaaccacaagaacaacgacagcagcgtgggcaagagcagcagctaccccatggtgagcgagagccccgaggacctgggctgcgccctgagaccccagagcagcggcaccgtgtacgaggccgccgccgtggaggtggacgtgagcgccagcatcaccctgcaggtgctggtggacgcccccggcaacatcagctgcctgtgggtgttcaagcacagcagcctgaactgccagccccacttcgacctgcagaacagaggcgtggtgagcatggtgatcctgaagatgaccgagacccaggccggcgagtacctgctgttcatccagagcgaggccaccaactacaccatcctgttcaccgtgagcatcagaaacaccctgctgtacaccctgagaagaccctacttcagaaagatggagaaccaggacgccctggtgtgcatcagcgagagcgtgcccgagcccatcgtggagtgggtgctgtgcgacagccagggcgagagctgcaaggaggagagccccgccgtggtgaagaaggaggagaaggtgctgcacgagctgttcggcaccgacatcagatgctgcgccagaaacgagctgggcagagagtgcaccagactgttcaccatcgacctgaaccagaccccccagaccaccctgccccagctgttcctgaaggtgggcgagcccctgtggatcagatgcaaggccgtgcacgtgaaccacggcttcggcctgacctgggagctggagaacaaggccctggaggagggcaactacttcgagatgagcacctacagcaccaacagaaccatgatcagaatcctgttcgccttcgtgagcagcgtggccagaaacgacaccggctactacacctgcagcagcagcaagcaccccagccagagcgccctggtgaccatcgtggagaagggcttcatcaacgccaccaacagcagcgaggactacgagatcgaccagtacgaggagttctgcttcagcgtgagattcaaggcctacccccagatcagatgcacctggaccttcagcagaaagagcttcccctgcgagcagaagggcctggacaacggctacagcatcagcaagttctgcaaccacaagcaccagcccggcgagtacatcttccacgccgagaacgacgacgcccagttcaccaagatgttcaccctgaacatcagaagaaagccccaggtgctggccgaggccagcgccagccaggccagctgcttcagcgacggctaccccctgcccagctggacctggaagaagtgcagcgacaagagccccaactgcaccgaggagatcaccgagggcgtgtggaacagaaaggccaacagaaaggtgttcggccagtgggtgagcagcagcaccctgaacatgagcgaggccatcaagggcttcctggtgaagtgctgcgcctacaacagcctgggcaccagctgcgagaccatcctgctgaacagccccggccccttccccttcatccaggacaacatcagcttctacgccaccatcggcgtgtgcctgctgttcatcgtggtgctgaccctgctgatctgccacaagtacaagaagcagttcagatacgagagccagctgcagatggtgcaggtgaccggcagcagcgacaacgagtacttctacgtggacttcagagagtacgagtacgacctgaagtgggagttccccagagagaacctggagttcggcaaggtgctgggcagcggcgccttcggcaaggtgatgaacgccaccgcctacggcatcagcaagaccggcgtgagcatccaggtggccgtgaagatgctgaaggagaaggccgacagcagcgagagagaggccctgatgagcgagctgaagatgatgacccagctgggcagccacgagaacatcgtgaacctgctgggcgcctgcaccctgagcggccccatctacctgatcttcgagtactgctgctacggcgacctgctgaactacctgagaagcaagagagagaagttccacagaacctggaccgagatcttcaaggagcacaacttcagcttctaccccaccttccagagccaccccaacagcagcatgcccggcagcagagaggtgcagatccaccccgacagcgaccagatcagcggcctgcacggcaacagcttccacagcgaggacgagatcgagtacgagaaccagaagagactggaggaggaggaggacctgaacgtgctgaccttcgaggacctgctgtgcttcgcctaccaggtggccaagggcatggagttcctggagttcaagagcgccagactgcccgtgaagtggatggcccccgagagcctgttcgagggcatctacaccatcaagagcgacgtgtggagctacggcatcctgctgtgggagatcttcagcctgggcgtgaacccctaccccggcatccccgtggacgccaacttctacaagctgatccagaacggcttcaagatggaccagcccttctacgccaccgaggagatctacatcatcatgcagagctgctgggccttcgacagcagaaagagacccagcttccccaacctgaccagcttcctgggctgccagctggccgacgccgaggaggccatgtaccagaacgtggacggcagagtgagcgagtgcccccacacctaccagaacagaagacccttcagcagagagatggacctgggcctgctgagcccccaggcccaggtggaggacagctag

SEQ ID NO: 81883 - DNA, 2253 bp, Artificial Sequence
  Description of Artificial Sequence: Synthetic coding sequence
atgtggaacctgctgcacgagaccgacagcgccgtggccaccgccagaagacccagatggctgtgcgccggcgccctggtgctggccggcggcttcttcctgctgggcttcctgttcggctggttcatcaagagcagcaacgaggccaccaacatcacccccaagcacaacatgaaggccttcctggacgagctgaaggccgagaacatcaagaagttcctgtacaacttcacccagatcccccacctggccggcaccgagcagaacttccagctggccaagcagatccagagccagtggaaggagttcggcctggacagcgtggagctggcccactacgacgtgctgctgagctaccccaacaagacccaccccaactacatcagcatcatcaacgaggacggcaacgagatcttcaacaccagcctgttcgagccccccccccccggctacgagaacgtgagcgacatcgtgccccccttcagcgccttcagcccccagggcatgcccgagggcgacctggtgtacgtgaactacgccagaaccgaggacttcttcaagctggagagagacatgaagatcaactgcagcggcaagatcgtgatcgccagatacggcaaggtgttcagaggcaacaaggtgaagaacgcccagctggccggcgccaagggcgtgatcctgtacagcgaccccgccgactacttcgcccccggcgtgaagagctaccccgacggctggaacctgcccggcggcggcgtgcagagaggcaacatcctgaacctgaacggcgccggcgaccccctgacccccggctaccccgccaacgagtacgcctacagaagaggcatcgccgaggccgtgggcctgcccagcatccccgtgcaccccatcggctactacgacgcccagaagctgctggagaagatgggcggcagcgccccccccgacagcagctggagaggcagcctgaaggtgccctacaacgtgggccccggcttcaccggcaacttcagcacccagaaggtgaagatgcacatccacagcaccaacgaggtgaccagaatctacaacgtgatcggcaccctgagaggcgccgtggagcccgacagatacgtgatcctgggcggccacagagacagctgggtgttcggcggcatcgacccccagagcggcgccgccgtggtgcacgagatcgtgagaagcttcggcaccctgaagaaggagggctggagacccagaagaaccatcctgttcgccagctgggacgccgaggagttcggcctgctgggcagcaccgagtgggccgaggagaacagcagactgctgcaggagagaggcgtggcctacatcaacgccgacagcagcatcgagggcaactacaccctgagagtggactgcacccccctgatgtacagcctggtgcacaacctgaccaaggagctgaagagccccgacgagggcttcgagggcaagagcctgtacgagagctggaccaagaagagccccagccccgagttcagcggcatgcccagaatcagcaagctgggcagcggcaacgacttcgaggtgttcttccagagactgggcatcgccagcggcagagccagatacaccaagaactgggagaccaacaagttcagcggctaccccctgtaccacagcgtgtacgagacctacgagctggtggagaagttctacgaccccatgttcaagtaccacctgaccgtggcccaggtgagaggcggcatggtgttcgagctggccaacagcatcgtgctgcccttcgactgcagagactacgccgtggtgctgagaaagtacgccgacaagatctacagcatcagcatgaagcacccccaggagatgaagacctacagcgtgagcttcgacagcctgttcagcgccgtgaagaacttcaccgagatcgccagcaagttcagcgagagactgcaggacttcgacaagagcaaccccatcgtgctgagaatgatgaacgaccagctgatgttcctggagagagccttcatcgaccccctgggcctgcccgacagacccttctacagacacgtgatctacgcccccagcagccacaacaagtacgccggcgagagcttccccggcatctacgacgccctgttcgacatcgagagcaaggtggaccccagcaaggcctggggcgaggtgaagagacagatctacgtggccgccttcaccgtgcaggccgccgccgagaccctgagcgaggtggcctag

SEQ ID NO: 81884 - DNA, 2208 bp, Artificial Sequence
  Description of Artificial Sequence: Synthetic coding sequence
atgaccgccggcagcagctaccccctgttcctggccgcctacgcctgcaccggctgcctggccgagagactgggctggttcatcaagagcagcaacgaggccaccaacatcacccccaagcacaacatgaaggccttcctggacgagctgaaggccgagaacatcaagaagttcctgtacaacttcacccagatcccccacctggccggcaccgagcagaacttccagctggccaagcagatccagagccagtggaaggagttcggcctggacagcgtggagctggcccactacgacgtgctgctgagctaccccaacaagacccaccccaactacatcagcatcatcaacgaggacggcaacgagatcttcaacaccagcctgttcgagccccccccccccggctacgagaacgtgagcgacatcgtgccccccttcagcgccttcagcccccagggcatgcccgagggcgacctggtgtacgtgaactacgccagaaccgaggacttcttcaagctggagagagacatgaagatcaactgcagcggcaagatcgtgatcgccagatacggcaaggtgttcagaggcaacaaggtgaagaacgcccagctggccggcgccaagggcgtgatcctgtacagcgaccccgccgactacttcgcccccggcgtgaagagctaccccgacggctggaacctgcccggcggcggcgtgcagagaggcaacatcctgaacctgaacggcgccggcgaccccctgacccccggctaccccgccaacgagtacgcctacagaagaggcatcgccgaggccgtgggcctgcccagcatccccgtgcaccccatcggctactacgacgcccagaagctgctggagaagatgggcggcagcgccccccccgacagcagctggagaggcagcctgaaggtgccctacaacgtgggccccggcttcaccggcaacttcagcacccagaaggtgaagatgcacatccacagcaccaacgaggtgaccagaatctacaacgtgatcggcaccctgagaggcgccgtggagcccgacagatacgtgatcctgggcggccacagagacagctgggtgttcggcggcatcgacccccagagcggcgccgccgtggtgcacgagatcgtgagaagcttcggcaccctgaagaaggagggctggagacccagaagaaccatcctgttcgccagctgggacgccgaggagttcggcctgctgggcagcaccgagtgggccgaggagaacagcagactgctgcaggagagaggcgtggcctacatcaacgccgacagcagcatcgagggcaactacaccctgagagtggactgcacccccctgatgtacagcctggtgcacaacctgaccaaggagctgaagagccccgacgagggcttcgagggcaagagcctgtacgagagctggaccaagaagagccccagccccgagttcagcggcatgcccagaatcagcaagctgggcagcggcaacgacttcgaggtgttcttccagagactgggcatcgccagcggcagagccagatacaccaagaactgggagaccaacaagttcagcggctaccccctgtaccacagcgtgtacgagacctacgagctggtggagaagttctacgaccccatgttcaagtaccacctgaccgtggcccaggtgagaggcggcatggtgttcgagctggccaacagcatcgtgctgcccttcgactgcagagactacgccgtggtgctgagaaagtacgccgacaagatctacagcatcagcatgaagcacccccaggagatgaagacctacagcgtgagcttcgacagcctgttcagcgccgtgaagaacttcaccgagatcgccagcaagttcagcgagagactgcaggacttcgacaagagcaaccccatcgtgctgagaatgatgaacgaccagctgatgttcctggagagagccttcatcgaccccctgggcctgcccgacagacccttctacagacacgtgatctacgcccccagcagccacaacaagtacgccggcgagagcttccccggcatctacgacgccctgttcgacatcgagagcaaggtggaccccagcaaggcctggggcgaggtgaagagacagatctacgtggccgccttcaccgtgcaggccgccgccgagaccctgagcgaggtggcctag

SEQ ID NO: 81885 - DNA, 1329 bp, Artificial Sequence
  Description of Artificial Sequence: Synthetic coding sequence
atgggcggcagcgccccccccgacagcagctggagaggcagcctgaaggtgccctacaacgtgggccccggcttcaccggcaacttcagcacccagaaggtgaagatgcacatccacagcaccaacgaggtgaccagaatctacaacgtgatcggcaccctgagaggcgccgtggagcccgacagatacgtgatcctgggcggccacagagacagctgggtgttcggcggcatcgacccccagagcggcgccgccgtggtgcacgagatcgtgagaagcttcggcaccctgaagaaggagggctggagacccagaagaaccatcctgttcgccagctgggacgccgaggagttcggcctgctgggcagcaccgagtgggccgaggagaacagcagactgctgcaggagagaggcgtggcctacatcaacgccgacagcagcatcgagggcaactacaccctgagagtggactgcacccccctgatgtacagcctggtgcacaacctgaccaaggagctgaagagccccgacgagggcttcgagggcaagagcctgtacgagagctggaccaagaagagccccagccccgagttcagcggcatgcccagaatcagcaagctgggcagcggcaacgacttcgaggtgttcttccagagactgggcatcgccagcggcagagccagatacaccaagaactgggagaccaacaagttcagcggctaccccctgtaccacagcgtgtacgagacctacgagctggtggagaagttctacgaccccatgttcaagtaccacctgaccgtggcccaggtgagaggcggcatggtgttcgagctggccaacagcatcgtgctgcccttcgactgcagagactacgccgtggtgctgagaaagtacgccgacaagatctacagcatcagcatgaagcacccccaggagatgaagacctacagcgtgagcttcgacagcctgttcagcgccgtgaagaacttcaccgagatcgccagcaagttcagcgagagactgcaggacttcgacaagagcaaccccatcgtgctgagaatgatgaacgaccagctgatgttcctggagagagccttcatcgaccccctgggcctgcccgacagacccttctacagacacgtgatctacgcccccagcagccacaacaagtacgccggcgagagcttccccggcatctacgacgccctgttcgacatcgagagcaaggtggaccccagcaaggcctggggcgaggtgaagagacagatctacgtggccgccttcaccgtgcaggccgccgccgagaccctgagcgaggtggcctag

SEQ ID NO: 81886 - DNA, 2160 bp, Artificial Sequence
  Description of Artificial Sequence: Synthetic coding sequence
atgtggaacctgctgcacgagaccgacagcgccgtggccaccgccagaagacccagatggctgtgcgccggcgccctggtgctggccggcggcttcttcctgctgggcttcctgttcggctggttcatcaagagcagcaacgaggccaccaacatcacccccaagcacaacatgaaggccttcctggacgagctgaaggccgagaacatcaagaagttcctgtacaacttcacccagatcccccacctggccggcaccgagcagaacttccagctggccaagcagatccagagccagtggaaggagttcggcctggacagcgtggagctggcccactacgacgtgctgctgagctaccccaacaagacccaccccaactacatcagcatcatcaacgaggacggcaacgagatcttcaacaccagcctgttcgagccccccccccccggctacgagaacgtgagcgacatcgtgccccccttcagcgccttcagcccccagggcatgcccgagggcgacctggtgtacgtgaactacgccagaaccgaggacttcttcaagctggagagagacatgaagatcaactgcagcggcaagatcgtgatcgccagatacggcaaggtgttcagaggcaacaaggtgaagaacgcccagctggccggcgccaagggcgtgatcctgtacagcgaccccgccgactacttcgcccccggcgtgaagagctaccccgacggctggaacctgcccggcggcggcgtgcagagaggcaacatcctgaacctgaacggcgccggcgaccccctgacccccggctaccccgccaacgagtacgcctacagaagaggcatcgccgaggccgtgggcctgcccagcatccccgtgcaccccatcggctactacgacgcccagaagctgctggagaagatgggcggcagcgccccccccgacagcagctggagaggcagcctgaaggtgccctacaacgtgggccccggcttcaccggcaacttcagcacccagaaggtgaagatgcacatccacagcaccaacgaggtgaccagaatctacaacgtgatcggcaccctgagaggcgccgtggagcccgacagatacgtgatcctgggcggccacagagacagctgggtgttcggcggcatcgacccccagagcggcgccgccgtggtgcacgagatcgtgagaagcttcggcaccctgaagaaggagggctggagacccagaagaaccatcctgttcgccagctgggacgccgaggagttcggcctgctgggcagcaccgagtgggccgaggagaacagcagactgctgcaggagagaggcgtggcctacatcaacgccgacagcagcatcgagggcaactacaccctgagagtggactgcacccccctgatgtacagcctggtgcacaacctgaccaaggagctgaagagccccgacgagggcttcgagggcaagagcctgtacgagagctggaccaagaagagccccagccccgagttcagcggcatgcccagaatcagcaagctgggcagcggcaacgacttcgaggtgttcttccagagactgggcatcgccagcggcagagccagatacaccaagaactgggagaccaacaagttcagcggctaccccctgtaccacagcgtgtacgagacctacgagctggtggagaagttctacgaccccatgttcaagtaccacctgaccgtggcccaggtgagaggcggcatggtgttcgagctggccaacagcatcgtgctgcccttcgactgcagagactacgccgtggtgctgagaaagtacgccgacaagatctacagcatcagcatgaagcacccccaggagatgaagacctacagcgtgagcttcgacagcctgttcagcgccgtgaagaacttcaccgagatcgccagcaagttcagcgagagactgcaggacttcgacaagagcaagcacgtgatctacgcccccagcagccacaacaagtacgccggcgagagcttccccggcatctacgacgccctgttcgacatcgagagcaaggtggaccccagcaaggcctggggcgaggtgaagagacagatctacgtggccgccttcaccgtgcaggccgccgccgagaccctgagcgaggtggcctag

SEQ ID NO: 81887 - DNA, 1638 bp, Artificial Sequence
  Description of Artificial Sequence: Synthetic coding sequence
atgtggaacctgctgcacgagaccgacagcgccgtggccaccgccagaagacccagatggctgtgcgccggcgccctggtgctggccggcggcttcttcctgctgggcttcctgttcggctggttcatcaagagcagcaacgaggccaccaacatcacccccaagcacaacatgaaggccttcctggacgagctgaaggccgagaacatcaagaagttcctgtacaacttcacccagatcccccacctggccggcaccgagcagaacttccagctggccaagcagatccagagccagtggaaggagttcggcctggacagcgtggagctggcccactacgacgtgctgctgagctaccccaacaagacccaccccaactacatcagcatcatcaacgaggacggcaacgagatcttcaacaccagcctgttcgagccccccccccccggctacgagaacgtgagcgacatcgtgccccccttcagcgccttcagcccccagggcatgcccgagggcgacctggtgtacgtgaactacgccagaaccgaggacttcttcaagctggagagagacatgaagatcaactgcagcggcaagatcgtgatcgccagatacggcaaggtgttcagaggcaacaaggtgaagaacgcccagctggccggcgccaagggcgtgatcctgtacagcgaccccgccgactacttcgcccccggcgtgaagagctaccccgacggctggaacctgcccggcggcggcgtgcagagaggcaacatcctgaacctgaacggcgccggcgaccccctgacccccggctaccccgccaacgagtacgcctacagaagaggcatcgccgaggccgtgggcctgcccagcatccccgtgcaccccatcggctactacgacgcccagaagctgctggagaagatgggcggcagcgccccccccgacagcagctggagaggcagcctgaaggtgccctacaacgtgggccccggcttcaccggcaacttcagcacccagaaggtgaagatgcacatccacagcaccaacgaggtgaccagaatctacaacgtgatcggcaccctgagaggcgccgtggagcccgacagatacgtgatcctgggcggccacagagacagctgggtgttcggcggcatcgacccccagagcggcgccgccgtggtgcacgagatcgtgagaagcttcggcaccctgaagaaggaggacatcctgggctggagacccagaagaaccatcctgttcgccagctgggacgccgaggagttcggcctgctgggcagcaccgagtgggccgaggagaacagcagactgctgcaggagagaggcgtggcctacatcaacgccgacagcagcatcgagggcaactacaccctgagagtggactgcacccccctgatgtacagcctggtgcacaacctgaccaaggagctgaagagccccgacgagggcttcgagggcaagagcctgtacgagagctggaccaagaagagccccagccccgagttcagcggcatgcccagaatcagcaagctgggcagcggcaacgacttcgaggtgttcttccagagactgggcatcgccagcggcagagccagatacaccaagaagaagaagtag

SEQ ID NO: 81888 - DNA, 2115 bp, Artificial Sequence
  Description of Artificial Sequence: Synthetic coding sequence
atgaccgccggcagcagctaccccctgttcctggccgcctacgcctgcaccggctgcctggccgagagactgggctggttcatcaagagcagcaacgaggccaccaacatcacccccaagcacaacatgaaggccttcctggacgagctgaaggccgagaacatcaagaagttcctgtacaacttcacccagatcccccacctggccggcaccgagcagaacttccagctggccaagcagatccagagccagtggaaggagttcggcctggacagcgtggagctggcccactacgacgtgctgctgagctaccccaacaagacccaccccaactacatcagcatcatcaacgaggacggcaacgagatcttcaacaccagcctgttcgagccccccccccccggctacgagaacgtgagcgacatcgtgccccccttcagcgccttcagcccccagggcatgcccgagggcgacctggtgtacgtgaactacgccagaaccgaggacttcttcaagctggagagagacatgaagatcaactgcagcggcaagatcgtgatcgccagatacggcaaggtgttcagaggcaacaaggtgaagaacgcccagctggccggcgccaagggcgtgatcctgtacagcgaccccgccgactacttcgcccccggcgtgaagagctaccccgacggctggaacctgcccggcggcggcgtgcagagaggcaacatcctgaacctgaacggcgccggcgaccccctgacccccggctaccccgccaacgagtacgcctacagaagaggcatcgccgaggccgtgggcctgcccagcatccccgtgcaccccatcggctactacgacgcccagaagctgctggagaagatgggcggcagcgccccccccgacagcagctggagaggcagcctgaaggtgccctacaacgtgggccccggcttcaccggcaacttcagcacccagaaggtgaagatgcacatccacagcaccaacgaggtgaccagaatctacaacgtgatcggcaccctgagaggcgccgtggagcccgacagatacgtgatcctgggcggccacagagacagctgggtgttcggcggcatcgacccccagagcggcgccgccgtggtgcacgagatcgtgagaagcttcggcaccctgaagaaggagggctggagacccagaagaaccatcctgttcgccagctgggacgccgaggagttcggcctgctgggcagcaccgagtgggccgaggagaacagcagactgctgcaggagagaggcgtggcctacatcaacgccgacagcagcatcgagggcaactacaccctgagagtggactgcacccccctgatgtacagcctggtgcacaacctgaccaaggagctgaagagccccgacgagggcttcgagggcaagagcctgtacgagagctggaccaagaagagccccagccccgagttcagcggcatgcccagaatcagcaagctgggcagcggcaacgacttcgaggtgttcttccagagactgggcatcgccagcggcagagccagatacaccaagaactgggagaccaacaagttcagcggctaccccctgtaccacagcgtgtacgagacctacgagctggtggagaagttctacgaccccatgttcaagtaccacctgaccgtggcccaggtgagaggcggcatggtgttcgagctggccaacagcatcgtgctgcccttcgactgcagagactacgccgtggtgctgagaaagtacgccgacaagatctacagcatcagcatgaagcacccccaggagatgaagacctacagcgtgagcttcgacagcctgttcagcgccgtgaagaacttcaccgagatcgccagcaagttcagcgagagactgcaggacttcgacaagagcaagcacgtgatctacgcccccagcagccacaacaagtacgccggcgagagcttccccggcatctacgacgccctgttcgacatcgagagcaaggtggaccccagcaaggcctggggcgaggtgaagagacagatctacgtggccgccttcaccgtgcaggccgccgccgagaccctgagcgaggtggcctag

SEQ ID NO: 81889 - DNA, 774 bp, Artificial Sequence
  Description of Artificial Sequence: Synthetic coding sequence
atggcccagagaatgaccacccagctgctgctgctgctggtgtgggtggccgtggtgggcgaggcccagaccagaatcgcctgggccagaaccgagctgctgaacgtgtgcatgaacgccaagcaccacaaggagaagcccggccccgaggacaagctgcacgagcagtgcagaccctggagaaagaacgcctgctgcagcaccaacaccagccaggaggcccacaaggacgtgagctacctgtacagattcaactggaaccactgcggcgagatggcccccgcctgcaagagacacttcatccaggacacctgcctgtacgagtgcagccccaacctgggcccctggatccagcaggtggaccagagctggagaaaggagagagtgctgaacgtgcccctgtgcaaggaggactgcgagcagtggtgggaggactgcagaaccagctacacctgcaagagcaactggcacaagggctggaactggaccagcggcttcaacaagtgcgccgtgggcgccgcctgccagcccttccacttctacttccccacccccaccgtgctgtgcaacgagatctggacccacagctacaaggtgagcaactacagcagaggcagcggcagatgcatccagatgtggttcgaccccgcccagggcaaccccaacgaggaggtggccagattctacgccgccgccatgagcggcgccggcccctgggccgcctggcccttcctgctgagcctggccctgatgctgctgtggctgctgagctag

SEQ ID NO: 81890 - DNA, 774 bp, Artificial Sequence; identical to SEQ ID NO: 81889
  Description of Artificial Sequence: Synthetic coding sequence

SEQ ID NO: 81891 - DNA, 774 bp, Artificial Sequence; identical to SEQ ID NO: 81889
  Description of Artificial Sequence: Synthetic coding sequence

SEQ ID NO: 81892 - DNA, 774 bp, Artificial Sequence; identical to SEQ ID NO: 81889
  Description of Artificial Sequence: Synthetic coding sequence

SEQ ID NO: 81893 - DNA, 768 bp, Artificial Sequence
  Description of Artificial Sequence: Synthetic coding sequence
atggtgtggaagtggatgcccctgctgctgctgctggtgtgcgtggccaccatgtgcagcgcccaggacagaaccgacctgctgaacgtgtgcatggacgccaagcaccacaagaccaagcccggccccgaggacaagctgcacgaccagtgcagcccctggaagaagaacgcctgctgcaccgccagcaccagccaggagctgcacaaggacaccagcagactgtacaacttcaactgggaccactgcggcaagatggagcccgcctgcaagagacacttcatccaggacacctgcctgtacgagtgcagccccaacctgggcccctggatccagcaggtgaaccagagctggagaaaggagagattcctggacgtgcccctgtgcaaggaggactgccagagatggtgggaggactgccacaccagccacacctgcaagagcaactggcacagaggctgggactggaccagcggcgtgaacaagtgccccgccggcgccctgtgcagaaccttcgagagctacttccccacccccgccgccctgtgcgagggcctgtggagccacagctacaaggtgagcaactacagcagaggcagcggcagatgcatccagatgtggttcgacagcgcccagggcaaccccaacgaggaggtggccagattctacgccgccgccatgcacgtgaacgccggcgagatgctgcacggcaccggcggcctgctgctgagcctggccctgatgctgcagctgtggctgctgggctag

SEQ ID NO: 81894 - DNA, 729 bp, Artificial Sequence
  Description of Artificial Sequence: Synthetic coding sequence
atgctgcccgccgccaccgaggtgcagctgagactgcagggccagaaggacatggtgtggaagtggatgcccctgctgctgctgctggtgtgcgtggccaccatgtgcagcgcccaggacagaaccgacctgctgaacgtgtgcatggacgccaagcaccacaagaccaagcccggccccgaggacaagctgcacgaccagtgcagcccctggaagaagaacgcctgctgcaccgccagcaccagccaggagctgcacaaggacaccagcagactgtacaacttcaactgggaccactgcggcaagatggagcccgcctgcgccaccagcagcagaacccccgtgagcatgagcgcccaccccggcgccctggaccccgccggcgagagcgagctggccaagaacgccagctggatgtgcccctacgccaagagaaccgtgagcgccggcggcagaatcgtgaccccccccaccagagccagagccaccggcaccgaggacggcaccggcccccaggagctgaccagcgcccagctgggcctgagcgccgcccccctgagccccaccagccccctgcagctgcccttcgtgaaggccagcggcgtgacccacaccagaagcgccaccaccgccgagggcgccgccgccgccagcagatgcggcctgatccagcccagagccacccccaccagaaagtggagaggcagcatgctgcagccctgcatgtag

SEQ ID NO: 81895 - DNA, 516 bp, Artificial Sequence
  Description of Artificial Sequence: Synthetic coding sequence
atggtgtggaagtggatgcccctgctgctgctgctggtgtgcgtggccaccatgtgcagcgcccaggacagaaccgacctgctgaacgtgtgcatggacgccaagcaccacaagaccaagcccggccccgaggacaagctgcacgaccagtgcagcccctggaagaagaacgcctgctgcaccgccagcaccagccaggagctgcacaaggacaccagcagactgtacaacttcaactgggaccactgcggcaagatggagcccgcctgcaagagacacttcatccaggacacctgcctgtacgagtgcagccccaacctgggcccctggatccagcaggtgaaccagagctggagaaaggagagattcctggacgtgcccctgtgcaaggaggactgccagagatggtgggaggactgccacaccagccacacctgcaagagcaactggcacagaggctgggactggaccagcggcgtgaacaagtgccccgccggcgccctgtgcagaacctag

SEQ ID NO: 81896 - DNA, 2010 bp, Artificial Sequence
  Description of Artificial Sequence: Synthetic coding sequence
atggccctgctgctggtgagcctgctggccttcctgagcctgggcagcggctgccaccacagaatctgccactgcagcaacagagtgttcctgtgccaggagagcaaggtgaccgagatccccagcgacctgcccagaaacgccatcgagctgagattcgtgctgaccaagctgagagtgatccagaagggcgccttcagcggcttcggcgacctggagaagatcgagatcagccagaacgacgtgctggaggtgatcgaggccgacgtgttcagcaacctgcccaagctgcacgagatcagaatcgagaaggccaacaacctgctgtacatcaaccccgaggccttccagaacctgcccaacctgcagtacctgctgatcagcaacaccggcatcaagcacctgcccgacgtgcacaagatccacagcctgcagaaggtgctgctgtggctgaacaagaacggcatccaggagatccacaactgcgccttcaacggcacccagctggacgagctgaacctgagcgacaacaacaacctggaggagctgcccaacgacgtgttccacggcgccagcggccccgtgatcctggacatcagcagaaccagaatccacagcctgcccagctacggcctggagaacctgaagaagctgagagccagaagcacctacaacctgaagaagctgcccaccctggagaagctggtggccctgatggaggccagcctgacctaccccagccactgctgcgccttcgccaactggagaagacagatcagcgagctgcaccccatctgcaacaagagcatcctgagacaggaggtggactacatgacccaggccagaggccagagaagcagcctggccgaggacaacgagagcagctacagcagaggcttcgacatgacctacaccgagttcgactacgacctgtgcaacgaggtggtggacgtgacctgcagccccaagcccgacgccttcaacccctgcgaggacatcatgggctacaacatcctgagagtgctgatctggttcatcagcatcctggccatcaccggcaacatcatcgtgctggtgatcctgaccaccagccagtacaagctgaccgtgcccagattcctgatgtgcaacctggccttcgccgacctgtgcatcggcatctacctgctgctgatcgccagcgtggacatccacaccaagagccagtaccacaactacgccatcgactggcagaccggcgccggctgcgacgccgccggcttcttcaccgtgttcgccagcgagctgagcgtgtacaccctgaccgccatcaccctggagagatggcacaccatcacccacgccatgcagctggactgcaaggtgcagctgagacacgccgccagcgtgatggtgatgggctggatcttcgccttcgccgccgccctgttccccatcttcggcatcagcagctacatgaaggtgagcatctgcctgcccatggacatcgacagccccctgagccagctgtacgtgatgagcctgctggtgctgaacgtgctggccttcgtggtgatctgcggctgctacatccacatctacctgaccgtgagaaaccccaacatcgtgagcagcagcagcgacaccagaatcgccaagagaatggccatgctgatcttcaccgacttcctgtgcatggcccccatcagcttcttcgccatcagcgccagcctgaaggtgcccctgatcaccgtgagcaaggccaagatcctgctggtgctgttccaccccatcaacagctgcgccaaccccttcctgtacgccatcttcaccaagaacttcagaagagacttcttcatcctgctgagcaagtgcggctgctacgagatgcaggcccagatctacagaaccgagaccagcagcaccgtgcacaacacccaccccagaaacggccactgcagcagcgcccccagagtgaccagcggcagcacctacatcctggtgcccctgagccacctggcccagaactag

SEQ ID NO: 81897 - DNA, 1902 bp, Artificial Sequence
  Description of Artificial Sequence: Synthetic coding sequence
atggccctgctgctggtgagcctgctggccttcctgagcctgggcagcggctgccaccacagaatctgccactgcagcaacagagtgttcctgtgccaggagagcaaggtgaccgagatccccagcgacctgcccagaaacgccatcgagctgagattcgtgctgaccaagctgagagtgatccagaagggcgccttcagcggcttcggcgacctggagaagatcgagatcagccagaacgacgtgctggaggtgatcgaggccgacgtgttcagcaacctgcccaagctgcacgagatcagaatcgagaaggccaacaacctgctgtacatcaaccccgaggccttccagaacctgcccaacctgcagtacctgctgatcagcaacaccggcatcaagcacctgcccgacgtgcacaagatccacagcctgcagaaggtgctgctggacatccaggacaacatcaacatccacaccatcgagagaaacagcttcgtgggcctgagcttcgagagcgtgatcctgtggctgaacaagaacggcatccaggagatccacaactgcgccttcaacggcacccagctggacgagctgaacctgagcgacaacaacaacctggaggagctgcccaacgacgtgttccacggcgccagcggccccgtgatcctgagcgagctgcaccccatctgcaacaagagcatcctgagacaggaggtggactacatgacccaggccagaggccagagaagcagcctggccgaggacaacgagagcagctacagcagaggcttcgacatgacctacaccgagttcgactacgacctgtgcaacgaggtggtggacgtgacctgcagccccaagcccgacgccttcaacccctgcgaggacatcatgggctacaacatcctgagagtgctgatctggttcatcagcatcctggccatcaccggcaacatcatcgtgctggtgatcctgaccaccagccagtacaagctgaccgtgcccagattcctgatgtgcaacctggccttcgccgacctgtgcatcggcatctacctgctgctgatcgccagcgtggacatccacaccaagagccagtaccacaactacgccatcgactggcagaccggcgccggctgcgacgccgccggcttcttcaccgtgttcgccagcgagctgagcgtgtacaccctgaccgccatcaccctggagagatggcacaccatcacccacgccatgcagctggactgcaaggtgcagctgagacacgccgccagcgtgatggtgatgggctggatcttcgccttcgccgccgccctgttccccatcttcggcatcagcagctacatgaaggtgagcatctgcctgcccatggacatcgacagccccctgagccagctgtacgtgatgagcctgctggtgctgaacgtgctggccttcgtggtgatctgcggctgctacatccacatctacctgaccgtgagaaaccccaacatcgtgagcagcagcagcgacaccagaatcgccaagagaatggccatgctgatcttcaccgacttcctgtgcatggcccccatcagcttcttcgccatcagcgccagcctgaaggtgcccctgatcaccgtgagcaaggccaagatcctgctggtgctgttccaccccatcaacagctgcgccaaccccttcctgtacgccatcttcaccaagaacttcagaagagacttcttcatcctgctgagcaagtgcggctgctacgagatgcaggcccagatctacagaaccgagaccagcagcaccgtgcacaacacccaccccagaaacggccactgcagcagcgcccccagagtgaccagcggcagcacctacatcctggtgcccctgagccacctggcccagaactag

SEQ ID NO: 81898 - DNA, 2088 bp, Artificial Sequence
  Description of Artificial Sequence: Synthetic coding sequence
atggccctgctgctggtgagcctgctggccttcctgagcctgggcagcggctgccaccacagaatctgccactgcagcaacagagtgttcctgtgccaggagagcaaggtgaccgagatccccagcgacctgcccagaaacgccatcgagctgagattcgtgctgaccaagctgagagtgatccagaagggcgccttcagcggcttcggcgacctggagaagatcgagatcagccagaacgacgtgctggaggtgatcgaggccgacgtgttcagcaacctgcccaagctgcacgagatcagaatcgagaaggccaacaacctgctgtacatcaaccccgaggccttccagaacctgcccaacctgcagtacctgctgatcagcaacaccggcatcaagcacctgcccgacgtgcacaagatccacagcctgcagaaggtgctgctggacatccaggacaacatcaacatccacaccatcgagagaaacagcttcgtgggcctgagcttcgagagcgtgatcctgtggctgaacaagaacggcatccaggagatccacaactgcgccttcaacggcacccagctggacgagctgaacctgagcgacaacaacaacctggaggagctgcccaacgacgtgttccacggcgccagcggccccgtgatcctggacatcagcagaaccagaatccacagcctgcccagctacggcctggagaacctgaagaagctgagagccagaagcacctacaacctgaagaagctgcccaccctggagaagctggtggccctgatggaggccagcctgacctaccccagccactgctgcgccttcgccaactggagaagacagatcagcgagctgcaccccatctgcaacaagagcatcctgagacaggaggtggactacatgacccaggccagaggccagagaagcagcctggccgaggacaacgagagcagctacagcagaggcttcgacatgacctacaccgagttcgactacgacctgtgcaacgaggtggtggacgtgacctgcagccccaagcccgacgccttcaacccctgcgaggacatcatgggctacaacatcctgagagtgctgatctggttcatcagcatcctggccatcaccggcaacatcatcgtgctggtgatcctgaccaccagccagtacaagctgaccgtgcccagattcctgatgtgcaacctggccttcgccgacctgtgcatcggcatctacctgctgctgatcgccagcgtggacatccacaccaagagccagtaccacaactacgccatcgactggcagaccggcgccggctgcgacgccgccggcttcttcaccgtgttcgccagcgagctgagcgtgtacaccctgaccgccatcaccctggagagatggcacaccatcacccacgccatgcagctggactgcaaggtgcagctgagacacgccgccagcgtgatggtgatgggctggatcttcgccttcgccgccgccctgttccccatcttcggcatcagcagctacatgaaggtgagcatctgcctgcccatggacatcgacagccccctgagccagctgtacgtgatgagcctgctggtgctgaacgtgctggccttcgtggtgatctgcggctgctacatccacatctacctgaccgtgagaaaccccaacatcgtgagcagcagcagcgacaccagaatcgccaagagaatggccatgctgatcttcaccgacttcctgtgcatggcccccatcagcttcttcgccatcagcgccagcctgaaggtgcccctgatcaccgtgagcaaggccaagatcctgctggtgctgttccaccccatcaacagctgcgccaaccccttcctgtacgccatcttcaccaagaacttcagaagagacttcttcatcctgctgagcaagtgcggctgctacgagatgcaggcccagatctacagaaccgagaccagcagcaccgtgcacaacacccaccccagaaacggccactgcagcagcgcccccagagtgaccagcggcagcacctacatcctggtgcccctgagccacctggcccagaactag

SEQ ID NO: 81899 - DNA, 1296 bp, Artificial Sequence
  Description of Artificial Sequence: Synthetic coding sequence
atggaggccagcctgacctaccccagccactgctgcgccttcgccaactggagaagacagatcagcgagctgcaccccatctgcaacaagagcatcctgagacaggaggtggactacatgacccaggccagaggccagagaagcagcctggccgaggacaacgagagcagctacagcagaggcttcgacatgacctacaccgagttcgactacgacctgtgcaacgaggtggtggacgtgacctgcagccccaagcccgacgccttcaacccctgcgaggacatcatgggctacaacatcctgagagtgctgatctggttcatcagcatcctggccatcaccggcaacatcatcgtgctggtgatcctgaccaccagccagtacaagctgaccgtgcccagattcctgatgtgcaacctggccttcgccgacctgtgcatcggcatctacctgctgctgatcgccagcgtggacatccacaccaagagccagtaccacaactacgccatcgactggcagaccggcgccggctgcgacgccgccggcttcttcaccgtgttcgccagcgagctgagcgtgtacaccctgaccgccatcaccctggagagatggcacaccatcacccacgccatgcagctggactgcaaggtgcagctgagacacgccgccagcgtgatggtgatgggctggatcttcgccttcgccgccgccctgttccccatcttcggcatcagcagctacatgaaggtgagcatctgcctgcccatggacatcgacagccccctgagccagctgtacgtgatgagcctgctggtgctgaacgtgctggccttcgtggtgatctgcggctgctacatccacatctacctgaccgtgagaaaccccaacatcgtgagcagcagcagcgacaccagaatcgccaagagaatggccatgctgatcttcaccgacttcctgtgcatggcccccatcagcttcttcgccatcagcgccagcctgaaggtgcccctgatcaccgtgagcaaggccaagatcctgctggtgctgttccaccccatcaacagctgcgccaaccccttcctgtacgccatcttcaccaagaacttcagaagagacttcttcatcctgctgagcaagtgcggctgctacgagatgcaggcccagatctacagaaccgagaccagcagcaccgtgcacaacacccaccccagaaacggccactgcagcagcgcccccagagtgaccagcggcagcacctacatcctggtgcccctgagccacctggcccagaactag

SEQ ID NO: 81900 - DNA, 3417 bp, Artificial Sequence
  Description of Artificial Sequence: Synthetic coding sequence
atggcccccaccctgttccagaagctgttcagcaagagaaccggcctgggcgcccccggcagagacgccagagaccccgactgcggcttcagctggcccctgcccgagttcgaccccagccagatcagactgatcgtgtaccaggactgcgagagaagaggcagaaacgtgctgttcgacagcagcgtgaagagaagaaacgaggacatcagcgtgagcaagctgggcagcgacgcccaggtgaaggtgttcggcaagtgctgccagctgaagcccggcggcgacagcagcagcagcctggacagcagcgtgaccagcagcagcgacatcaaggaccagtgcctgaagtaccagggcagcagatgcagcagcgacgccaacatgctgggcgagatgatgttcggcagcgtggccatgagctacaagggcagcaccctgaagatccaccagatcagaagccccccccagctgatgctgagcaaggtgttcaccgccagaaccggcagcagcatctgcggcagcctgaacaccctgcaggacagcctggagttcatcaaccaggacaacaacaccctgaaggccgacaacaacaccgtgatcaacggcctgctgggcaacatcgtgcacagcaaccccatggacatgcccggcagagagctgaacgaggacagagacagcggcatcgccagaagcgccagcctgagcagcctgctgatcacccccttccccagccccaacagcagcctgaccagaagctgcgccagcagctaccagagaagatggagaagaagccagaccaccagcctggagaacggcgtgttccccagatggagcatcgaggagagcttcaacctgagcgacgagagctgcggccccaaccccggcatcgtgagaaagaagaagatcgccatcggcgtgatcttcagcctgagcaaggacgaggacgagaacaacaagttcaacgagttcttcttcagccacttccccctgttcgagagccacatgaacaagctgaagagcgccatcgagcaggccatgaagatgagcagaagaagcgccgacgccagccagagaagcctggcctacaacagaatcgtggacgccctgaacgagttcagaaccaccatctgcaacctgtacaccatgcccagaatcggcgagcccgtgtggctgaccatgatgagcggcacccccgagaagaaccacctgtgctacagattcatgaaggagttcaccttcctgatggagaacgccagcaagaaccagttcctgcccgccctgatcaccgccgtgctgaccaaccacctggcctgggtgcccaccgtgatgcccaacggccagccccccatcaagatcttcctggagaagcacagcagccagagcgtggacatgctggccaagacccacccctacaaccccctgtgggcccagctgggcgacctgtacggcgccatcggcagccccgtgagactggccagaaccgtggtggtgggcaagagacaggacatggtgcagagactgctgtacttcctgacctacttcatcagatgcagcgagctgcaggagacccacctgctggagaacggcgaggacgaggccatcgtgatgcccggcaccgtgatcaccaccaccctggagaagggcgagatcgaggagagcgagtacgtgctggtgaccatgcacagaaacaagagcagcctgctgttcaaggagagcgaggagatcagaacccccaactgcaactgcaagtactgcagccaccccctgctgggccagaacgtggagaacatcagccagcaggagagagaggacatccagaacagcagcaaggagctgctgggcatcagcgacgagtgccagatgatcagccccagcgactgccaggaggagaacgccgtggacgtgaagcagtacagagacaagctgagaacctgcttcgacgccaagctggagaccgtggtgtgcaccggcagcgtgcccgtggacaagtgcgccctgagcgagagcggcctggagagcaccgaggagacctggcagagcgagaagctgctggacagcgacagccacaccggcaaggccatgagaagcaccggcatggtggtggagaagaagccccccgacaagatcgtgcccgccagcttcagctgcgaggccgcccagaccaaggtgaccttcctgatcggcgacagcatgagccccgacagcgacaccgagctgagaagccaggccgtggtggaccagatcaccagacaccacaccaagcccctgaaggaggagagaggcgccatcgaccagcaccaggagaccaagcagaccaccaaggaccagagcggcgagagcgacacccagaacatggtgagcgaggagccctgcgagctgccctgctggaaccacagcgaccccgagagcatgagcctgttcgacgagtacttcaacgacgacagcatcgagaccagaaccatcgacgacgtgcccttcaagaccagcaccgacagcaaggaccactgctgcatgctggagttcagcaagatcctgtgcaccaagaacaacaagcagaacaacgagttctgcaagtgcatcgagaccgtgccccaggacagctgcaagacctgcttcccccagcaggaccagagagacaccctgagcatcctggtgccccacggcgacaaggagagcagcgacaagaagatcgccgtgggcaccgagtgggacatccccagaaacgagagcagcgacagcgccctgggcgacagcgagagcgaggacaccggccacgacatgaccagacaggtgagcagctactacggcggcgagcaggaggactgggccgaggaggacgagatccccttccccggcagcaagctgatcgaggtgagcgccgtgcagcccaacatcgccaacttcggcagaagcctgctgggcggctactgcagcagctacgtgcccgacttcgtgctgcagggcatcggcagcgacgagagattcagacagtgcctgatgagcgacctgagccacgccgtgcagcaccccgtgctggacgagcccatcgccgaggccgtgtgcatcatcgccgacatggacaagtggaccgtgcaggtggccagcagccagagaagagtgaccgacaacaagctgggcaaggaggtgctggtgagcagcctggtgagcaacctgctgcacagcaccctgcagctgtacaagcacaacctgagccccaacttctgcgtgatgcacctggaggacagactgcaggagctgtacttcaagagcaagatgctgagcgagtacctgagaggccagatgagagtgcacgtgaaggagctgggcgtggtgctgggcatcgagagcagcgacctgcccctgctggccgccgtggccagcacccacagcccctacgtggcccagatcctgctgtag

SEQ ID NO: 81901 - DNA, 3501 bp, Artificial Sequence
  Description of Artificial Sequence: Synthetic coding sequence
atggcccccaccctgttccagaagctgttcagcaagagaaccggcctgggcgcccccggcagagacgccagagaccccgactgcggcttcagctggcccctgcccgagttcgaccccagccagatcagactgatcgtgtaccaggactgcgagagaagaggcagaaacgtgctgttcgacagcagcgtgaagagaagaaacgaggacatcagcgtgagcaagctgggcagcgacgcccaggtgaaggtgttcggcaagtgctgccagctgaagcccggcggcgacagcagcagcagcctggacagcagcgtgaccagcagcagcgacatcaaggaccagtgcctgaagtaccagggcagcagatgcagcagcgacgccaacatgctgggcgagatgatgttcggcagcgtggccatgagctacaagggcagcaccctgaagatccaccagatcagaagccccccccagctgatgctgagcaaggtgttcaccgccagaaccggcagcagcatctgcggcagcctgaacaccctgcaggacagcctggagttcatcaaccaggacaacaacaccctgaaggccgacaacaacaccgtgatcaacggcctgctgggcaacatcggcctgagccagttctgcagccccagaagagccttcagcgagcagggccccctgagactgatcagaagcgccagcttcttcgccgtgcacagcaaccccatggacatgcccggcagagagctgaacgaggacagagacagcggcatcgccagaagcgccagcctgagcagcctgctgatcacccccttccccagccccaacagcagcctgaccagaagctgcgccagcagctaccagagaagatggagaagaagccagaccaccagcctggagaacggcgtgttccccagatggagcatcgaggagagcttcaacctgagcgacgagagctgcggccccaaccccggcatcgtgagaaagaagaagatcgccatcggcgtgatcttcagcctgagcaaggacgaggacgagaacaacaagttcaacgagttcttcttcagccacttccccctgttcgagagccacatgaacaagctgaagagcgccatcgagcaggccatgaagatgagcagaagaagcgccgacgccagccagagaagcctggcctacaacagaatcgtggacgccctgaacgagttcagaaccaccatctgcaacctgtacaccatgcccagaatcggcgagcccgtgtggctgaccatgatgagcggcacccccgagaagaaccacctgtgctacagattcatgaaggagttcaccttcctgatggagaacgccagcaagaaccagttcctgcccgccctgatcaccgccgtgctgaccaaccacctggcctgggtgcccaccgtgatgcccaacggccagccccccatcaagatcttcctggagaagcacagcagccagagcgtggacatgctggccaagacccacccctacaaccccctgtgggcccagctgggcgacctgtacggcgccatcggcagccccgtgagactggccagaaccgtggtggtgggcaagagacaggacatggtgcagagactgctgtacttcctgacctacttcatcagatgcagcgagctgcaggagacccacctgctggagaacggcgaggacgaggccatcgtgatgcccggcaccgtgatcaccaccaccctggagaagggcgagatcgaggagagcgagtacgtgctggtgaccatgcacagaaacaagagcagcctgctgttcaaggagagcgaggagatcagaacccccaactgcaactgcaagtactgcagccaccccctgctgggccagaacgtggagaacatcagccagcaggagagagaggacatccagaacagcagcaaggagctgctgggcatcagcgacgagtgccagatgatcagccccagcgactgccaggaggagaacgccgtggacgtgaagcagtacagagacaagctgagaacctgcttcgacgccaagctggagaccgtggtgtgcaccggcagcgtgcccgtggacaagtgcgccctgagcgagagcggcctggagagcaccgaggagacctggcagagcgagaagctgctggacagcgacagccacaccggcaaggccatgagaagcaccggcatggtggtggagaagaagccccccgacaagatcgtgcccgccagcttcagctgcgaggccgcccagaccaaggtgaccttcctgatcggcgacagcatgagccccgacagcgacaccgagctgagaagccaggccgtggtggaccagatcaccagacaccacaccaagcccctgaaggaggagagaggcgccatcgaccagcaccaggagaccaagcagaccaccaaggaccagagcggcgagagcgacacccagaacatggtgagcgaggagccctgcgagctgccctgctggaaccacagcgaccccgagagcatgagcctgttcgacgagtacttcaacgacgacagcatcgagaccagaaccatcgacgacgtgcccttcaagaccagcaccgacagcaaggaccactgctgcatgctggagttcagcaagatcctgtgcaccaagaacaacaagcagaacaacgagttctgcaagtgcatcgagaccgtgccccaggacagctgcaagacctgcttcccccagcaggaccagagagacaccctgagcatcctggtgccccacggcgacaaggagagcagcgacaagaagatcgccgtgggcaccgagtgggacatccccagaaacgagagcagcgacagcgccctgggcgacagcgagagcgaggacaccggccacgacatgaccagacaggtgagcagctactacggcggcgagcaggaggactgggccgaggaggacgagatccccttccccggcagcaagctgatcgaggtgagcgccgtgcagcccaacatcgccaacttcggcagaagcctgctgggcggctactgcagcagctacgtgcccgacttcgtgctgcagggcatcggcagcgacgagagattcagacagtgcctgatgagcgacctgagccacgccgtgcagcaccccgtgctggacgagcccatcgccgaggccgtgtgcatcatcgccgacatggacaagtggaccgtgcaggtggccagcagccagagaagagtgaccgacaacaagctgggcaaggaggtgctggtgagcagcctggtgagcaacctgctgcacagcaccctgcagctgtacaagcacaacctgagccccaacttctgcgtgatgcacctggaggacagactgcaggagctgtacttcaagagcaagatgctgagcgagtacctgagaggccagatgagagtgcacgtgaaggagctgggcgtggtgctgggcatcgagagcagcgacctgcccctgctggccgccgtggccagcacccacagcccctacgtggcccagatcctgctgtag

SEQ ID NO: 81902 - DNA, 1527 bp, Artificial Sequence
  Description of Artificial Sequence: Synthetic coding sequence
atggcccccaccctgttccagaagctgttcagcaagagaaccggcctgggcgcccccggcagagacgccagagaccccgactgcggcttcagctggcccctgcccgagttcgaccccagccagatcagactgatcgtgtaccaggactgcgagagaagaggcagaaacgtgctgttcgacagcagcgtgaagagaagaaacgaggacatcagcgtgagcaagctgggcagcgacgcccaggtgaaggtgttcggcaagtgctgccagctgaagcccggcggcgacagcagcagcagcctggacagcagcgtgaccagcagcagcgacatcaaggaccagtgcctgaagtaccagggcagcagatgcagcagcgacgccaacatgctgggcgagatgatgttcggcagcgtggccatgagctacaagggcagcaccctgaagatccaccagatcagaagccccccccagctgatgctgagcaaggtgttcaccgccagaaccggcagcagcatctgcggcagcctgaacaccctgcaggacagcctggagttcatcaaccaggacaacaacaccctgaaggccgacaacaacaccgtgatcaacggcctgctgggcaacatcggcctgagccagttctgcagccccagaagagccttcagcgagcagggccccctgagactgatcagaagcgccagcttcttcgccgtgcacagcaaccccatggacatgcccggcagagagctgaacgaggacagagacagcggcatcgccagaagcgccagcctgagcagcctgctgatcacccccttccccagccccaacagcagcctgaccagaagctgcgccagcagctaccagagaagatggagaagaagccagaccaccagcctggagaacggcgtgttccccagatggagcatcgaggagagcttcaacctgagcgacgagagctgcggccccaaccccggcatcgtgagaaagaagaagatcgccatcggcgtgatcttcagcctgagcaaggacgaggacgagaacaacaagttcaacgagttcttcttcagccacttccccctgttcgagagccacatgaacaagctgaagagcgccatcgagcaggccatgaagatgagcagaagaagcgccgacgccagccagagaagcctggcctacaacagaatcgtggacgccctgaacgagttcagaaccaccatctgcaacctgtacaccatgcccagaatcggcgagcccgtgtggctgaccatgatgagcggcacccccgagaagaaccacctgtgctacagattcatgaaggagttcaccttcctgatggagaacgccagcaagaaccagttcctgcccgccctgatcaccgccgtgctgaccaaccacctggcctgggtgcccaccgtgatgcccaacggccagccccccatcaagatcttcctggagaagcacagcagccagagcgtggacatgctggccaagacccacccctacaaccccctgtgggcccagctgggcatgtag

SEQ ID NO: 81903 - DNA, 2757 bp, Artificial Sequence
  Description of Artificial Sequence: Synthetic coding sequence
atggacatgcccggcagagagctgaacgaggacagagacagcggcatcgccagaagcgccagcctgagcagcctgctgatcacccccttccccagccccaacagcagcctgaccagaagctgcgccagcagctaccagagaagatggagaagaagccagaccaccagcctggagaacggcgtgttccccagatggagcatcgaggagagcttcaacctgagcgacgagagctgcggccccaaccccggcatcgtgagaaagaagaagatcgccatcggcgtgatcttcagcctgagcaaggacgaggacgagaacaacaagttcaacgagttcttcttcagccacttccccctgttcgagagccacatgaacaagctgaagagcgccatcgagcaggccatgaagatgagcagaagaagcgccgacgccagccagagaagcctggcctacaacagaatcgtggacgccctgaacgagttcagaaccaccatctgcaacctgtacaccatgcccagaatcggcgagcccgtgtggctgaccatgatgagcggcacccccgagaagaaccacctgtgctacagattcatgaaggagttcaccttcctgatggagaacgccagcaagaaccagttcctgcccgccctgatcaccgccgtgctgaccaaccacctggcctgggtgcccaccgtgatgcccaacggccagccccccatcaagatcttcctggagaagcacagcagccagagcgtggacatgctggccaagacccacccctacaaccccctgtgggcccagctgggcgacctgtacggcgccatcggcagccccgtgagactggccagaaccgtggtggtgggcaagagacaggacatggtgcagagactgctgtacttcctgacctacttcatcagatgcagcgagctgcaggagacccacctgctggagaacggcgaggacgaggccatcgtgatgcccggcaccgtgatcaccaccaccctggagaagggcgagatcgaggagagcgagtacgtgctggtgctgctgttcaaggagagcgaggagatcagaacccccaactgcaactgcaagtactgcagccaccccctgctgggccagaacgtggagaacatcagccagcaggagagagaggacatccagaacagcagcaaggagctgctgggcatcagcgacgagtgccagatgatcagccccagcgactgccaggaggagaacgccgtggacgtgaagcagtacagagacaagctgagaacctgcttcgacgccaagctggagaccgtggtgtgcaccggcagcgtgcccgtggacaagtgcgccctgagcgagagcggcctggagagcaccgaggagacctggcagagcgagaagctgctggacagcgacagccacaccggcaaggccatgagaagcaccggcatggtggtggagaagaagccccccgacaagatcgtgcccgccagcttcagctgcgaggccgcccagaccaaggtgaccttcctgatcggcgacagcatgagccccgacagcgacaccgagctgagaagccaggccgtggtggaccagatcaccagacaccacaccaagcccctgaaggaggagagaggcgccatcgaccagcaccaggagaccaagcagaccaccaaggaccagagcggcgagagcgacacccagaacatggtgagcgaggagccctgcgagctgccctgctggaaccacagcgaccccgagagcatgagcctgttcgacgagtacttcaacgacgacagcatcgagaccagaaccatcgacgacgtgcccttcaagaccagcaccgacagcaaggaccactgctgcatgctggagttcagcaagatcctgtgcaccaagaacaacaagcagaacaacgagttctgcaagtgcatcgagaccgtgccccaggacagctgcaagacctgcttcccccagcaggaccagagagacaccctgagcatcctggtgccccacggcgacaaggagagcagcgacaagaagatcgccgtgggcaccgagtgggacatccccagaaacgagagcagcgacagcgccctgggcgacagcgagagcgaggacaccggccacgacatgaccagacaggtgagcagctactacggcggcgagcaggaggactgggccgaggaggacgagatccccttccccggcagcaagctgatcgaggtgagcgccgtgcagcccaacatcgccaacttcggcagaagcctgctgggcggctactgcagcagctacgtgcccgacttcgtgctgcagggcatcggcagcgacgagagattcagacagtgcctgatgagcgacctgagccacgccgtgcagcaccccgtgctggacgagcccatcgccgaggccgtgtgcatcatcgccgacatggacaagtggaccgtgcaggtggccagcagccagagaagagtgaccgacaacaagctgggcaaggaggtgctggtgagcagcctggtgagcaacctgctgcacagcaccctgcagctgtacaagcacaacctgagccccaacttctgcgtgatgcacctggaggacagactgcaggagctgtacttcaagagcaagatgctgagcgagtacctgagaggccagatgagagtgcacgtgaaggagctgggcgtggtgctgggcatcgagagcagcgacctgcccctgctggccgccgtggccagcacccacagcccctacgtggcccagatcctgctgtag

SEQ ID NO: 81904 - DNA, 3345 bp, Artificial Sequence
  Description of Artificial Sequence: Synthetic coding sequence
atggcccccaccctgctgcagaagctgttcaacaagagaggcagcagcggcagcagcgccgccgccagcgcccagggcagagcccccaaggagggccccgccttcagctggagctgcagcgagttcgacctgaacgagatcagactgatcgtgtaccaggactgcgacagaagaggcagacaggtgctgttcgacagcaaggccgtgcagaagatcgaggaggtgaccgcccagaagaccgaggacgtgcccatcaagatcagcgccaagtgctgccagggcagcagcagcgtgagcagcagcagcagcagcagcatcagcagccacagcagcagcggcggcagcagccaccacgccaaggagcagctgcccaagtaccagtacaccagacccgccagcgacgtgaacatgctgggcgagatgatgttcggcagcgtggccatgagctacaagggcagcaccctgaagatccactacatcagaagccccccccagctgatgatcagcaaggtgttcagcgccagaatgggcagcttctgcggcagcaccaacaacctgcaggacagcttcgagtacatcaaccaggaccccaacctgggcaagctgaacaccaaccagaacagcctgggcccctgcagaaccggcagcaacctggcccacagcacccccgtggacatgcccagcagaggccagaacgaggacagagacagcggcatcgccagaagcgccagcctgagcagcctgctgatcacccccttccccagccccagcagcagcaccagcagcagcagcagctaccagagaagatggctgagaagccagaccaccagcctggagaacggcatcatccccagaagaagcaccgacgagaccttcagcctggccgaggagacctgcagcagcaaccccgccatggtgagaagaaagaagatcgccatcagcatcatcttcagcctgtgcgagaaggaggaggcccagagaaacttccaggacttcttcttcagccacttccccctgttcgagagccacatgaacagactgaagagcgccatcgagaaggccatgatcagctgcagaaagatcgccgagagcagcctgagagtgcagttctacgtgagcagactgatggaggccctgggcgagttcagaggcaccatctggaacctgtacagcgtgcccagaatcgccgagcccgtgtggctgaccatgatgagcggcaccctggagaagaaccagctgtgccagagattcctgaaggagttcaccctgctgatcgagcagatcaacaagaaccagttcttcgccgccctgctgaccgccgtgctgacctaccacctggcctgggtgcccaccgtgatgcccgtggaccacccccccatcaaggccttcagcgagaagagaaccagccagagcgtgaacatgctggccaagacccacccctacaaccccctgtgggcccagctgggcgacctgtacggcgccatcggcagccccgtgagactgaccagaaccgtggtggtgggcaagcagaaggacctggtgcagagaatcctgtacgtgctgacctacttcctgagatgcagcgagctgcaggagaaccagctgacctggagcggcaaccacggcgagggcgaccaggtgctgaacggcagcaagatcatcaccgccctggagaagggcgaggtggaggagagcgagtacgtggtgatcaccgtgagaaacgagcccgccctggtgccccccatcctgccccccaccgccgccgagagacacaacccctggcccaccggcttccccgagtgccccgagggcaccgacagcagagacctgggcctgaagcccgacaaggaggccaacagaagacccgagcagggcagcgaggcctgcagcgccggctgcctgggccccgccagcgacgccagctggaagccccagaacgccttctgcggcgacgagaagaacaaggaggccccccaggacggcagcagcagactgcccagctgcgaggtgctgggcgccggcatgaagatggaccagcaggccgtgtgcgagctgctgaaggtggagatgcccaccagactgcccgacagaagcgtggcctggccctgccccgacagacacctgagagagaagcccagcctggagaaggtgaccttccagatcggcagcttcgccagccccgagagcgacttcgagagcagaatgaagaagatggaggagagagtgaaggcctgcggccccagcctggaggccagcgaggccgccgacgtggcccaggacccccaggtgagcagaagccccttcaagcccggcttccaggagaacgtgtgctgcccccagaacagactgagcgagggcgacgagggcgagagcgacaagggcttcgccgaggacagaggcagcagaaacgacatggccgccgacatcgccggccagctgagccacgccgccgacctgggcaccgccagccacggcgccggcggcaccggcggcagaagactggaggccaccagaggcctgtacgtgaaggccgccgagggccccgtgctggagcccgtggcccccagatgcgtgcagagaggccccggcctggtggccggcgccaacatcccctgcggcgacgacaacaagaaggccaacttcagaaccgagggcgacatccccagaaacgagagcagcgacagcgccctgggcgacagcgacgacgaggcctgcgccagcgccatgctggacctgggccacggcggcgacagaaccggcggcagcctggaggtggagctgcccctgcccagaagccagagcatcagcacccagaacgtgagaaacttcggcagaagcctgctggccggctactgccccacctacatgcccgacctggtgctgcacggcaccggcagcgacgagaagctgaagcagtgcctggtggccgacctggtgcacaccgtgcaccaccccgtgctggacgagcccatcgccgaggccgtgtgcatcatcgccgacaccgacaagtggagcgtgcaggtggccaccagccagagaaaggtgaccgacaacatgaagctgggccaggacgtgctggtgagcagccaggtgagcagcctgctgcagagcatcctgcagctgtacaagctgcacctgcccgccgacttctgcatcatgcacctggaggacagactgcaggagatgtacctgaagagcaagatgctgagcgagtacctgagaggccacaccagagtgcacgtgaaggagctgggcgtggtgctgggcatcgagagcaacgacctgcccctgctgaccgccatcgccagcacccacagcccctacgtggcccagatcctgctgtag

SEQ ID NO: 81905 - DNA, 3414 bp, Artificial Sequence
  Description of Artificial Sequence: Synthetic coding sequence
atgtgcggcggcaccgccaacaccaccaaccagcccgagagctggcaggacagcgccagatgcgtgagcgacgccgtgcccggcgccggcagaatctacagagccctgctgtgcaccaagatcaagaagcacaccggcgtggacagaagcaccgaccacaccgagctggacaacagctggagctgcagcgagttcgacctgaacgagatcagactgatcgtgtaccaggactgcgacagaagaggcagacaggtgctgttcgacagcaaggccgtgcagaagatcgaggaggtgaccgcccagaagaccgaggacgtgcccatcaagatcagcgccaagtgctgccagggcagcagcagcgtgagcagcagcagcagcagcagcatcagcagccacagcagcagcggcggcagcagccaccacgccaaggagcagctgcccaagtaccagtacaccagacccgccagcgacgtgaacatgctgggcgagatgatgttcggcagcgtggccatgagctacaagggcagcaccctgaagatccactacatcagaagccccccccagctgatgatcagcaaggtgttcagcgccagaatgggcagcttctgcggcagcaccaacaacctgcaggacagcttcgagtacatcaaccaggaccccaacctgggcaagctgaacaccaaccagaacagcctgggcccctgcagaaccggcagcaacctggcccacagcacccccgtggacatgcccagcagaggccagaacgaggacagagacagcggcatcgccagaagcgccagcctgagcagcctgctgatcacccccttccccagccccagcagcagcaccagcagcagcagcagctaccagagaagatggctgagaagccagaccaccagcctggagaacggcatcatccccagaagaagcaccgacgagaccttcagcctggccgaggagacctgcagcagcaaccccgccatggtgagaagaaagaagatcgccatcagcatcatcttcagcctgtgcgagaaggaggaggcccagagaaacttccaggacttcttcttcagccacttccccctgttcgagagccacatgaacagactgaagagcgccatcgagaaggccatgatcagctgcagaaagatcgccgagagcagcctgagagtgcagttctacgtgagcagactgatggaggccctgggcgagttcagaggcaccatctggaacctgtacagcgtgcccagaatcgccgagcccgtgtggctgaccatgatgagcggcaccctggagaagaaccagctgtgccagagattcctgaaggagttcaccctgctgatcgagcagatcaacaagaaccagttcttcgccgccctgctgaccgccgtgctgacctaccacctggcctgggtgcccaccgtgatgcccgtggaccacccccccatcaaggccttcagcgagaagagaaccagccagagcgtgaacatgctggccaagacccacccctacaaccccctgtgggcccagctgggcgacctgtacggcgccatcggcagccccgtgagactgaccagaaccgtggtggtgggcaagcagaaggacctggtgcagagaatcctgtacgtgctgacctacttcctgagatgcagcgagctgcaggagaaccagctgacctggagcggcaaccacggcgagggcgaccaggtgctgaacggcagcaagatcatcaccgccctggagaagggcgaggtggaggagagcgagtacgtggtgatcaccgtgagaaacgagcccgccctggtgccccccatcctgccccccaccgccgccgagagacacaacccctggcccaccggcttccccgagtgccccgagggcaccgacagcagagacctgggcctgaagcccgacaaggaggccaacagaagacccgagcagggcagcgaggcctgcagcgccggctgcctgggccccgccagcgacgccagctggaagccccagaacgccttctgcggcgacgagaagaacaaggaggccccccaggacggcagcagcagactgcccagctgcgaggtgctgggcgccggcatgaagatggaccagcaggccgtgtgcgagctgctgaaggtggagatgcccaccagactgcccgacagaagcgtggcctggccctgccccgacagacacctgagagagaagcccagcctggagaaggtgaccttccagatcggcagcttcgccagccccgagagcgacttcgagagcagaatgaagaagatggaggagagagtgaaggcctgcggccccagcctggaggccagcgaggccgccgacgtggcccaggacccccaggtgagcagaagccccttcaagcccggcttccaggagaacgtgtgctgcccccagaacagactgagcgagggcgacgagggcgagagcgacaagggcttcgccgaggacagaggcagcagaaacgacatggccgccgacatcgccggccagctgagccacgccgccgacctgggcaccgccagccacggcgccggcggcaccggcggcagaagactggaggccaccagaggcctgtacgtgaaggccgccgagggccccgtgctggagcccgtggcccccagatgcgtgcagagaggccccggcctggtggccggcgccaacatcccctgcggcgacgacaacaagaaggccaacttcagaaccgagggcgacatccccagaaacgagagcagcgacagcgccctgggcgacagcgacgacgaggcctgcgccagcgccatgctggacctgggccacggcggcgacagaaccggcggcagcctggaggtggagctgcccctgcccagaagccagagcatcagcacccagaacgtgagaaacttcggcagaagcctgctggccggctactgccccacctacatgcccgacctggtgctgcacggcaccggcagcgacgagaagctgaagcagtgcctggtggccgacctggtgcacaccgtgcaccaccccgtgctggacgagcccatcgccgaggccgtgtgcatcatcgccgacaccgacaagtggagcgtgcaggtggccaccagccagagaaaggtgaccgacaacatgaagctgggccaggacgtgctggtgagcagccaggtgagcagcctgctgcagagcatcctgcagctgtacaagctgcacctgcccgccgacttctgcatcatgcacctggaggacagactgcaggagatgtacctgaagagcaagatgctgagcgagtacctgagaggccacaccagagtgcacgtgaaggagctgggcgtggtgctgggcatcgagagcaacgacctgcccctgctgaccgccatcgccagcacccacagcccctacgtggcccagatcctgctgtag

SEQ ID NO: 81906 - DNA, 2022 bp, Artificial Sequence
  Description of Artificial Sequence: Synthetic coding sequence
atgtgcggcggcaccgccaacaccaccaaccagcccgagagctggcaggacagcgccagatgcgtgagcgacgccgtgcccggcgccggcagaatctacagagccctgctgtgcaccaagatcaagaagcacaccggcgtggacagaagcaccgaccacaccgagctggacaacagctggagctgcagcgagttcgacctgaacgagatcagactgatcgtgtaccaggactgcgacagaagaggcagacaggtgctgttcgacagcaaggccgtgcagaagatcgaggaggtgaccgcccagaagaccgaggacgtgcccatcaagatcagcgccaagtgctgccagggcagcagcagcgtgagcagcagcagcagcagcagcatcagcagccacagcagcagcggcggcagcagccaccacgccaaggagcagctgcccaagtaccagtacaccagacccgccagcgacgtgaacatgctgggcgagatgatgttcggcagcgtggccatgagctacaagggcagcaccctgaagatccactacatcagaagccccccccagctgatgatcagcaaggtgttcagcgccagaatgggcagcttctgcggcagcaccaacaacctgcaggacagcttcgagtacatcaaccaggaccccaacctgggcaagctgaacaccaaccagaacagcctgggcccctgcagaaccggcagcaacctggcccacagcacccccgtggacatgcccagcagaggccagaacgaggacagagacagcggcatcgccagaagcgccagcctgagcagcctgctgatcacccccttccccagccccagcagcagcaccagcagcagcagcagctaccagagaagatggctgagaagccagaccaccagcctggagaacggcatcatccccagaagaagcaccgacgagaccttcagcctggccgaggagacctgcagcagcaaccccgccatggtgagaagaaagaagatcgccatcagcatcatcttcagcctgtgcgagaaggaggaggcccagagaaacttccaggacttcttcttcagccacttccccctgttcgagagccacatgaacagactgaagagcgccatcgagaaggccatgatcagctgcagaaagatcgccgagagcagcctgagagtgcagttctacgtgagcagactgatggaggccctgggcgagttcagaggcaccatctggaacctgtacagcgtgcccagaatcgccgagcccgtgtggctgaccatgatgagcggcaccctggagaagaaccagctgtgccagagattcctgaaggagttcaccctgctgatcgagcagatcaacaagaaccagttcttcgccgccctgctgaccgccgtgctgacctaccacctggcctgggtgcccaccgtgatgcccgtggaccacccccccatcaaggccttcagcgagaagagaaccagccagagcgtgaacatgctggccaagacccacccctacaaccccctgtgggcccagctgggcgacctgtacggcgccatcggcagccccgtgagactgaccagaaccgtggtggtgggcaagcagaaggacctggtgcagagaatcctgtacgtgctgacctacttcctgagatgcagcgagctgcaggagaaccagctgacctggagcggcaaccacggcgagggcgaccaggtgctgaacggcagcaagatcatcaccgccctggagaagggcgaggtggaggagagcgagtacgtggtgatcaccgtgagaaacgagcccgccctggtgccccccatcctgccccccaccgccgccgagagacacaacccctggcccaccggcttccccgagtgccccgagggcaccgacagcagagacctgggcctgaagcccgacaaggaggccaacagaagacccgagcagggcagcgaggcctgcagcgccggctgcctgggccccgccagcgacgccagctggaagccccagaacgccttctgcggctag

SEQ ID NO: 81907 - DNA, 660 bp, Artificial Sequence
  Description of Artificial Sequence: Synthetic coding sequence
atggaccccgcccccggcgtgctggaccccagagccgccccccccgccctgctgggcaccccccaggccgaggtgctggaggacgtgctgagagagcagttcggccccctgccccagctggccgccgtgtgcagactgaagagactgcccagcggcggctacagcagcaccgagaacctgcagctggtgctggagagaagaagagtggccaacgccaaggagagagagagaatcaagaacctgaacagaggcttcgccagactgaaggccctggtgcccttcctgccccagagcagaaagcccagcaaggtggacatcctgaagggcgccaccgagtacatccaggtgctgagcgacctgctggagggcgccaaggacagcaagaagcaggaccccgacgagcagagctacagcaacaacagcagcgagagccacaccagcagcgccagacagctgagcagaaacatcacccagcacatcagctgcgccttcggcctgaagaacgaggaggagggcccctgggccgacggcggcagcggcgagcccgcccacgcctgcagacacagcgtgatgagcaccaccgagatcatcagccccaccagaagcctggacagattccccgaggtggagctgctgagccacagactgccccaggtgtag

SEQ ID NO: 81908 - DNA, 1035 bp, Artificial Sequence
  Description of Artificial Sequence: Synthetic coding sequence
atggtgagagccagacaccagcccggcggcctgtgcctgctgctgctgctgctgtgccagttcatggaggacagaagcgcccaggccggcaactgctggctgagacaggccaagaacggcagatgccaggtgctgtacaagaccgagctgagcaaggaggagtgctgcagcaccggcagactgagcaccagctggaccgaggaggacgtgaacgacaacaccctgttcaagtggatgatcttcaacggcggcgcccccaactgcatcccctgcaaggagacctgcgagaacgtggactgcggccccggcaagaagtgcagaatgaacaagaagaacaagcccagatgcgtgtgcgcccccgactgcagcaacatcacctggaagggccccgtgtgcggcctggacggcaagacctacagaaacgagtgcgccctgctgaaggccagatgcaaggagcagcccgagctggaggtgcagtaccagggcagatgcaagaagacctgcagagacgtgttctgccccggcagcagcacctgcgtggtggaccagaccaacaacgcctactgcgtgacctgcaacagaatctgccccgagcccgccagcagcgagcagtacctgtgcggcaacgacggcgtgacctacagcagcgcctgccacctgagaaaggccacctgcctgctgggcagaagcatcggcctggcctacgagggcaagtgcatcaaggccaagagctgcgaggacatccagtgcaccggcggcaagaagtgcctgtgggacttcaaggtgggcagaggcagatgcagcctgtgcgacgagctgtgccccgacagcaagagcgacgagcccgtgtgcgccagcgacaacgccacctacgccagcgagtgcgccatgaaggaggccgcctgcagcagcggcgtgctgctggaggtgaagcacagcggcagctgcaacagcatcagcgaggacaccgaggaggaggaggaggacgaggaccaggactacagcttccccatcagcagcatcctggagtggtag

SEQ ID NO: 81909 - DNA, 954 bp, Artificial Sequence
  Description of Artificial Sequence: Synthetic coding sequence
atggtgagagccagacaccagcccggcggcctgtgcctgctgctgctgctgctgtgccagttcatggaggacagaagcgcccaggccggcaactgctggctgagacaggccaagaacggcagatgccaggtgctgtacaagaccgagctgagcaaggaggagtgctgcagcaccggcagactgagcaccagctggaccgaggaggacgtgaacgacaacaccctgttcaagtggatgatcttcaacggcggcgcccccaactgcatcccctgcaaggagacctgcgagaacgtggactgcggccccggcaagaagtgcagaatgaacaagaagaacaagcccagatgcgtgtgcgcccccgactgcagcaacatcacctggaagggccccgtgtgcggcctggacggcaagacctacagaaacgagtgcgccctgctgaaggccagatgcaaggagcagcccgagctggaggtgcagtaccagggcagatgcaagaagacctgcagagacgtgttctgccccggcagcagcacctgcgtggtggaccagaccaacaacgcctactgcgtgacctgcaacagaatctgccccgagcccgccagcagcgagcagtacctgtgcggcaacgacggcgtgacctacagcagcgcctgccacctgagaaaggccacctgcctgctgggcagaagcatcggcctggcctacgagggcaagtgcatcaaggccaagagctgcgaggacatccagtgcaccggcggcaagaagtgcctgtgggacttcaaggtgggcagaggcagatgcagcctgtgcgacgagctgtgccccgacagcaagagcgacgagcccgtgtgcgccagcgacaacgccacctacgccagcgagtgcgccatgaaggaggccgcctgcagcagcggcgtgctgctggaggtgaagcacagcggcagctgcaactag

SEQ ID NO: 81910 - DNA, 1023 bp, Artificial Sequence
  Description of Artificial Sequence: Synthetic coding sequence
atggtgagagccagacaccagcccggcggcctgtgcctgctgctgctgctgctgtgccagttcatggaggacagaagcgcccaggccggcaactgctggctgagacaggccaagaacggcagatgccaggtgctgtacaagaccgagctgagcaaggaggagtgctgcagcaccggcagactgagcaccagctggaccgaggaggacgtgaacgacaacaccctgttcaagtggatgatcttcaacggcggcgcccccaactgcatcccctgcaaggagacctgcgagaacgtggactgcggccccggcaagaagtgcagaatgaacaagaagaacaagcccagatgcgtgtgcgcccccgactgcagcaacatcacctggaagggccccgtgtgcggcctggacggcaagacctacagaaacgagtgcgccctgctgaaggccagatgcaaggagcagcccgagctggaggtgcagtaccagggcagatgcaagaagacctgcagagacgtgttctgccccggcagcagcacctgcgtggtggaccagaccaacaacgcctactgcgtgacctgcaacagaatctgccccgagcccgccagcagcgagcagtacctgtgcggcaacgacggcgtgacctacagcagcgcctgccacctgagaaaggccacctgcctgctgggcagaagcatcggcctggcctacgagggcaagtgcatcaaggccaagagctgcgaggacatccagtgcaccggcggcaagaagtgcctgtgggacttcaaggtgggcagaggcagatgcagcctgtgcgacgagctgtgccccgacagcaagagcgacgagcccgtgtgcgccagcgacaacgccacctacgccagcgagtgcgccatgaaggaggccgcctgcagcagcggcgtgctgctggaggtgaagcacagcggcagctgcaactacaccgaggaggaggaggaggacgaggaccaggactacagcttccccatcagcagcatcctggagtggtag

SEQ ID NO: 81911 - DNA, 927 bp, Artificial Sequence
  Description of Artificial Sequence: Synthetic coding sequence
atgtggaagagatggctggccctggccctggccctggtggccgtggcctgggtgagagccgaggaggagctgagaagcaagagcaagatctgcgccaacgtgttctgcggcgccggcagagagtgcgccgtgaccgagaagggcgagcccacctgcctgtgcatcgagcagtgcaagccccacaagagacccgtgtgcggcagcaacggcaagacctacctgaaccactgcgagctgcacagagacgcctgcctgaccggcagcaagatccaggtggactacgacggccactgcaaggagaagaagagcgtgagccccagcgccagccccgtggtgtgctaccagagcaacagagacgagctgagaagaagaatcatccagtggctggaggccgagatcatccccgacggctggttcagcaagggcagcaactacagcgagatcctggacaagtacttcaagaacttcgacaacggcgacagcagactggacagcagcgagttcctgaagttcgtggagcagaacgagaccgccatcaacatcaccacctaccccgaccaggagaacaacaagctgctgagaggcctgtgcgtggacgccctgatcgagctgagcgacgagaacgccgactggaagctgagcttccaggagttcctgaagtgcctgaaccccagcttcaacccccccgagaagaagtgcgccctggaggacgagacctacgccgacggcgccgagaccgaggtggactgcaacagatgcgtgtgcgcctgcggcaactgggtgtgcaccgccatgacctgcgacggcaagaaccagaagggcgcccagacccagaccgaggaggagatgaccagatacgtgcaggagctgcagaagcaccaggagaccgccgagaagaccaagagagtgagcaccaaggagatctag

SEQ ID NO: 81912 - DNA, 423 bp, Artificial Sequence
  Description of Artificial Sequence: Synthetic coding sequence
atgtggaagagatggctggccctggccctggccctggtggccgtggcctgggtgagagccgaggaggagctgagaagcaagagcaagatctgcgccaacgtgttctgcggcgccggcagagagtgcgccgtgaccgagaagggcgagcccacctgcctgtgcatcgagcagtgcaagccccacaagagacccgtgtgcggcagcaacggcaagacctacctgaaccactgcgagctgcacagagacgcctgcctgaccggcagcaagatccaggtggactacgacggccactgcaaggagaagaagagcgtgagccccagcgccagccccgtggtgtgctaccagagcaacagagacgagctgagaagaagaatcatccagtggctggaggccgagatcatccccgacggctggttcagctag

SEQ ID NO: 81913 - DNA, 756 bp, Artificial Sequence
  Description of Artificial Sequence: Synthetic coding sequence
atgtgcttcgtggagcccgccggcaacgtgcagagccagagaaagggcaacccccccgtgagcgccctgagcaacgccaacctgaccggcagcaagatccaggtggactacgacggccactgcaaggagaagaagagcgtgagccccagcgccagccccgtggtgtgctaccagagcaacagagacgagctgagaagaagaatcatccagtggctggaggccgagatcatccccgacggctggttcagcaagggcagcaactacagcgagatcctggacaagtacttcaagaacttcgacaacggcgacagcagactggacagcagcgagttcctgaagttcgtggagcagaacgagaccgccatcaacatcaccacctaccccgaccaggagaacaacaagctgctgagaggcctgtgcgtggacgccctgatcgagctgagcgacgagaacgccgactggaagctgagcttccaggagttcctgaagtgcctgaaccccagcttcaacccccccgagaagaagtgcgccctggaggacgagacctacgccgacggcgccgagaccgaggtggactgcaacagatgcgtgtgcgcctgcggcaactgggtgtgcaccgccatgacctgcgacggcaagaaccagaagggcgcccagacccagaccgaggaggagatgaccagatacgtgcaggagctgcagaagcaccaggagaccgccgagaagaccaagagagtgagcaccaaggagatctag

SEQ ID NO: 81914 - DNA, 792 bp, Artificial Sequence
  Description of Artificial Sequence: Synthetic coding sequence
atgagacccggcgcccccggccccctgtggcccctgccctggggcgccctggcctgggccgtgggcttcgtgagcagcatgggcagcggcaaccccgcccccggcggcgtgtgctggctgcagcagggccaggaggccacctgcagcctggtgctgcagaccgacgtgaccagagccgagtgctgcgccagcggcaacatcgacaccgcctggagcaacctgacccaccccggcaacaagatcaacctgctgggcttcctgggcctggtgcactgcctgccctgcaaggacagctgcgacggcgtggagtgcggccccggcaaggcctgcagaatgctgggcggcagacccagatgcgagtgcgcccccgactgcagcggcctgcccgccagactgcaggtgtgcggcagcgacggcgccacctacagagacgagtgcgagctgagagccgccagatgcagaggccaccccgacctgagcgtgatgtacagaggcagatgcagaaagagctgcgagcacgtggtgtgccccagaccccagagctgcgtggtggaccagaccggcagcgcccactgcgtggtgtgcagagccgccccctgccccgtgcccagcagccccggccaggagctgtgcggcaacaacaacgtgacctacatcagcagctgccacatgagacaggccacctgcttcctgggcagaagcatcggcgtgagacacgccggcagctgcgccggcacccccgaggagccccccggcggcgagagcgccgaggaggaggagaacttcgtgtag

SEQ ID NO: 81915 - DNA, 1614 bp, Artificial Sequence
  Description of Artificial Sequence: Synthetic coding sequence
atgctgaacaccctgcagaccaacgccggctacctggagcaggtgaagagacagagaggcgacccccagacccagctggaggccatggagctgtacctggccagaagcggcctgcaggtggaggacctggacagactgaacatcatccacgtgaccggcaccaagggcaagggcagcacctgcgccttcaccgagtgcatcctgagaagctacggcctgaagaccggcttcttcagcagcccccacctggtgcaggtgagagagagaatcagaatcaacggccagcccatcagccccgagctgttcaccaagtacttctggagactgtaccacagactggaggagaccaaggacggcagctgcgtgagcatgcccccctacttcagattcctgaccctgatggccttccacgtgttcctgcaggagaaggtggacctggccgtggtggaggtgggcatcggcggcgcctacgactgcaccaacatcatcagaaagcccgtggtgtgcggcgtgagcagcctgggcatcgaccacaccagcctgctgggcgacaccgtggagaagatcgcctggcagaagggcggcatcttcaagcagggcgtgcccgccttcaccgtgctgcagcccgagggccccctggccgtgctgagagacagagcccagcagatcagctgccccctgtacctgtgccccatgctggaggccctggaggagggcggcccccccctgaccctgggcctggagggcgagcaccagagaagcaacgccgccctggccctgcagctggcccactgctggctgcagagacaggacagacacggcgccggcgagcccaaggccagcagacccggcctgctgtggcagctgcccctggcccccgtgttccagcccaccagccacatgagactgggcctgagaaacaccgagtggcccggcagaacccaggtgctgagaagaggccccctgacctggtacctggacggcgcccacaccgccagcagcgcccaggcctgcgtgagatggttcagacaggccctgcagggcagagagagacccagcggcggccccgaggtgagagtgctgctgttcaacgccaccggcgacagagaccccgccgccctgctgaagctgctgcagccctgccagttcgactacgccgtgttctgccccaacctgaccgaggtgagcagcaccggcaacgccgaccagcagaacttcaccgtgaccctggaccaggtgctgctgagatgcctggagcaccagcagcactggaaccacctggacgaggagcaggccagccccgacctgtggagcgcccccagccccgagcccggcggcagcgccagcctgctgctggccccccaccccccccacacctgcagcgccagcagcctggtgttcagctgcatcagccacgccctgcagtggatcagccagggcagagaccccatcttccagccccccagcccccccaagggcctgctgacccaccccgtggcccacagcggcgccagcatcctgagagaggccgccgccatccacgtgctggtgaccggcagcctgcacctggtgggcggcgtgctgaagctgctggagcccgccctgagccagtag

SEQ ID NO: 81916 - DNA, 1128 bp, Artificial Sequence
  Description of Artificial Sequence: Synthetic coding sequence
atgagcagagccagaagccacctgagagccgccctgttcctggccgccgccagcgccagaggcatcaccacccaggtggccgccagaagaggcctgagcgcctggcccgtgccccaggagcccagcatggagtaccaggacgccgtgagaatgctgaacaccctgcagaccaacgccggctacctggagcaggtgaagagacagagaggcgacccccagacccagctggaggccatggagctgtacctggccagaagcggcctgcaggtggaggacctggacagactgaacatcatccacgtgaccggcaccaagggcaagggcagcacctgcgccttcaccgagtgcatcctgagaagctacggcctgaagaccggcttcttcagcagcccccacctggtgcaggtgagagagagaatcagaatcaacggccagcccatcagccccgagctgttcaccaagtacttctggagactgtaccacagactggaggagaccaaggacggcagctgcgtgagcatgcccccctacttcagattcctgaccctgatggccttccacgtgttcctgcaggagaaggtggacctggccgtggtggaggtgggcatcggcggcgcctacgactgcaccaacatcatcagaaagcccgtggtgtgcggcgtgagcagcctgggcatcgaccacaccagcctgctgggcgacaccgtggagaagatcgcctggcagaagggcggcatcttcaagcagggcgtgcccgccttcaccgtgctgcagcccgagggccccctggccgtgctgagagacagagcccagcagatcagcgtgctgggcagccagagacaccccggccagggcagctgcggcagctgcccctggcacctgtgcagcagcccccaccccacctgcggcagcggcttcggcaccagaagcggcagagccggcagaagatgctgcggcgccggccccagccccggcacctggaccgtgagaaccccccccgccgccagaagacccgcctgcgccggcagcgccagaagatgcagagccgccagaggcagagccgtggcccccagattcgagagctgcagcagcatgctgcccggcaccggcaccagaagaccctgctag

SEQ ID NO: 81917 - DNA, 1128 bp, Artificial Sequence; identical to SEQ ID NO: 81916
  Description of Artificial Sequence: Synthetic coding sequence

SEQ ID NO: 81918 - DNA, 1764 bp, Artificial Sequence
  Description of Artificial Sequence: Synthetic coding sequence
atgagcagagccagaagccacctgagagccgccctgttcctggccgccgccagcgccagaggcatcaccacccaggtggccgccagaagaggcctgagcgcctggcccgtgccccaggagcccagcatggagtaccaggacgccgtgagaatgctgaacaccctgcagaccaacgccggctacctggagcaggtgaagagacagagaggcgacccccagacccagctggaggccatggagctgtacctggccagaagcggcctgcaggtggaggacctggacagactgaacatcatccacgtgaccggcaccaagggcaagggcagcacctgcgccttcaccgagtgcatcctgagaagctacggcctgaagaccggcttcttcagcagcccccacctggtgcaggtgagagagagaatcagaatcaacggccagcccatcagccccgagctgttcaccaagtacttctggagactgtaccacagactggaggagaccaaggacggcagctgcgtgagcatgcccccctacttcagattcctgaccctgatggccttccacgtgttcctgcaggagaaggtggacctggccgtggtggaggtgggcatcggcggcgcctacgactgcaccaacatcatcagaaagcccgtggtgtgcggcgtgagcagcctgggcatcgaccacaccagcctgctgggcgacaccgtggagaagatcgcctggcagaagggcggcatcttcaagcagggcgtgcccgccttcaccgtgctgcagcccgagggccccctggccgtgctgagagacagagcccagcagatcagctgccccctgtacctgtgccccatgctggaggccctggaggagggcggcccccccctgaccctgggcctggagggcgagcaccagagaagcaacgccgccctggccctgcagctggcccactgctggctgcagagacaggacagacacggcgccggcgagcccaaggccagcagacccggcctgctgtggcagctgcccctggcccccgtgttccagcccaccagccacatgagactgggcctgagaaacaccgagtggcccggcagaacccaggtgctgagaagaggccccctgacctggtacctggacggcgcccacaccgccagcagcgcccaggcctgcgtgagatggttcagacaggccctgcagggcagagagagacccagcggcggccccgaggtgagagtgctgctgttcaacgccaccggcgacagagaccccgccgccctgctgaagctgctgcagccctgccagttcgactacgccgtgttctgccccaacctgaccgaggtgagcagcaccggcaacgccgaccagcagaacttcaccgtgaccctggaccaggtgctgctgagatgcctggagcaccagcagcactggaaccacctggacgaggagcaggccagccccgacctgtggagcgcccccagccccgagcccggcggcagcgccagcctgctgctggccccccaccccccccacacctgcagcgccagcagcctggtgttcagctgcatcagccacgccctgcagtggatcagccagggcagagaccccatcttccagccccccagcccccccaagggcctgctgacccaccccgtggcccacagcggcgccagcatcctgagagaggccgccgccatccacgtgctggtgaccggcagcctgcacctggtgggcggcgtgctgaagctgctggagcccgccctgagccagtag

SEQ ID NO: 81919 - DNA, 1686 bp, Artificial Sequence
  Description of Artificial Sequence: Synthetic coding sequence
atgagcagagccagaagccacctgagagccgccctgttcctggccgccgccagcgccagaggcatcaccacccaggtggccgccagaagaggcctgagcgcctggcccgtgccccaggagcccagcatggagtaccaggacgccgtgagaatgctgaacaccctgcagaccaacgccggctacctggagcaggtgaagagacagagaggcgacccccagacccagctggaggccatggagctgtacctggccagaagcggcctgcaggtggaggacctggacagactgaacatcatccacgtgaccggcaccaagggcaagggcagcacctgcgccttcaccgagtgcatcctgagaagctacggcctgaagaccggcttcttcagcagcccccacctggtgcaggtgagagagagaatcagaatcaacggccagcccatcagccccgagctgttcaccaagtacttctggagactgtaccacagactggaggagaccaaggtggacctggccgtggtggaggtgggcatcggcggcgcctacgactgcaccaacatcatcagaaagcccgtggtgtgcggcgtgagcagcctgggcatcgaccacaccagcctgctgggcgacaccgtggagaagatcgcctggcagaagggcggcatcttcaagcagggcgtgcccgccttcaccgtgctgcagcccgagggccccctggccgtgctgagagacagagcccagcagatcagctgccccctgtacctgtgccccatgctggaggccctggaggagggcggcccccccctgaccctgggcctggagggcgagcaccagagaagcaacgccgccctggccctgcagctggcccactgctggctgcagagacaggacagacacggcgccggcgagcccaaggccagcagacccggcctgctgtggcagctgcccctggcccccgtgttccagcccaccagccacatgagactgggcctgagaaacaccgagtggcccggcagaacccaggtgctgagaagaggccccctgacctggtacctggacggcgcccacaccgccagcagcgcccaggcctgcgtgagatggttcagacaggccctgcagggcagagagagacccagcggcggccccgaggtgagagtgctgctgttcaacgccaccggcgacagagaccccgccgccctgctgaagctgctgcagccctgccagttcgactacgccgtgttctgccccaacctgaccgaggtgagcagcaccggcaacgccgaccagcagaacttcaccgtgaccctggaccaggtgctgctgagatgcctggagcaccagcagcactggaaccacctggacgaggagcaggccagccccgacctgtggagcgcccccagccccgagcccggcggcagcgccagcctgctgctggccccccaccccccccacacctgcagcgccagcagcctggtgttcagctgcatcagccacgccctgcagtggatcagccagggcagagaccccatcttccagccccccagcccccccaagggcctgctgacccaccccgtggcccacagcggcgccagcatcctgagagaggccgccgccatccacgtgctggtgaccggcagcctgcacctggtgggcggcgtgctgaagctgctggagcccgccctgagccagtag

SEQ ID NO: 81920 - DNA, 585 bp, Artificial Sequence
  Description of Artificial Sequence: Synthetic coding sequence
atgctgaacaccctgcagaccaacgccggctacctggagcaggtgaagagacagagaggcgacccccagacccagctggaggccatggagctgtacctggccagaagcggcctgcaggtggaggacctggacagactgaacatcatccacgtgaccggcaccaagggcaagggcagcacctgcgccttcaccgagtgcatcctgagaagctacggcctgaagaccggcttcttcagcagcccccacctggtgcaggtgagagagagaatcagaatcaacggccagcccatcagccccgagctgttcaccaagtacttctggagactgtaccacagactggaggagaccaaggtggacctggccgtggtggaggtgggcatcggcggcgcctacgactgcaccaacatcatcagaaagcccgtggtgtgcggcgtgagcagcctgggcatcgaccacaccagcctgctgggcgacaccgtggagaagatcgcctggcagaagggcggcatcttcaagcagggcgtgcccgccttcaccgtgctgcagcccgagggccccctggccgtgctgagagacagagcctag

SEQ ID NO: 81921 - DNA, 798 bp, Artificial Sequence
  Description of Artificial Sequence: Synthetic coding sequence
atgctgaacaccctgcagaccaacgccggctacctggagcaggtgaagagacagagaggcgacccccagacccagctggaggccatggagctgtacctggccagaagcggcctgcaggtggaggacctggacagactgaacatcatccacgtgaccggcaccaagggcaagggcagcacctgcgccttcaccgagtgcatcctgagaagctacggcctgaagaccggcttcttcagcagcccccacctggtgcaggtgagagagagaatcagaatcaacggccagcccatcagccccgagctgttcaccaagtacttctggagactgtaccacagactggaggagaccaaggacggcagctgcgtgagcatgcccccctacttcagattcctgaccctgatggccttccacgtgttcctgcaggagaaggtggacctggccgtggtggaggtgggcatcggcggcgcctacgactgcaccaacatcatcagaaagcccgtggtgtgcggcgtgagcagcctgggcatcgaccacaccagcctgctgggcgacaccgtggagaagatcgcctggcagaagggcggcatcttcaagcagggcgtgcccgccttcaccgtgctgcagcccgagggccccctggccgtgctgagagacagagcccagcagatcagcgtgctgggcagccagagacaccccggccagggcagctgcggcagctgcccctggcacctgtgcagcagcccccaccccacctgcggcagcggcttcggcaccagaagcggcagagccggcagatag

SEQ ID NO: 81922 - DNA, 1392 bp, Artificial Sequence
  Description of Artificial Sequence: Synthetic coding sequence
atgcacagcgccagcagcatgctgggcgccgtgaagatggagggccacgagcccagcgactggagcagctactacgccgagcccgagggctacagcagcgtgagcaacatgaacgccggcctgggcatgaacggcatgaacacctacatgagcatgagcgccgccgccatgggcagcggcagcggcaacatgagcgccggcagcatgaacatgagcagctacgtgggcgccggcatgagccccagcctggccggcatgagccccggcgccggcgccatggccggcatgggcggcagcgccggcgccgccggcgtggccggcatgggcccccacctgagccccagcctgagccccctgggcggccaggccgccggcgccatgggcggcctggccccctacgccaacatgaacagcatgagccccatgtacggccaggccggcctgagcagagccagagaccccaagacctacagaagaagctacacccacgccaagcccccctacagctacatcagcctgatcaccatggccatccagcagagccccaacaagatgctgaccctgagcgagatctaccagtggatcatggacctgttccccttctacagacagaaccagcagagatggcagaacagcatcagacacagcctgagcttcaacgactgcttcctgaaggtgcccagaagccccgacaagcccggcaagggcagcttctggaccctgcaccccgacagcggcaacatgttcgagaacggctgctacctgagaagacagaagagattcaagtgcgagaagcagctggccctgaaggaggccgccggcgccgccggcagcggcaagaaggccgccgccggcgcccaggccagccaggcccagctgggcgaggccgccggccccgccagcgagacccccgccggcaccgagagcccccacagcagcgccagcccctgccaggagcacaagagaggcggcctgggcgagctgaagggcacccccgccgccgccctgagcccccccgagcccgcccccagccccggccagcagcagcaggccgccgcccacctgctgggccccccccaccaccccggcctgccccccgaggcccacctgaagcccgagcaccactacgccttcaaccaccccttcagcatcaacaacctgatgagcagcgagcagcagcaccaccacagccaccaccaccaccagccccacaagatggacctgaaggcctacgagcaggtgatgcactaccccggctacggcagccccatgcccggcagcctggccatgggccccgtgaccaacaagaccggcctggacgccagccccctggccgccgacaccagctactaccagggcgtgtacagcagacccatcatgaacagcagctag

SEQ ID NO: 81923 - DNA, 1374 bp, Artificial Sequence
  Description of Artificial Sequence: Synthetic coding sequence
atgctgggcgccgtgaagatggagggccacgagcccagcgactggagcagctactacgccgagcccgagggctacagcagcgtgagcaacatgaacgccggcctgggcatgaacggcatgaacacctacatgagcatgagcgccgccgccatgggcagcggcagcggcaacatgagcgccggcagcatgaacatgagcagctacgtgggcgccggcatgagccccagcctggccggcatgagccccggcgccggcgccatggccggcatgggcggcagcgccggcgccgccggcgtggccggcatgggcccccacctgagccccagcctgagccccctgggcggccaggccgccggcgccatgggcggcctggccccctacgccaacatgaacagcatgagccccatgtacggccaggccggcctgagcagagccagagaccccaagacctacagaagaagctacacccacgccaagcccccctacagctacatcagcctgatcaccatggccatccagcagagccccaacaagatgctgaccctgagcgagatctaccagtggatcatggacctgttccccttctacagacagaaccagcagagatggcagaacagcatcagacacagcctgagcttcaacgactgcttcctgaaggtgcccagaagccccgacaagcccggcaagggcagcttctggaccctgcaccccgacagcggcaacatgttcgagaacggctgctacctgagaagacagaagagattcaagtgcgagaagcagctggccctgaaggaggccgccggcgccgccggcagcggcaagaaggccgccgccggcgcccaggccagccaggcccagctgggcgaggccgccggccccgccagcgagacccccgccggcaccgagagcccccacagcagcgccagcccctgccaggagcacaagagaggcggcctgggcgagctgaagggcacccccgccgccgccctgagcccccccgagcccgcccccagccccggccagcagcagcaggccgccgcccacctgctgggccccccccaccaccccggcctgccccccgaggcccacctgaagcccgagcaccactacgccttcaaccaccccttcagcatcaacaacctgatgagcagcgagcagcagcaccaccacagccaccaccaccaccagccccacaagatggacctgaaggcctacgagcaggtgatgcactaccccggctacggcagccccatgcccggcagcctggccatgggccccgtgaccaacaagaccggcctggacgccagccccctggccgccgacaccagctactaccagggcgtgtacagcagacccatcatgaacagcagctag

SEQ ID NO: 81924 - DNA, 1374 bp, Artificial Sequence; identical to SEQ ID NO: 81923
  Description of Artificial Sequence: Synthetic coding sequence

SEQ ID NO: 81925 - DNA, 1032 bp, Artificial Sequence
  Description of Artificial Sequence: Synthetic coding sequence
atgctgggcgccgtgaagatggagggccacgagcccagcgactggagcagctactacgccgagcccgagggctacagcagcgtgagcagagccagagaccccaagacctacagaagaagctacacccacgccaagcccccctacagctacatcagcctgatcaccatggccatccagcagagccccaacaagatgctgaccctgagcgagatctaccagtggatcatggacctgttccccttctacagacagaaccagcagagatggcagaacagcatcagacacagcctgagcttcaacgactgcttcctgaaggtgcccagaagccccgacaagcccggcaagggcagcttctggaccctgcaccccgacagcggcaacatgttcgagaacggctgctacctgagaagacagaagagattcaagtgcgagaagcagctggccctgaaggaggccgccggcgccgccggcagcggcaagaaggccgccgccggcgcccaggccagccaggcccagctgggcgaggccgccggccccgccagcgagacccccgccggcaccgagagcccccacagcagcgccagcccctgccaggagcacaagagaggcggcctgggcgagctgaagggcacccccgccgccgccctgagcccccccgagcccgcccccagccccggccagcagcagcaggccgccgcccacctgctgggccccccccaccaccccggcctgccccccgaggcccacctgaagcccgagcaccactacgccttcaaccaccccttcagcatcaacaacctgatgagcagcgagcagcagcaccaccacagccaccaccaccaccagccccacaagatggacctgaaggcctacgagcaggtgatgcactaccccggctacggcagccccatgcccggcagcctggccatgggccccgtgaccaacaagaccggcctggacgccagccccctggccgccgacaccagctactaccagggcgtgtacagcagacccatcatgaacagcagctag

SEQ ID NO: 81926 - DNA, 1053 bp, Artificial Sequence
  Description of Artificial Sequence: Synthetic coding sequence
atgctgggcagcgtgaagatggaggcccacgacctggccgagtggagctactaccccgaggccggcgaggtgtacagccccgtgacccccgtgcccaccatggcccccctgaacagctacatgaccctgaaccccctgagcagcccctacccccccggcggcctgcccgccagccccctgcccagcggccccctggccccccccgcccccgccgcccccctgggccccaccttccccggcctgggcgtgagcggcggcagcagcagcagcggctacggcgcccccggccccggcctggtgcacggcaaggagatgcccaagggctacagaagacccctggcccacgccaagcccccctacagctacatcagcctgatcaccatggccatccagcaggcccccggcaagatgctgaccctgagcgagatctaccagtggatcatggacctgttcccctactacagagagaaccagcagagatggcagaacagcatcagacacagcctgagcttcaacgactgcttcgtgaaggtggccagaagccccgacaagcccggcaagggcagctactgggccctgcaccccagcagcggcaacatgttcgagaacggctgctacctgagaagacagaagagattcaagctggaggagaaggtgaagaagggcggcagcggcgccgccaccaccaccagaaacggcaccggcagcgccgccagcaccaccacccccgccgccaccgtgaccagccccccccagccccccccccccgcccccgagcccgaggcccagggcggcgaggacgtgggcgccctggactgcggcagccccgccagcagcaccccctacttcaccggcctggagctgcccggcgagctgaagctggacgccccctacaacttcaaccaccccttcagcatcaacaacctgatgagcgagcagacccccgccccccccaagctggacgtgggcttcggcggctacggcgccgagggcggcgagcccggcgtgtactaccagggcctgtacagcagaagcctgctgaacgccagctag

SEQ ID NO: 81927 - DNA, 1662 bp, Artificial Sequence
  Description of Artificial Sequence: Synthetic coding sequence
atgcaggccagatacagcgtgagcagccccaacagcctgggcgtggtgccctacctgggcggcgagcagagctactacagagccgccgccgccgccgccggcggcggctacaccgccatgcccgcccccatgagcgtgtacagccaccccgcccacgccgagcagtaccccggcggcatggccagagcctacggcccctacaccccccagccccagcccaaggacatggtgaagcccccctacagctacatcgccctgatcaccatggccatccagaacgcccccgacaagaagatcaccctgaacggcatctaccagttcatcatggacagattccccttctacagagacaacaagcagggctggcagaacagcatcagacacaacctgagcctgaacgagtgcttcgtgaaggtgcccagagacgacaagaagcccggcaagggcagctactggaccctggaccccgacagctacaacatgttcgagaacggcagcttcctgagaagaagaagaagattcaagaagaaggacgccgtgaaggacaaggaggagaaggacagactgcacctgaaggagccccccccccccggcagacagcccccccccgccccccccgagcaggccgacggcaacgcccccggcccccagcccccccccgtgagaatccaggacatcaagaccgagaacggcacctgccccagccccccccagcccctgagccccgccgccgccctgggcagcggcagcgccgccgccgtgcccaagatcgagagccccgacagcagcagcagcagcctgagcagcggcagcagcccccccggcagcctgcccagcgccagacccctgagcctggacggcgccgacagcgccccccccccccccgcccccagcgccccccccccccaccacagccagggcttcagcgtggacaacatcatgaccagcctgagaggcagcccccagagcgccgccgccgagctgagcagcggcctgctggccagcgccgccgccagcagcagagccggcatcgccccccccctggccctgggcgcctacagccccggccagagcagcctgtacagcagcccctgcagccagaccagcagcgccggcagcagcggcggcggcggcggcggcgccggcgccgccggcggcgccggcggcgccggcacctaccactgcaacctgcaggccatgagcctgtacgccgccggcgagagaggcggccacctgcagggcgcccccggcggcgccggcggcagcgccgtggacgaccccctgcccgactacagcctgccccccgtgaccagcagcagcagcagcagcctgagccacggcggcggcggcggcggcggcggcggcggccaggaggccggccaccaccccgccgcccaccagggcagactgaccagctggtacctgaaccaggccggcggcgacctgggccacctggccagcgccgccgccgccgccgccgccgccggctaccccggccagcagcagaacttccacagcgtgagagagatgttcgagagccagagaatcggcctgaacaacagccccgtgaacggcaacagcagctgccagatggccttccccagcagccagagcctgtacagaaccagcggcgccttcgtgtacgactgcagcaagttctag

SEQ ID NO: 81928 - DNA, 639 bp, Artificial Sequence
  Description of Artificial Sequence: Synthetic coding sequence
atgcaggccagatacagcgtgagcagccccaacagcctgggcgtggtgccctacctgggcggcgagcagagctactacagagccgccgccgccgccgccggcggcggctacaccgccatgcccgcccccatgagcgtgtacagccaccccgcccacgccgagcagtaccccggcggcatggccagagcctacggcccctacaccccccagccccagcccaaggacatggtgaagcccccctacagctacatcgccctgatcaccatggccatccagaacgcccccgacaagaagatcaccctgaacggcatctaccagttcatcatggacagattccccttctacagagacaacaagcagggctggcagaacagcatcagacacaacctgagcctgaacgagtgcttcgtgaaggtgcccagagacgacaagaagcccggcaagggcagctactggaccctggaccccgacagctacaacatgttcgagaacggcagcttcctgagaagaagaagaagattcaagaagaaggacgccgtgaaggacaaggaggagaaggacagaccccaggccaccagagccagcagcagaaccagcaccagatgcggcagatgcagcagccacagaggcagcgcctag

SEQ ID NO: 81929 - DNA, 1488 bp, Artificial Sequence
  Description of Artificial Sequence: Synthetic coding sequence
atgaccctgggcagctgctgctgcgagatcatgagcagcgagagcagccccgccgccctgagcgaggccgacgccgacatcgacgtggtgggcggcggcagcggcggcggcgagctgcccgccagaagcggccccagagcccccagagacgtgctgccccacggccacgagccccccgccgaggaggccgaggccgacctggccgaggacgaggaggagagcggcggctgcagcgacggcgagcccagagccctggccagcagaggcgccgccgccgccgccggcagccccggccccggcgccgccgccgccagaggcgccgccggccccggccccggcccccccagcggcggcgccgccaccagaagccccctggtgaagcccccctacagctacatcgccctgatcaccatggccatcctgcagagccccaagaagagactgaccctgagcgagatctgcgagttcatcagcggcagattcccctactacagagagaagttccccgcctggcagaacagcatcagacacaacctgagcctgaacgactgcttcgtgaagatccccagagagcccggcaaccccggcaagggcaactactggaccctggaccccgagagcgccgacatgttcgacaacggcagcttcctgagaagaagaaagagattcaagagacagcccctgccccccccccacccccacccccacccccaccccgagctgctgctgagaggcggcgccgccgccgccggcgaccccggcgccttcctgcccggcttcgccgcctacggcgcctacggctacggctacggcctggccctgcccgcctacggcgcccccccccccggccccgccccccacccccacccccacccccacgccttcgccttcgccgccgccgccgccgccgccccctgccagctgagcgtgccccccggcagagccgccgcccccccccccggcccccccaccgccagcgtgttcgccggcgccggcagcgcccccgcccccgcccccgccagcggcagcggccccggccccggccccgccggcctgcccgccttcctgggcgccgagctgggctgcgccaaggccttctacgccgccagcctgagcccccccgccgccggcaccgccgccggcctgcccaccgccctgctgagacagggcctgaagaccgacgccggcggcggcgccggcggcggcggcgccggcgccggccagagacccagcttcagcatcgaccacatcatgggccacggcggcggcggcgccgccccccccggcgccggcgagggcagccccggcccccccttcgccgccgccgccggccccggcggccaggcccaggtgctggccatgctgaccgcccccgccctggcccccgtggccggccacatcagactgagccaccccggcgacgccctgctgagcagcggcagcagattcgccagcaaggtggccggcctgagcggctgccacttctag

SEQ ID NO: 81930 - DNA, 1437 bp, Artificial Sequence
  Description of Artificial Sequence: Synthetic coding sequence
atgaccctgagcggcggcggcagcgccagcgacatgagcggccagaccgtgctgaccgccgaggacgtggacatcgacgtggtgggcgagggcgacgacggcctggaggagaaggacagcgacgccggctgcgacagccccgccggcccccccgagctgagactggacgaggccgacgaggtgccccccgccgccccccaccacggccagccccagcccccccaccagcagcccctgaccctgcccaaggaggccgccggcgccggcgccggccccggcggcgacgtgggcgcccccgaggccgacggctgcaagggcggcgtgggcggcgaggagggcggcgccagcggcggcggccccggcgccggcagcggcagcgccggcggcctggcccccagcaagcccaagaacagcctggtgaagcccccctacagctacatcgccctgatcaccatggccatcctgcagagcccccagaagaagctgaccctgagcggcatctgcgagttcatcagcaacagattcccctactacagagagaagttccccgcctggcagaacagcatcagacacaacctgagcctgaacgactgcttcgtgaagatccccagagagcccggcaaccccggcaagggcaactactggaccctggacccccagagcgaggacatgttcgacaacggcagcttcctgagaagaagaaagagattcaagagacaccagcaggagcacctgagagagcagaccgccctgatgatgcagagcttcggcgcctacagcctggccgccgccgccggcgccgccggcccctacggcagaccctacggcctgcaccccgccgccgccgccggcgcctacagccaccccgccgccgccgccgccgccgccgccgccgccgccctgcagtacccctacgccctgccccccgtggcccccgtgctgccccccgccgtgcccctgctgcccagcggcgagctgggcagaaaggccgccgccttcggcagccagctgggccccggcctgcagctgcagctgaacagcctgggcgccgccgccgccgccgccggcaccgccggcgccgccggcaccaccgccagcctgatcaagagcgagcccagcgccagacccagcttcagcatcgagaacatcatcggcggcggccccgccgcccccggcggcagcgccgtgggcgccggcgtggccggcggcaccggcggcagcggcggcggcagcaccgcccagagcttcctgagaccccccggcaccgtgcagagcgccgccctgatggccacccaccagcccctgagcctgagcagaaccaccgccaccatcgcccccatcctgagcgtgcccctgagcggccagttcctgcagcccgccgccagcgccgccgccgccgccgccgccgccgcccaggccaagtggcccgcccagtag

SEQ ID NO: 81931 - DNA, 1320 bp, Artificial Sequence
  Description of Artificial Sequence: Synthetic coding sequence
atgaacctgcccagagccgagagactgagaagcaccccccagagaagcctgagagacagcgacggcgaggacggcaagatcgacgtgctgggcgaggaggaggacgaggacgaggaggaggccgccagccagcagttcctggagcagagcctgcagcccggcctgcaggtggccagatggggcggcgtggccctgcccagagagcacatcgagggcggcggcggccccagcgaccccagcgagttcggcaccgagttcagagccccccccagaagcgccgccgccagcgaggacgccagacagcccgccaagccccccagcagctacatcgccctgatcaccatggccatcctgcagagcccccacaagagactgaccctgagcggcatctgcgccttcatcagcgacagattcccctactacagaagaaagttccccgcctggcagaacagcatcagacacaacctgagcctgaacgactgcttcgtgaagatccccagagagcccggcagacccggcaagggcaactactggagcctggaccccgccagccaggacatgttcgacaacggcagcttcctgagaagaagaaagagattccagagacaccagcccacccccggcgcccacctgccccaccccttccccctgcccgccgcccacgccgccctgcacaaccccagacccggccccctgctgggcgcccccgcccccccccagcccgtgcccggcgcctaccccaacaccggccccggcagaagaccctacgccctgctgcacccccacccccccagatacctgctgctgagcgcccccgcctacgccggcgcccccaagaaggccgagggcgccgacctggccacccccgcccccttcccctgctgcagcccccacctggtgctgagcctgggcagaagagccagagtgtggagaagacacagagaggccgacgccagcctgagcgccctgagagtgagctgcaagggcagcggcgagagagtgcagggcctgagaagagtgtgccccagacccagaggcgccaccgccccctgcagcagcgacagacaggcctgcagaaccatcctgcagcagcagcagagacaccaggaggaggactgcgccaacggctgcgcccccaccaagggcgccgtgctgggcggccacctgagcgccgccagcgccctgctgagataccaggccgtggccgagggcagcggcctgaccagcctggccgcccccctgggcggcgagggcaccagccccgtgttcctggtgagccccacccccagcagcctggccgagagcgccggccccagctag

SEQ ID NO: 81932 - DNA, 1227 bp, Artificial Sequence
  Description of Artificial Sequence: Synthetic coding sequence
atgaacctgcccagagccgagagacccagaagcaccccccagagaagcctgagagacagcgacggcgaggacggcaagatcgacgtgctgggcgaggaggaggacgaggacgaggtggaggacgaggaggaggaggccagccagaagttcctggagcagagcctgcagcccggcctgcaggtggccagatggggcggcgtggccctgcccagagagcacatcgagggcggcggccccagcgaccccagcgagttcggcaccgagttcagagccccccccagaagcgccgccgccagcgaggacgccagacagcccgccaagcccccctacagctacatcgccctgatcaccatggccatcctgcagagcccccacaagagactgaccctgagcggcatctgcgccttcatcagcggcagattcccctactacagaagaaagttccccgcctggcagaacagcatcagacacaacctgagcctgaacgactgcttcgtgaagatccccagagagcccggccaccccggcaagggcacctactggagcctggaccccgccagccaggacatgttcgacaacggcagcttcctgagaagaagaaagagattcaagagacaccagctgacccccggcgcccacctgccccaccccttccccctgcccgccgcccacgccgccctgcacaaccccagacccggccccctgctgggcgcccccgccctgccccagcccgtgcccggcgcctaccccaacaccgcccccggcagaagaccctacgccctgctgcacccccacccccccagatacctgctgctgagcgcccccgcctacgccggcgcccccaagaaggccgagggcgccgacctggccacccccggcaccctgcccgtgctgcagcccagcctgggcccccagccctgggaggagggcaagggcctggccagcccccccggcggcggctgcatcagcttcagcatcgagagcatcatgcagggcgtgagaggcgccggcaccggcgccgcccagagcctgagccccaccgcctggagctactgccccctgctgcagagacccagcagcctgagcgacaacttcgccgccaccgccgccgccagcggcggcggcctgagacagagactgagaagccaccagggcagaggcgccggcagagcccccgtgggcagagtgggcgccgccgccgtgagcggcggcggcagaggcctgtag

SEQ ID NO: 81933 - DNA, 1251 bp, Artificial Sequence
  Description of Artificial Sequence: Synthetic coding sequence
atgaacctgcccagagccgagagacccagaagcaccccccagagaagcctgagagacagcgacggcgaggacggcaagatcgacgtgctgggcgaggaggaggacgaggacgaggtggaggacgaggaggaggaggccagacagcagttcctggagcagagcctgcagcccggcctgcaggtggccagatggggcggcgtggccctgcccagagagcacatcgagggcggcggcggccccagcgaccccagcgagttcggcaccaagttcagagccccccccagaagcgccgccgccagcgaggacgccagacagcccgccaagcccccctacagctacatcgccctgatcaccatggccatcctgcagaacccccacaagagactgaccctgagcggcatctgcgccttcatcagcggcagattcccctactacagaagaaagttccccgcctggcagaacagcatcagacacaacctgagcctgaacgactgcttcgtgaagatccccagagagcccggccaccccggcaagggcaactactggagcctggaccccgccagccaggacatgttcgacaacggcagcttcctgagaagaagaaagagattcaagagacaccagctgacccccggcgcccacctgccccaccccttccccctgcccgccgcccacgccgccctgcacaacccccaccccggccccctgctgggcgcccccgcccccccccagcccgtgcccggcgcctaccccaacaccgcccccggcagaagaccctacgccctgctgcacccccaccccctgagatacctgctgctgagcgccagagtgtacgccggcgcccccaagaaggccgagggcgccgacctggccacccccgcccccttcccctgctgcagcccccacctggtgctgagcctgggcagaagagccagagtgtggagaagacacagagaggccgacgccagcctgagcgccctgagagtgctgtgcaagggcagcggcgagagagtgcagggcctgagaagagtgtgccccagacccagaggcgccaccgccacctgcagcagcgaccaccaggcctgctgcatccccaagcccctgcccctgtgctgcaagtgccccccccccctgctgctgggccagttctgcagcaacagcagcagcatcagaagaaccgcccccaccgccgccctgccccccagagccagatgctgggccggcacctgcagacccagaagaagatgctag

SEQ ID NO: 81934 - DNA, 1254 bp, Artificial Sequence
  Description of Artificial Sequence: Synthetic coding sequence
atgaacctgcccagagccgagagactgagaagcaccccccagagaagcctgagagacagcgacggcgaggacggcaagatcgacgtgctgggcgaggaggaggacgaggacgaggtggaggacgaggaggaggccgccagccagcagttcctggagcagagcctgcagcccggcctgcaggtggccagatggggcggcgtggccctgcccagagagcacatcgagggcggcggcggccccagcgaccccagcgagttcggcaccaagttcagagccccccccagaagcgccgccgccagcgaggacgccagacagcccgccaagcccccctacagctacatcgccctgatcaccatggccatcctgcagaacccccacaagagactgaccctgagcggcatctgcgccttcatcagcggcagattcccctactacagaagaaagttccccgcctggcagaacagcatcagacacaacctgagcctgaacgactgcttcgtgaagatccccagagagcccggccaccccggcaagggcaactactggagcctggaccccgccagccaggacatgttcgacaacggcagcttcctgagaagaagaaagagattcaagagacaccagctgacccccggcgcccacctgccccaccccttccccctgcccgccgcccacgccgccctgcacaaccccagacccggccccctgctgggcgcccccgcccccccccagcccgtgcccggcgcctaccccaacaccgcccccggcagaagaccctacgccctgctgcacccccaccccctgagatacctgctgctgagcgcccccgtgtacgccggcgcccccaagaaggccgagggcgccgccctggccacccccgcccccttcccctgctgcagcccccacctggtgctgagcctgggcagaagagccagagtgtggagaagacacagagaggccgacgccagcctgagcgccctgagagtgctgtgcaagggcagcggcgagagagtgcagggcctgagaagaatctgccccagacccagaggcgccaccgccacctgcagcagcgaccaccaggcctgctgcatccccagacccctgcccctgtgctgcaagtgcccccccccccccctgctgggccagttctgcagcaacagcagcagcatcagaagaagaaccgcccccaccgccgccctgccccccagagccagatgctgggccggcacctgcagacccagaagaccctgctag

SEQ ID NO: 81935 - DNA, 1122 bp, Artificial Sequence
  Description of Artificial Sequence: Synthetic coding sequence
atgaccgccgagagcggccccccccccccccagcccgaggtgctggccaccgtgaaggaggagagaggcgagaccgccgccggcgccggcgtgcccggcgaggccaccggcagaggcgccggcggcagaagaagaaagagacccctgcagagaggcaagcccccctacagctacatcgccctgatcgccatggccatcgcccacgcccccgagagaagactgaccctgggcggcatctacaagttcatcaccgagagattccccttctacagagacaaccccaagaagtggcagaacagcatcagacacaacctgaccctgaacgactgcttcctgaagatccccagagaggccggcagacccggcaagggcaactactgggccctggaccccaacgccgaggacatgttcgagagcggcagcttcctgagaagaagaaagagattcaagagaagcgacctgagcacctaccccgcctacatgcacgacgccgccgccgccgccgccgccgccgccgccgccgccgccgccgccgccatcttccccggcgccgtgcccgccgccagacccccctaccccggcgccgtgtacgccggctacgccccccccagcctggccgcccccccccccgtgtactaccccgccgccagccccggcccctgcagagtgttcggcctggtgcccgagagacccctgagccccgagctgggccccgcccccagcggccccggcggcagctgcgccttcgccagcgccggcgcccccgccaccaccaccggctaccagcccgccggctgcaccggcgccagacccgccaaccccagcgcctacgccgccgcctacgccggccccgacggcgcctacccccagggcgccggcagcgccatcttcgccgccgccggcagactggccggccccgccagcccccccgccggcggcagcagcggcggcgtggagaccaccgtggacttctacggcagaaccagccccggccagttcggcgccctgggcgcctgctacaaccccggcggccagctgggcggcgccagcgccggcgcctaccacgccagacacgccgccgcctaccccggcggcatcgacagattcgtgagcgccatgtag

SEQ ID NO: 81936 - DNA, 960 bp, Artificial Sequence
  Description of Artificial Sequence: Synthetic coding sequence
atggccggcagaagcgacatggacccccccgccgccttcagcggcttccccgccctgcccgccgtggcccccagcggccccccccccagccccctggccggcgccgagcccggcagagagcccgaggaggccgccgccggcagaggcgaggccgcccccacccccgcccccggccccggcagaagaagaagaagacccctgcagagaggcaagcccccctacagctacatcgccctgatcgccatggccctggcccacgcccccggcagaagactgaccctggccgccatctacagattcatcaccgagagattcgccttctacagagacagccccagaaagtggcagaacagcatcagacacaacctgaccctgaacgactgcttcgtgaaggtgcccagagagcccggcaaccccggcaagggcaactactggaccctggaccccgccgccgccgacatgttcgacaacggcagcttcctgagaagaagaaagagattcaagagagccgagctgcccgcccacgccgccgccgcccccggcccccccctgcccttcccctacgccccctacgcccccgcccccggccccgccctgctggtgcccccccccagcgccggccccggccccagcccccccgccagactgttcagcgtggacagcctggtgaacctgcagcccgagctggccggcctgggcgcccccgagcccccctgctgcgccgcccccgacgccgccgccgccgccttccccccctgcgccgccgccgccagcccccccctgtacagccaggtgcccgacagactggtgctgcccgccaccagacccggccccggccccctgcccgccgagcccctgctggccctggccggccccgccgccgccctgggccccctgagccccggcgaggcctacctgagacagcccggcttcgccagcggcctggagagatacctgtag

SEQ ID NO: 81937 - DNA, 1335 bp, Artificial Sequence
  Description of Artificial Sequence: Synthetic coding sequence
atgaccaccgagggcggccccccccccgcccccctgagaagagcctgcagccccgtgcccggcgccctgcaggccgccctgatgagccccccccccgccgccgccgccgccgccgccgccgcccccgagaccaccagcagcagcagcagcagcagcagcgccagctgcgccagcagcagcagcagcagcaacagcgccagcgcccccagcgccgcctgcaagagcgccggcggcggcggcgccggcgccggcagcggcggcgccaagaaggccagcagcggcctgagaagacccgagaagcccccctacagctacatcgccctgatcgtgatggccatccagagcagccccagcaagagactgaccctgagcgagatctaccagttcctgcaggccagattccccttcttcagaggcgcctaccagggctggaagaacagcgtgagacacaacctgagcctgaacgagtgcttcatcaagctgcccaagggcctgggcagacccggcaagggccactactggaccatcgaccccgccagcgagttcatgttcgaggagggcagcttcagaagaagacccagaggcttcagaagaaagtgccaggccctgaagcccatgtaccacagagtggtgagcggcctgggcttcggcgccagcctgctgccccagggcttcgacttccaggccccccccagcgcccccctgggctgccacagccagggcggctacggcggcctggacatgatgcccgccggctacgacgccggcgccggcgcccccagccacgcccacccccaccaccaccaccaccaccacgtgccccacatgagccccaaccccggcagcacctacatggccagctgccccgtgcccgccggccccggcggcgtgggcgccgccggcggcggcggcggcggcgactacggccccgacagcagcagcagccccgtgcccagcagccccgccatggccagcgccatcgagtgccacagcccctacaccagccccgccgcccactggagcagccccggcgccagcccctacctgaagcagccccccgccctgacccccagcagcaaccccgccgccagcgccggcctgcacagcagcatgagcagctacagcctggagcagagctacctgcaccagaacgccagagaggacctgagcgtgggcctgcccagataccagcaccacagcacccccgtgtgcgacagaaaggacttcgtgctgaacttcaacggcatcagcagcttccaccccagcgccagcggcagctactaccaccaccaccaccagagcgtgtgccaggacatcaagccctgcgtgatgtag

SEQ ID NO: 81938 - DNA, 1470 bp, Artificial Sequence
  Description of Artificial Sequence: Synthetic coding sequence
atgctggacatgggcgacagaaaggaggtgaagatgatccccaagagcagcttcagcatcaacagcctggtgcccgaggccgtgcagaacgacaaccaccacgccagccacggccaccacaacagccaccacccccagcaccaccaccaccaccaccaccaccaccaccacccccccccccccgccccccagccccccccccccccccagcagcagcagcccccccccccccccccccccgccccccagcccccccagaccagaggcgcccccgccgccgacgacgacaagggcccccagcagctgctgctgccccccccccccccccccccccccgccgccgccctggacggcgccaaggccgacggcctgggcggcaagggcgagcccggcggcggccccggcgagctggcccccgtgggccccgacgagaaggagaagggcgccggcgccggcggcgaggagaagaagggcgccggcgagggcggcaaggacggcgagggcggcaaggagggcgagaagaagaacggcaagtacgagaagccccccttcagctacaacgccctgatcatgatggccatcagacagagccccgagaagagactgaccctgaacggcatctacgagttcatcatgaagaacttcccctactacagagagaacaagcagggctggcagaacagcatcagacacaacctgagcctgaacaagtgcttcgtgaaggtgcccagacactacgacgaccccggcaagggcaactactggatgctggaccccagcagcgacgacgtgttcatcggcggcaccaccggcaagctgagaagaagaagcaccaccagcagagccaagctggccttcaagagaggcgccagactgaccagcaccggcctgaccttcatggacagagccggcagcctgtactggcccatgagccccttcctgagcctgcaccaccccagagccagcagcaccctgagctacaacggcaccaccagcgcctaccccagccaccccatgccctacagcagcgtgctgacccagaacagcctgggcaacaaccacagcttcagcaccgccaacggcctgagcgtggacagactggtgaacggcgagatcccctacgccacccaccacctgaccgccgccgccctggccgccagcgtgccctgcggcctgagcgtgccctgcagcggcacctacagcctgaacccctgcagcgtgaacctgctggccggccagaccagctacttcttcccccacgtgccccaccccagcatgaccagccagagcagcaccagcatgagcgccagagccgccagcagcagcaccagcccccaggcccccagcaccctgccctgcgagagcctgagacccagcctgcccagcttcaccaccggcctgagcggcggcctgagcgactacttcacccaccagaaccagggcagcagcagcaaccccctgatccactag

SEQ ID NO: 81939 - DNA, 1470 bp, Artificial Sequence; identical to SEQ ID NO: 81938
  Description of Artificial Sequence: Synthetic coding sequence

SEQ ID NO: 81940 - DNA, 1137 bp, Artificial Sequence
  Description of Artificial Sequence: Synthetic coding sequence
atgagcagcttcgacctgcccgcccccagcccccccagatgcagcccccagttccccagcatcggccaggagccccccgagatgaacctgtactacgagaacttcttccacccccagggcgtgcccagcccccagagacccagcttcgagggcggcggcgagtacggcgccacccccaacccctacctgtggttcaacggccccaccatgaccccccccccctacctgcccggccccaacgccagccccttcctgccccaggcctacggcgtgcagagacccctgctgcccagcgtgagcggcctgggcggcagcgacctgggctggctgcccatccccagccaggaggagctgatgaagctggtgagacccccctacagctacagcgccctgatcgccatggccatccacggcgcccccgacaagagactgaccctgagccagatctaccagtacgtggccgacaacttccccttctacaacaagagcaaggccggctggcagaacagcatcagacacaacctgagcctgaacgactgcttcaagaaggtgcccagagacgaggacgaccccggcaagggcaactactggaccctggaccccaactgcgagaagatgttcgacaacggcaacttcagaagaaagagaaagagaaagagcgacgtgagcagcagcaccgccagcctggccctggagaagaccgagagcagcctgcccgtggacagccccaagaccaccgagccccaggacatcctggacggcgccagccccggcggcaccaccagcagccccgagaagagacccagccccccccccagcggcgccccctgcctgaacagcttcctgagcagcatgaccgcctacgtgagcggcggcagccccaccagccaccccctggtgacccccggcctgagccccgagcccagcgacaagaccggccagaacagcctgaccttcaacagcttcagccccctgaccaacctgagcaaccacagcggcggcggcgactgggccaaccccatgcccaccaacatgctgagctacggcggcagcgtgctgagccagttcagcccccacttctacaacagcgtgaacaccagcggcgtgctgtaccccagagagggcaccgaggtgtag

SEQ ID NO: 81941 - DNA, 852 bp, Artificial Sequence
  Description of Artificial Sequence: Synthetic coding sequence
atgagcagcttcgacctgcccgcccccagcccccccagatgcagcccccagttccccagcatcggccaggagccccccgagatgaacctgtactacgagaacttcttccacccccagggcgtgcccagcccccagagacccagcttcgagggcggcggcgagtacggcgccacccccaacccctacctgtggttcaacggccccaccatgaccccccccccctacctgcccggccccaacgccagccccttcctgccccaggcctacggcgtgcagagacccctgctgcccagcgtgagcggcctgggcggcagcgacctgggctggctgcccatccccagccaggaggagctgatgaagctggtgagacccccctacagctacagcgccctgatcgccatggccatccacggcgcccccgacaagagactgaccctgagccagatctaccagtacgtggccgacaacttccccttctacaacaagagcaaggccggctggcagaacagcatcagacacaacctgagcctgaacgactgcttcaagaaggtgcccagagacgaggacgaccccgcctacgtgagcggcggcagccccaccagccaccccctggtgacccccggcctgagccccgagcccagcgacaagaccggccagaacagcctgaccttcaacagcttcagccccctgaccaacctgagcaaccacagcggcggcggcgactgggccaaccccatgcccaccaacatgctgagctacggcggcagcgtgctgagccagttcagcccccacttctacaacagcgtgaacaccagcggcgtgctgtaccccagagagggcaccgaggtgtag

SEQ ID NO: 81942 - DNA, 1266 bp, Artificial Sequence
  Description of Artificial Sequence: Synthetic coding sequence
atggccgagagctggctgagactgagcggcgccggccccgccgaggaggccggccccgagggcggcctggaggagcccgacgccctggacgacagcctgaccagcctgcagtggctgcaggagttcagcatcctgaacgccaaggcccccgccctgccccccggcggcaccgacccccacggctaccaccaggtgcccggcagcgccgcccccggcagccccctggccgccgaccccgcctgcctgggccagccccacacccccggcaagcccaccagcagctgcaccagcagaagcgccccccccggcctgcaggcccccccccccgacgacgtggactacgccaccaacccccacgtgaagcccccctacagctacgccaccctgatctgcatggccatgcaggccagcaaggccaccaagatcaccctgagcgccatctacaagtggatcaccgacaacttctgctacttcagacacgccgaccccacctggcagaacagcatcagacacaacctgagcctgaacaagtgcttcatcaaggtgcccagagagaaggacgagcccggcaagggcggcttctggagaatcgacccccagtacgccgagagactgctgagcggcgccttcaagaagagaagactgccccccgtgcacatccaccccgccttcgccagacaggccgcccaggagcccagcgccgtgcccagagccggccccctgaccgtgaacaccgaggcccagcagctgctgagagagttcgaggaggccaccggcgaggccggctggggcgccggcgagggcagactgggccacaagagaaagcagcccctgcccaagagagtggccaaggtgcccagaccccccagcaccctgctgcccacccccgaggagcagggcgagctggagcccctgaagggcaacttcgactgggaggccatcttcgacgccggcaccctgggcggcgagctgggcgccctggaggccctggagctgagcccccccctgagccccgccagccacgtggacgtggacctgaccatccacggcagacacatcgactgccccgccacctggggccccagcgtggagcaggccgccgacagcctggacttcgacgagaccttcctggccaccagcttcctgcagcacccctgggacgagagcggcagcggctgcctgccccccgagcccctgttcgaggccggcgacgccaccctggccagcgacctgcaggactgggccagcgtgggcgccttcctgtag

SEQ ID NO: 81943 - DNA, 987 bp, Artificial Sequence
  Description of Artificial Sequence: Synthetic coding sequence
atggccgccgccgccgccgccctgagcggcgccggcaccccccccgccggcggcggcgccggcggcggcggcgccggcggcggcggcagcccccccggcggctgggccgtggccagactggagggcagagagttcgagtacctgatgaagaagagaagcgtgaccatcggcagaaacagcagccagggcagcgtggacgtgagcatgggccacagcagcttcatcagcagaagacacctggagatcttcaccccccccggcggcggcggccacggcggcgccgcccccgagctgccccccgcccagcccagacccgacgccggcggcgacttctacctgagatgcctgggcaagaacggcgtgttcgtggacggcgtgttccagagaagaggcgccccccccctgcagctgcccagagtgtgcaccttcagattccccagcaccaacatcaagatcaccttcaccgccctgagcagcgagaagagagagaagcaggaggccagcgagagccccgtgaaggccgtgcagccccacatcagccccctgaccatcaacatccccgacaccatggcccacctgatcagccccctgcccagccccaccggcaccatcagcgccgccaacagctgccccagcagccccagaggcgccggcagcagcggctacaaggtgggcagagtgatgcccagcgacctgaacctgatggccgacaacagccagcccgagaacgagaaggaggccagcggcggcgacagccccaaggacgacagcaagcccccctacagctacgcccagctgatcgtgcaggccatcaccatggcccccgacaagcagctgaccctgaacggcatctacacccacatcaccaagaactacccctactacagaaccgccgacaagggctggcagagaggcgagagcttcgcccacgtgggcaacaccagaatcagaatcggcctgcccgcccacaaggccccccagagatag

SEQ ID NO: 81944 - DNA, 1983 bp, Artificial Sequence
  Description of Artificial Sequence: Synthetic coding sequence
atggccgccgccgccgccgccctgagcggcgccggcaccccccccgccggcggcggcgccggcggcggcggcgccggcggcggcggcagcccccccggcggctgggccgtggccagactggagggcagagagttcgagtacctgatgaagaagagaagcgtgaccatcggcagaaacagcagccagggcagcgtggacgtgagcatgggccacagcagcttcatcagcagaagacacctggagatcttcaccccccccggcggcggcggccacggcggcgccgcccccgagctgccccccgcccagcccagacccgacgccggcggcgacttctacctgagatgcctgggcaagaacggcgtgttcgtggacggcgtgttccagagaagaggcgccccccccctgcagctgcccagagtgtgcaccttcagattccccagcaccaacatcaagatcaccttcaccgccctgagcagcgagaagagagagaagcaggaggccagcgagagccccgtgaaggccgtgcagccccacatcagccccctgaccatcaacatccccgacaccatggcccacctgatcagccccctgcccagccccaccggcaccatcagcgccgccaacagctgccccagcagccccagaggcgccggcagcagcggctacaaggtgggcagagtgatgcccagcgacctgaacctgatggccgacaacagccagcccgagaacgagaaggaggccagcggcggcgacagccccaaggacgacagcaagcccccctacagctacgcccagctgatcgtgcaggccatcaccatggcccccgacaagcagctgaccctgaacggcatctacacccacatcaccaagaactacccctactacagaaccgccgacaagggctggcagaacagcatcagacacaacctgagcctgaacagatacttcatcaaggtgcccagaagccaggaggagcccggcaagggcagcttctggagaatcgaccccgccagcgagagcaagctgatcgagcaggccttcagaaagagaagacccagaggcgtgccctgcttcagaacccccctgggccccctgagcagcagaagcgcccccgccagccccaaccacgccggcgtgctgagcgcccacagcagcggcgcccagacccccgagagcctgagcagagagggcagccccgcccccctggagcccgagcccggcgccgcccagcccaagctggccgtgatccaggaggccagattcgcccagagcgcccccggcagccccctgagcagccagcccgtgctgatcaccgtgcagagacagctgccccaggccatcaagcccgtgacctacaccgtggccacccccgtgaccaccagcaccagccagccccccgtggtgcagaccgtgcacgtggtgcaccagatccccgccgtgagcgtgaccagcgtggccggcctggcccccgccaacacctacaccgtgagcggccaggccgtggtgacccccgccgccgtgctggccccccccaaggccgaggcccaggagaacggcgaccacagagaggtgaaggtgaaggtggagcccatccccgccatcggccacgccaccctgggcaccgccagcagaatcatccagaccgcccagaccacccccgtgcagaccgtgaccatcgtgcagcaggcccccctgggccagcaccagctgcccatcaagaccgtgacccagaacggcacccacgtggccagcgtgcccaccgccgtgcacggccaggtgaacaacgccgccgccagccccctgcacatgctggccacccacgccagcgccagcgccagcctgcccaccaagagacacaacggcgaccagcccgagcagcccgagctgaagagaatcaagaccgaggacggcgagggcatcgtgatcgccctgagcgtggacaccccccccgccgccgtgagagagaagggcgtgcagaactag

SEQ ID NO: 81945 - DNA, 1833 bp, Artificial Sequence
  Description of Artificial Sequence: Synthetic coding sequence
atggccgccgccagaagagccctgggcgccggcacccccagagccagaggcagaggcagaggcgccggcggcggcggcagcagaagagccctgggcagaggcgcccccggcggccccagagtgagagtgagcgacgaggaggccctgggcgaccacagaccccagctggtggccggcctgggcggcagagagcacggccccctggagctgcacctgcccgccccccccagagacctgcacgcccccggcagaagaggccacggcggcgccgcccccgagctgccccccgcccagcccagacccgacgccggcggcgacttctacctgagatgcctgggcaagaacggcgtgttcgtggacggcgtgttccagagaagaggcgccccccccctgcagctgcccagagtgtgcaccttcagattccccagcaccaacatcaagatcaccttcaccgccctgagcagcgagaagagagagaagcaggaggccagcgagagccccgtgaaggccgtgcagccccacatcagccccctgaccatcaacatccccgacaccatggcccacctgatcagccccctgcccagccccaccggcaccatcagcgccgccaacagctgccccagcagccccagaggcgccggcagcagcggctacaaggtgggcagagtgatgcccagcgacctgaacctgatggccgacaacagccagcccgagaacgagaaggaggccagcggcggcgacagccccaaggacgacagcaagcccccctacagctacgcccagctgatcgtgcaggccatcaccatggcccccgacaagcagctgaccctgaacggcatctacacccacatcaccaagaactacccctactacagaaccgccgacaagggctggcagaacagcatcagacacaacctgagcctgaacagatacttcatcaaggtgcccagaagccaggaggagcccggcaagggcagcttctggagaatcgaccccgccagcgagagcaagctgatcgagcaggccttcagaaagagaagacccagaggcgtgccctgcttcagaacccccctgggccccctgagcagcagaagcgcccccgccagccccaaccacgccggcgtgctgagcgcccacagcagcggcgcccagacccccgagagcctgagcagagagggcagccccgcccccctggagcccgagcccggcgccgcccagcccaagctggccgtgatccaggaggccagattcgcccagagcgcccccggcagccccctgagcagccagcccgtgctgatcaccgtgcagagacagctgccccaggccatcaagcccgtgacctacaccgtggccacccccgtgaccaccagcaccagccagccccccgtggtgcagaccgtgcacgtggtgcaccagatccccgccgtgagcgtgaccagcgtggccggcctggcccccgccaacacctacaccgtgagcggccaggccgtggtgacccccgccgccgtgctggccccccccaaggccgaggcccaggagaacggcgaccacagagaggtgaaggtgaaggtggagcccatccccgccatcggccacgccaccctgggcaccgccagcagaatcatccagaccgcccagaccacccccgtgcagaccgtgaccatcgtgcagcaggcccccctgggccagcaccagctgcccatcaagaccgtgacccagaacggcacccacgtggccagcgtgcccaccgccgtgcacggccaggtgaacaacggccccctgggcctgagaagacccccctgcgccagcagcgactggagctgcctgagctag

SEQ ID NO: 81946 - DNA, 1038 bp, Artificial Sequence
  Description of Artificial Sequence: Synthetic coding sequence
atgagccacctgttcgaccccagactgcccgccctggccgccagccccatgctgtacctgtacggccccgagagacccggcctgcccctggccttcgcccccgccgccgccctggccgccagcggcagagccgagaccccccagaagcccccctacagctacatcgccctgatcgccatggccatccaggacgcccccgagcagagagtgaccctgaacggcatctaccagttcatcatggacagattccccttctaccacgacaacagacagggctggcagaacagcatcagacacaacctgagcctgaacgactgcttcgtgaaggtgcccagagagaagggcagacccggcaagggcagctactggaccctggaccccagatgcctggacatgttcgagaacggcaactacagaagaagaaagagaaagcccaagcccggccccggcgcccccgaggccaagagacccagagccgagacccaccagagaagcgccgaggcccagcccgaggccggcagcggcgccggcggcagcggccccgccatcagcagactgcaggccgcccccgccggccccagccccctgctggacggccccagcccccccgcccccctgcactggcccggcaccgccagccccaacgaggacgccggcgacgccgcccagggcgccgccgccgtggccgtgggccaggccgccagaaccggcgacggccccggcagccccctgagacccgccagcagaagcagccccaagagcagcgacaagagcaagagcttcagcatcgacagcatcctggccggcaagcagggccagaagccccccagcggcgacgagctgctgggcggcgccaagcccggccccggcggcagactgggcgccagcctgctggccgccagcagcagcctgagaccccccttcaacgccagcctgatgctggacccccacgtgcagggcggcttctaccagctgggcatccccttcctgagctacttccccctgcaggtgcccgacaccgtgctgcacttccagtag

SEQ ID NO: 81947 - DNA, 1131 bp, Artificial Sequence
  Description of Artificial Sequence: Synthetic coding sequence
atgatggccagctaccccgagcccgaggacgccgccggcgccctgctggcccccgagaccggcagaaccgtgaaggagcccgagggccccccccccagccccggcaagggcggcggcggcggcggcggcaccgcccccgagaagcccgaccccgcccagaagcccccctacagctacgtggccctgatcgccatggccatcagagagagcgccgagaagagactgaccctgagcggcatctaccagtacatcatcgccaagttccccttctacgagaagaacaagaagggctggcagaacagcatcagacacaacctgagcctgaacgagtgcttcatcaaggtgcccagagagggcggcggcgagagaaagggcaactactggaccctggaccccgcctgcgaggacatgttcgagaagggcaactacagaagaagaagaagaatgaagagacccttcagacccccccccgcccacttccagcccggcaagggcctgttcggcgccggcggcgccgccggcggctgcggcgtggccggcgccggcgccgacggctacggctacctggccccccccaagtacctgcagagcggcttcctgaacaacagctggcccctgccccagccccccagccccatgccctacgccagctgccagatggccgccgccgccgccgccgccgccgccgccgccgccgccgccggccccggcagccccggcgccgccgccgtggtgaagggcctggccggccccgccgccagctacggcccctacaccagagtgcagagcatggccctgccccccggcgtggtgaacagctacaacggcctgggcggcccccccgccgccccccccccccccccccacccccacccccacccccacgcccaccacctgcacgccgccgccgcccccccccccgcccccccccaccacggcgccgccgcccccccccccggccagctgagccccgccagccccgccaccgccgccccccccgcccccgcccccaccagcgcccccggcctgcagttcgcctgcgccagacagcccgagctggccatgatgcactgcagctactgggaccacgacagcaagaccggcgccctgcacagcagactggacctgtag

SEQ ID NO: 81948 - DNA, 810 bp, Artificial Sequence
  Description of Artificial Sequence: Synthetic coding sequence
atgatggccagctaccccgagcccgaggacgccgccggcgccctgctggcccccgagaccggcagaaccgtgaaggagcccgagggccccccccccagccccggcaagggcggcggcggcggcggcggcaccgcccccgagaagcccgaccccgcccagaagcccccctacagctacgtggccctgatcgccatggccatcagagagagcgccgagaagagactgaccctgagcggcatctaccagtacatcatcgccaagttccccttctacgagaagaacaagaagggctggcagaacagcatcagacacaacctgagcctgaacgagtgcttcatcaaggtgcccagagagggcggcggcgagagaaagggcaactactggaccctggaccccgcctgcgaggacatgttcgagaagggcaactacagaagaagaagaagaatgaagagacccttcagacccccccccgcccacttccagcccggcaagggcctgttcggcgccggcggcgccgccggcggctgcggcgtggccggcgccggcgccgacggctacggctacctggccccccccaagtacctgcagagcggcttcctgaacaacagctggcccctgccccagccccccagccccatgccctacgccagctgccagatggccgccgccgccgccgccgccgccgccgccgccgccgccgccggccccggcagcctggccagacccctgtggagcagaggctggagagccagaccccccagaaccggcagaacccacgcctgcagagcctggagatgcccccccgcctag

SEQ ID NO: 81949 - DNA, 2406 bp, Artificial Sequence
  Description of Artificial Sequence: Synthetic coding sequence
atgaagaccagccccagaagacccctgatcctgaagagaagaagactgcccctgcccgtgcagaacgcccccagcgagaccagcgaggaggagcccaagagaagccccgcccagcaggagagcaaccaggccgaggccagcaaggaggtggccgagagcaacagctgcaagttccccgccggcatcaagatcatcaaccaccccaccatgcccaacacccaggtggtggccatccccaacaacgccaacatccacagcatcatcaccgccctgaccgccaagggcaaggagagcggcagcagcggccccaacaagttcatcctgatcagctgcggcggcgcccccacccagccccccggcctgagaccccagacccagaccagctacgacgccaagagaaccgaggtgaccctggagaccctgggccccaagcccgccgccagagacgtgaacctgcccagaccccccggcgccctgtgcgagcagaagagagagacctgcgccgacggcgaggccgccggctgcaccatcaacaacagcctgagcaacatccagtggctgagaaagatgagcagcgacggcctgggcagcagaagcatcaagcaggagatggaggagaaggagaactgccacctggagcagagacaggtgaaggtggaggagcccagcagacccagcgccagctggcagaacagcgtgagcgagagacccccctacagctacatggccatgatccagttcgccatcaacagcaccgagagaaagagaatgaccctgaaggacatctacacctggatcgaggaccacttcccctacttcaagcacatcgccaagcccggctggaagaacagcatcagacacaacctgagcctgcacgacatgttcgtgagagagaccagcgccaacggcaaggtgagcttctggaccatccaccccagcgccaacagatacctgaccctggaccaggtgttcaagcccctggaccccggcagcccccagctgcccgagcacctggagagccagcagaagagacccaaccccgagctgagaagaaacatgaccatcaagaccgagctgcccctgggcgccagaagaaagatgaagcccctgctgcccagagtgagcagctacctggtgcccatccagttccccgtgaaccagagcctggtgctgcagcccagcgtgaaggtgcccctgcccctggccgccagcctgatgagcagcgagctggccagacacagcaagagagtgagaatcgcccccaaggtgttcggcgagcaggtggtgttcggctacatgagcaagttcttcagcggcgacctgagagacttcggcacccccatcaccagcctgttcaacttcatcttcctgtgcctgagcgtgctgctggccgaggagggcatcgcccccctgagcagcgccggccccggcaaggaggagaagctgctgttcggcgagggcttcagccccctgctgcccgtgcagaccatcaaggaggaggagatccagcccggcgaggagatgccccacctggccagacccatcaaggtggagagcccccccctggaggagtggcccagccccgcccccagcttcaaggaggagagcagccacagctgggaggacagcagccagagccccacccccagacccaagaagagctacagcggcctgagaagccccaccagatgcgtgagcgagatgctggtgatccagcacagagagagaagagagagaagcagaagcagaagaaagcagcacctgctgcccccctgcgtggacgagcccgagctgctgttcagcgagggccccagcaccagcagatgggccgccgagctgcccttccccgccgacagcagcgaccccgccagccagctgagctacagccaggaggtgggcggccccttcaagacccccatcaaggagaccctgcccatcagcagcacccccagcaagagcgtgctgcccagaacccccgagagctggagactgaccccccccgccaaggtgggcggcctggacttcagccccgtgcagaccagccagggcgccagcgaccccctgcccgaccccctgggcctgatggacctgagcaccacccccctgcagagcgccccccccctggagagcccccagagactgctgagcagcgagcccctggacctgatcagcgtgcccttcggcaacagcagccccagcgacatcgacgtgcccaagcccggcagccccgagccccaggtgagcggcctggccgccaacagaagcctgaccgagggcctggtgctggacaccatgaacgacagcctgagcaagatcctgctggacatcagcttccccggcctggacgaggaccccctgggccccgacaacatcaactggagccagttcatccccgagctgcagtag

SEQ ID NO: 81950 - DNA, 2292 bp, Artificial Sequence
  Description of Artificial Sequence: Synthetic coding sequence
atgaagaccagccccagaagacccctgatcctgaagagaagaagactgcccctgcccgtgcagaacgcccccagcgagaccagcgaggaggagcccaagagaagccccgcccagcaggagagcaaccaggccgaggccagcaaggaggtggccgagagcaacagctgcaagttccccgccggcatcaagatcatcaaccaccccaccatgcccaacacccaggtggtggccatccccaacaacgccaacatccacagcatcatcaccgccctgaccgccaagggcaaggagagcggcagcagcggccccaacaagttcatcctgatcagctgcggcggcgcccccacccagccccccggcctgagaccccagacccagaccagctacgacgccaagagaaccgaggtgaccctggagaccctgggccccaagcccgccgccagagacgtgaacctgcccagaccccccggcgccctgtgcgagcagaagagagagacctgcgccgacggcgaggccgccggctgcaccatcaacaacagcctgagcaacatccagtggctgagaaagatgagcagcgacggcctgggcagcagaagcatcaagcaggagatggaggagaaggagaactgccacctggagcagagacaggtgaaggtggaggagcccagcagacccagcgccagctggcagaacagcgtgagcgagagacccccctacagctacatggccatgatccagttcgccatcaacagcaccgagagaaagagaatgaccctgaaggacatctacacctggatcgaggaccacttcccctacttcaagcacatcgccaagcccggctggaagaacagcatcagacacaacctgagcctgcacgacatgttcgtgagagagaccagcgccaacggcaaggtgagcttctggaccatccaccccagcgccaacagatacctgaccctggaccaggtgttcaagcccctggaccccggcagcccccagctgcccgagcacctggagagccagcagaagagacccaaccccgagctgagaagaaacatgaccatcaagaccgagctgcccctgggcgccagaagaaagatgaagcccctgctgcccagagtgagcagctacctggtgcccatccagttccccgtgaaccagagcctggtgctgcagcccagcgtgaaggtgcccctgcccctggccgccagcctgatgagcagcgagctggccagacacagcaagagagtgagaatcgcccccaaggtgctgctggccgaggagggcatcgcccccctgagcagcgccggccccggcaaggaggagaagctgctgttcggcgagggcttcagccccctgctgcccgtgcagaccatcaaggaggaggagatccagcccggcgaggagatgccccacctggccagacccatcaaggtggagagcccccccctggaggagtggcccagccccgcccccagcttcaaggaggagagcagccacagctgggaggacagcagccagagccccacccccagacccaagaagagctacagcggcctgagaagccccaccagatgcgtgagcgagatgctggtgatccagcacagagagagaagagagagaagcagaagcagaagaaagcagcacctgctgcccccctgcgtggacgagcccgagctgctgttcagcgagggccccagcaccagcagatgggccgccgagctgcccttccccgccgacagcagcgaccccgccagccagctgagctacagccaggaggtgggcggccccttcaagacccccatcaaggagaccctgcccatcagcagcacccccagcaagagcgtgctgcccagaacccccgagagctggagactgaccccccccgccaaggtgggcggcctggacttcagccccgtgcagaccagccagggcgccagcgaccccctgcccgaccccctgggcctgatggacctgagcaccacccccctgcagagcgccccccccctggagagcccccagagactgctgagcagcgagcccctggacctgatcagcgtgcccttcggcaacagcagccccagcgacatcgacgtgcccaagcccggcagccccgagccccaggtgagcggcctggccgccaacagaagcctgaccgagggcctggtgctggacaccatgaacgacagcctgagcaagatcctgctggacatcagcttccccggcctggacgaggaccccctgggccccgacaacatcaactggagccagttcatccccgagctgcagtag

SEQ ID NO: 81951 - DNA, 2247 bp, Artificial Sequence
  Description of Artificial Sequence: Synthetic coding sequence
atgaagaccagccccagaagacccctgatcctgaagagaagaagactgcccctgcccgtgcagaacgcccccagcgagaccagcgaggaggagcccaagagaagccccgcccagcaggagagcaaccaggccgaggccagcaaggaggtggccgagagcaacagctgcaagttccccgccggcatcaagatcatcaaccaccccaccatgcccaacacccaggtggtggccatccccaacaacgccaacatccacagcatcatcaccgccctgaccgccaagggcaaggagagcggcagcagcggccccaacaagttcatcctgatcagctgcggcggcgcccccacccagccccccggcctgagaccccagacccagaccagctacgacgccaagagaaccgaggtgaccctggagaccctgggccccaagcccgccgccagagacgtgaacctgcccagaccccccggcgccctgtgcgagcagaagagagagacctgcgccgacggcgaggccgccggctgcaccatcaacaacagcctgagcaacatccagtggctgagaaagatgagcagcgacggcctgggcagcagaagcatcaagcaggagatggaggagaaggagaactgccacctggagcagagacaggtgaaggtggaggagcccagcagacccagcgccagctggcagaacagcgtgagcgagagacccccctacagctacatggccatgatccagttcgccatcaacagcaccgagagaaagagaatgaccctgaaggacatctacacctggatcgaggaccacttcccctacttcaagcacatcgccaagcccggctggaagaacagcatcagacacaacctgagcctgcacgacatgttcgtgagagagaccagcgccaacggcaaggtgagcttctggaccatccaccccagcgccaacagatacctgaccctggaccaggtgttcaagcagcagaagagacccaaccccgagctgagaagaaacatgaccatcaagaccgagctgcccctgggcgccagaagaaagatgaagcccctgctgcccagagtgagcagctacctggtgcccatccagttccccgtgaaccagagcctggtgctgcagcccagcgtgaaggtgcccctgcccctggccgccagcctgatgagcagcgagctggccagacacagcaagagagtgagaatcgcccccaaggtgctgctggccgaggagggcatcgcccccctgagcagcgccggccccggcaaggaggagaagctgctgttcggcgagggcttcagccccctgctgcccgtgcagaccatcaaggaggaggagatccagcccggcgaggagatgccccacctggccagacccatcaaggtggagagcccccccctggaggagtggcccagccccgcccccagcttcaaggaggagagcagccacagctgggaggacagcagccagagccccacccccagacccaagaagagctacagcggcctgagaagccccaccagatgcgtgagcgagatgctggtgatccagcacagagagagaagagagagaagcagaagcagaagaaagcagcacctgctgcccccctgcgtggacgagcccgagctgctgttcagcgagggccccagcaccagcagatgggccgccgagctgcccttccccgccgacagcagcgaccccgccagccagctgagctacagccaggaggtgggcggccccttcaagacccccatcaaggagaccctgcccatcagcagcacccccagcaagagcgtgctgcccagaacccccgagagctggagactgaccccccccgccaaggtgggcggcctggacttcagccccgtgcagaccagccagggcgccagcgaccccctgcccgaccccctgggcctgatggacctgagcaccacccccctgcagagcgccccccccctggagagcccccagagactgctgagcagcgagcccctggacctgatcagcgtgcccttcggcaacagcagccccagcgacatcgacgtgcccaagcccggcagccccgagccccaggtgagcggcctggccgccaacagaagcctgaccgagggcctggtgctggacaccatgaacgacagcctgagcaagatcctgctggacatcagcttccccggcctggacgaggaccccctgggccccgacaacatcaactggagccagttcatccccgagctgcagtag

SEQ ID NO: 81952 - DNA, 531 bp, Artificial Sequence
  Description of Artificial Sequence: Synthetic coding sequence
atgggcgcccccgccaccagaagatgcgtggagtggctgctgggcctgtacttcctgagccacatccccatcaccctgttcatggacctgcaggccgtgctgcccagagagctgtaccccgtggagttcagaaacctgctgaagtggtacgccaaggagttcaaggaccccctgctgcaggagccccccgcctggttcaagagcttcctgttctgcgagctggtgttccagctgcccttcttccccatcgccacctacgccttcctgaagggcagctgcaagtggatcagaacccccgccatcatctacagcgtgcacaccatgaccaccctgatccccatcctgagcaccttcctgttcgaggacttcagcaaggccagcggcttcaagggccagagacccgagaccctgcacgagagactgaccctggtgagcgtgtacgccccctacctgctgatccccttcatcctgctgatcttcatgctgagaagcccctactacaagtacgaggagaagagaaagaagaagtag

SEQ ID NO: 81953 - DNA, 1473 bp, Artificial Sequence
  Description of Artificial Sequence: Synthetic coding sequence
atgggccccgtgatgccccccagcaagaagcccgagagcagcggcatcagcgtgagcagcggcctgagccagtgctacggcggcagcggcttcagcaaggccctgcaggaggacgacgacctggacttcagcctgcccgacatcagactggaggagggcgccatggaggacgaggagctgaccaacctgaactggctgcacgagagcaagaacctgctgaagagcttcggcgagagcgtgctgagaagcgtgagccccgtgcaggacctggacgacgacaccccccccagccccgcccacagcgacatgccctacgacgccagacagaaccccaactgcaagcccccctacagcttcagctgcctgatcttcatggccatcgaggacagccccaccaagagactgcccgtgaaggacatctacaactggatcctggagcacttcccctacttcgccaacgcccccaccggctggaagaacagcgtgagacacaacctgagcctgaacaagtgcttcaagaaggtggacaaggagagaagccagagcatcggcaagggcagcctgtggtgcatcgaccccgagtacagacagaacctgatccaggccctgaagaagaccccctaccacccccacccccacgtgttcaacaccccccccacctgcccccaggcctaccagagcaccagcggcccccccatctggcccggcagcaccttcttcaagagaaacggcgccctgctgcaggaccccgacatcgacgccgccagcgccatgatgctgctgaacaccccccccgagatccaggccggcttcccccccggcgtgatccagaacggcgccagagtgctgagcagaggcctgttccccggcgtgagacccctgcccatcacccccatcggcgtgaccgccgccatgagaaacggcatcaccagctgcagaatgagaaccgagagcgagcccagctgcggcagccccgtggtgagcggcgaccccaaggaggaccacaactacagcagcgccaagagcagcaacgccagaagcaccagccccaccagcgacagcatcagcagcagcagcagcagcgccgacgaccactacgagttcgccaccaagggcagccaggagggcagcgagggcagcgagggcagcttcagaagccacgagagccccagcgacaccgaggaggacgacagaaagcacagccagaaggagcccaaggacagcctgggcgacagcggctacgccagccagcacaagaagagacagcacttcgccaaggccagaaaggtgcccagcgacaccctgcccctgaagaagagaagaaccgagaagccccccgagagcgacgacgaggagatgaaggaggccgccggcagcctgctgcacctggccggcatcagaagctgcctgaacaacatcaccaacagaaccgccaagggccagaaggagcagaaggagaccaccaagaactag

SEQ ID NO: 81954 - DNA, 1473 bp, Artificial Sequence; identical to SEQ ID NO: 81953
  Description of Artificial Sequence: Synthetic coding sequence

SEQ ID NO: 81955 - DNA, 165 bp, Artificial Sequence
  Description of Artificial Sequence: Synthetic coding sequence
atgggccccgtgatgccccccagcaagaagcccgagagcagcggcatcagcgtgagcagcggcctgagccagtgctacggcggcagcggcttcagcaaggccctgcaggaggacgacgacctggacttcagcctgcccgacatcagactggaggagggcgcctag

SEQ ID NO: 81956 - DNA, 282 bp, Artificial Sequence
  Description of Artificial Sequence: Synthetic coding sequence
atgggccccgtgatgccccccagcaagaagcccgagagcagcggcatcagcgtgagcagcggcctgagccagtgctacggcggcagcggcttcagcaaggccctgcaggaggacgacgacctggacttcagcctgcccgacatcagactggaggagggcgccatggaggacgaggagctgaccaacctgaactggctgcacgagagcaagaacctgctgaagagcttcggcgagagcgtgctgagaagcgtgagccccgtgcaggacctggacgacgactag

SEQ ID NO: 81957 - DNA, 1407 bp, Artificial Sequence
  Description of Artificial Sequence: Synthetic coding sequence
atgggccccgtgatgccccccagcaagaagcccgagagcagcggcatcagcgtgagcagcggcctgagccagtgctacggcggcagcggcttcagcaaggccctgcaggaggacgacgacctggacttcagcctgcccgacatcagactggaggagggcgccatggaggacgaggagctgaccaacctgaactggctgcacgagagcaagaacctgctgaagagcttcggcgagagcgtgctgagaagcgtgagccccgtgcaggacctggacgacgacaccccccccagccccgcccacagcgacatgccctacgacgccagacagaaccccaactgcaagcccccctacagcttcagctgcctgatcttcatggccatcgaggacagccccaccaagagactgcccgtgaaggacatctacaactggatcctggagcacttcccctacttcgccaacgcccccaccggctggaagaacagcgtgagacacaacctgagcctgaacaagtgcttcaagaaggtggacaaggagagaagccagagcatcggcaagggcagcctgtggtgcatcgaccccgagtacagacagaacctgatccaggccctgaagaagaccccctaccacccccacccccacgtgttcaacaccccccccacctgcccccaggcctaccagagcaccagcggcccccccatctggcccggcagcaccttcttcaagagaaacggcgccctgctgcaggtgccccccggcgtgatccagaacggcgccagagtgctgagcagaggcctgttccccggcgtgagacccctgcccatcacccccatcggcgtgaccgccgccatgagaaacggcatcaccagctgcagaatgagaaccgagagcgagcccagctgcggcagccccgtggtgagcggcgaccccaaggaggaccacaactacagcagcgccaagagcagcaacgccagaagcaccagccccaccagcgacagcatcagcagcagcagcagcagcgccgacgaccactacgagttcgccaccaagggcagccaggagggcagcgagggcagcgagggcagcttcagaagccacgagagccccagcgacaccgaggaggacgacagaaagcacagccagaaggagcccaaggacagcctgggcgacagcggctacgccagccagcacaagaagagacagcacttcgccaaggccagaaaggtgcccagcgacaccctgcccctgaagaagagaagaaccgagaagccccccgagagcgacgacgaggagatgaaggaggccgccggcagcctgctgcacctggccggcatcagaagctgcctgaacaacatcaccaacagaaccgccaagggccagaaggagcagaaggagaccaccaagaactag

SEQ ID NO: 81958 - DNA, 627 bp, Artificial Sequence
  Description of Artificial Sequence: Synthetic coding sequence
atgggccccgtgatgccccccagcaagaagcccgagagcagcggcatcagcgtgagcagcggcctgagccagtgctacggcggcagcggcttcagcaaggccctgcaggaggacgacgacctggacttcagcctgcccgacatcagactggaggagggcgccatggaggacgaggagctgaccaacctgaactggctgcacgagagcaagaacctgctgaagagcttcggcgagagcgtgctgagaagcgtgagccccgtgcaggacctggacgacgacaccccccccagccccgcccacagcgacatgccctacgacgccagacagaaccccaactgcaagcccccctacagcttcagctgcctgatcttcatggccatcgaggacagccccaccaagagactgcccgtgaaggacatctacaactggatcctggagcacttcccctacttcgccaacgcccccaccggctggaagaacagcgtgagacacaacctgagcctgaacaagtgcttcaagaaggtggacaaggagagaagccagagcatcggcaagggcagcctgtggtgcatcgaccccgagtacagacagaacctgatccaggccctgaagaagaccccctactag

SEQ ID NO: 81959 - DNA, 1407 bp, Artificial Sequence; identical to SEQ ID NO: 81957
  Description of Artificial Sequence: Synthetic coding sequence

SEQ ID NO: 81960 - DNA, 777 bp, Artificial Sequence
  Description of Artificial Sequence: Synthetic coding sequence
atgatcgagagcgacaccagcagcatcatgagcggcatcatcagaaacagcggccagaaccaccaccccagcccccaggagtacagactgctggccaccaccagcgacgacgacctgcccggcgacctgcagagcctgagctggctgaccgccgtggacgtgcccagactgcagcagatggccagcggcagagtggacctgggcggcccctgcgtgccccacccccaccccggcgccctggccggcgtggccgacctgcacgtgggcgccacccccagccccctgctgcacggccccgccggcatggcccccagaggcatgcccggcctgggccccatcaccggccacagagacagccagatgagccagttccccgtgggcggccagcccagcagcggcctgcaggaccccccccacctgtacagccccgccacccagccccagttccccctgccccccggcgcccagcagctgagcgacagacacggccccgaggagcagcaggacagacagcccgcctgcgagagagacctgcagctgcacgagggcgccctgcccctgctgcaggacggccccagaagagtggaggagctgggcgccgcccagcccgtgagcgagcaggtgctgagagagggcggcgagcaggacgagagactgctgccccagggcctgcccgtgggcagcgagcccggcccccacagacaggacggcggcggcgacgcccaggtggaggaggagggccccggctgccacccccccgagtacggccagccctag

SEQ ID NO: 81961 - DNA, 1554 bp, Artificial Sequence
  Description of Artificial Sequence: Synthetic coding sequence
atgatcgagagcgacaccagcagcatcatgagcggcatcatcagaaacagcggccagaaccaccaccccagcccccaggagtacagactgctggccaccaccagcgacgacgacctgcccggcgacctgcagagcctgagctggctgaccgccgtggacgtgcccagactgcagcagatggccagcggcagagtggacctgggcggcccctgcgtgccccacccccaccccggcgccctggccggcgtggccgacctgcacgtgggcgccacccccagccccctgctgcacggccccgccggcatggcccccagaggcatgcccggcctgggccccatcaccggccacagagacagcatgagccagttccccgtgggcggccagcccagcagcggcctgcaggaccccccccacctgtacagccccgccacccagccccagttccccctgccccccggcgcccagcagtgcccccccgtgggcctgtacggcccccccttcggcgtgagacccccctacccccagccccacgtggccgtgcacagcagccaggagctgcaccccaagcactaccccaagcccatctacagctacagctgcctgatcgccatggccctgaagaacagcaagaccggcagcctgcccgtgagcgagatctacagcttcatgaaggagcacttcccctacttcaagaccgcccccgacggctggaagaacagcgtgagacacaacctgagcctgaacaagtgcttcgagaaggtggagaacaagatgagcggcagcagcagaaagggctgcctgtgggccctgaacctggccagaatcgacaagatggaggaggagatgcacaagtggaagagaaaggacctggccgccatccacagaagcatggccaaccccgaggagctggacaagctgatcagcgacagacccgagagctgcagaagacccggcaagcccggcgagcccgaggcccccgtgctgacccacgccaccaccgtggccgtggcccacggctgcctggccgtgagccagctgcccccccagcccctgatgaccctgagcctgcagagcgtgcccctgcaccaccaggtgcagccccaggcccacctggcccccgacagccccgcccccgcccagaccccccccctgcacgccctgcccgacctgagccccagccccctgccccaccccgccatgggcagagcccccgtggacttcatcaacatcagcaccgacatgaacaccgaggtggacgccctggaccccagcatcatggacttcgccctgcagggcaacctgtgggaggagatgaaggacgagggcttcagcctggacaccctgggcgccttcgccgacagccccctgggctgcgacctgggcgccagcggcctgacccccgccagcggcggcagcgaccagagcttccccgacctgcaggtgaccggcctgtacaccgcctacagcacccccgacagcgtggccgccagcggcaccagcagcagcagccagtacctgggcgcccagggcaacaagcccatcgccctgctgtag

SEQ ID NO: 81962 - DNA, 1014 bp, Artificial Sequence
  Description of Artificial Sequence: Synthetic coding sequence
atgcccggcctgccctgccccgccctgccctgccccgcccccccccccgcccccagctgcctgatcgccatggccctgaagaacagcaagaccggcagcctgcccgtgagcgagatctacagcttcatgaaggagcacttcccctacttcaagaccgcccccgacggctggaagaacagcgtgagacacaacctgagcctgaacaagtgcttcgagaaggtggagaacaagatgagcggcagcagcagaaagggctgcctgtgggccctgaacctggccagaatcgacaagatggaggaggagatgcacaagtggaagagaaaggacctggccgccatccacagaagcatggccaaccccgaggagctggacaagctgatcagcgacagacccgagagctgcagaagacccggcaagcccggcgagcccgaggcccccgtgctgacccacgccaccaccgtggccgtggcccacggctgcctggccgtgagccagctgcccccccagcccctgatgaccctgagcctgcagagcgtgcccctgcaccaccaggtgcagccccaggcccacctggcccccgacagccccgcccccgcccagaccccccccctgcacgccctgcccgacctgagccccagccccctgccccaccccgccatgggcagagcccccgtggacttcatcaacatcagcaccgacatgaacaccgaggtggacgccctggaccccagcatcatggacttcgccctgcagggcaacctgtgggaggagatgaaggacgagggcttcagcctggacaccctgggcgccttcgccgacagccccctgggctgcgacctgggcgccagcggcctgacccccgccagcggcggcagcgaccagagcttccccgacctgcaggtgaccggcctgtacaccgcctacagcacccccgacagcgtggccgccagcggcaccagcagcagcagccagtacctgggcgcccagggcaacaagcccatcgccctgctgtag

SEQ ID NO: 81963 - DNA, 1680 bp, Artificial Sequence
  Description of Artificial Sequence: Synthetic coding sequence
atggccgccaagctgagagcccaccaggtggacgtggaccccgacttcgccccccagagcagacccagaagctgcacctggcccctgccccagcccgacctggccggcgacgaggacggcgccctgggcgccggcgtggccgagggcgccgaggactgcggccccgagagaagagccaccgcccccgccatggcccccgccccccccctgggcgccgaggtgggccccctgagaaaggccaagagcagcagaagaaacgcctggggcaacctgagctacgccgacctgatcaccaaggccatcgagagcgcccccgacaagagactgaccctgagccagatctacgactggatggtgagatacgtgccctacttcaaggacaagggcgacagcaacagcagcgccggctggaagaacagcatcagacacaacctgagcctgcacaccagattcatcagagtgcagaacgagggcaccggcaagagcagctggtggatgctgaaccccgagggcggcaagaccggcaagacccccagaagaagagccgtgagcatggacaacggcgccaagttcctgagaatcaagggcaaggccagcaagaagaagcagctgcaggcccccgagagaagccccgacgacagcagccccagcgcccccgcccccggccccgtgcccgccgccgccaagtgggccgccagccccgccagccacgccagcgacgactacgaggcctgggccgacttcagaggcggcggcagacccctgctgggcgaggccgccgagctggaggacgacgaggccctggaggccctggcccccagcagccccctgatgtaccccagccccgccagcgccctgagccccgccctgggcagcagatgccccggcgagctgcccagactggccgagctgggcggccccctgggcctgcacggcggcggcggcgccggcctgcccgagggcctgctggacggcgcccaggacgcctacggccccagagccagagcccaggccagacccggcgccggctgcgccggcggcgccggcgccggcggcagaagcagaagactgcccagacagagaggcggccccgtgagagccgccagagccctggcccagtgcctgagccccccccaccagccctacgacgccgccagaagaggcggcagaagaggccccggcaccgccggccccagaagaagactgagaggccccgccagaagaccccccgccggcagaagcgccggcgccctgagatgcagaagaagaagagccgccggcagaagagccagacccctgcccggcagacccggccccagacacgtgcagagagagcccagagtgagaagaggcgtgcaccacccccagagactgcacggccagagaagaaacggcctgcagctgagattcggccccgccagcgccgccgccggccccggcagaggccccgccccccagcccgagctgggcgccggcctgagagccgccagcagactgagagcccccagacccgtgcccagaggccccctgagcagccaccccgacagcagagtgcccgcccccgacagcagcagccccggcggcggccccagccccgccagagaccccagcagaagacccgccgccggcgagggcgagggcggcgccggcgccccccactgcagctgcccccacagctag

SEQ ID NO: 81964 - DNA, 2034 bp, Artificial Sequence
  Description of Artificial Sequence: Synthetic coding sequence
atgatgcaggagagcggcaccgagaccaagagcaacggcagcgccatccagaacggcagcggcggcagcaaccacctgctggagtgcggcggcctgagagagggcagaagcaacggcgagacccccgccgtggacatcggcgccgccgacctggcccacgcccagcagcagcagcagcaggccctgcaggtggccagacagctgctgctgcagcagcagcagcagcagcaggtgagcggcctgaagagccccaagagaaacgacaagcagcccgccctgcaggtgcccgtgagcgtggccatgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagagacagggcctgctgaccatccagcccggccagcccgccctgcccctgcagcccctggcccagggcatgatccccaccgagctgcagcagctgtggaaggaggtgaccagcgcccacaccgccgaggagaccaccggcaacaaccacagcagcctggacctgaccaccacctgcgtgagcagcagcgcccccagcaagaccagcctgatcatgaacccccacgccagcaccaacggccagctgagcgtgcacacccccaagagagagagcctgagccacgaggagcacccccacagccaccccctgtacggccacggcgtgtgcaagtggcccggctgcgaggccgtgtgcgaggacttccagagcttcctgaagcacctgaacagcgagcacgccctggacgacagaagcaccgcccagtgcagagtgcagatgcaggtggtgcagcagctggagctgcagctggccaaggacaaggagagactgcaggccatgatgacccacctgcacgtgaagagcaccgagcccaaggccgccccccagcccctgaacctggtgagcagcgtgaccctgagcaagagcgccagcgaggccagcccccagagcctgccccacacccccaccacccccaccgcccccctgacccccgtgacccagggccccagcgtgatcaccaccaccagcatgcacaccgtgggccccatcagaagaagatacagcgacaagtacaacgtgcccatcagcagcgccgacatcgcccagaaccaggagttctacaagaacgccgaggtgagaccccccttcacctacgccagcctgatcagacaggccatcctggagagccccgagaagcagctgaccctgaacgagatctacaactggttcaccagaatgttcgcctacttcagaagaaacgccgccacctggaagaacgccgtgagacacaacctgagcctgcacaagtgcttcgtgagagtggagaacgtgaagggcgccgtgtggaccgtggacgaggtggagttccagaagagaagaccccagaagatcagcggcaaccccagcctgatcaagaacatgcagagcagccacgcctactgcacccccctgaacgccgccctgcaggccagcatggccgagaacagcatccccctgtacaccaccgccagcatgggcaaccccaccctgggcaacctggccagcgccatcagagaggagctgaacggcgccatggagcacaccaacagcaacgagagcgacagcagccccggcagaagccccatgcaggccgtgcaccccgtgcacgtgaaggaggagcccctggaccccgaggaggccgagggccccctgagcctggtgaccaccgccaaccacagccccgacttcgaccacgacagagactacgaggacgagcccgtgaacgaggacatggagtag

SEQ ID NO: 81965 - DNA, 1077 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagagacagggcctgctgaccatccagcccggccagcccgccctgcccctgcagcccctggcccagggcatgatccccaccgagctgcagcagctgtggaaggaggtgaccagcgcccacaccgccgaggagaccaccggcaacaaccacagcagcctggacctgaccaccacctgcgtgagcagcagcgcccccagcaagaccagcctgatcatgaacccccacgccagcaccaacggccagctgagcgtgcacacccccaagagagagagcctgagccacgaggagcacccccacagccaccccctgtacggccacggcgtgtgcaagtggcccggctgcgaggccgtgtgcgaggacttccagagcttcctgaagcacctgaacagcgagcacgccctggacgacagaagcaccgcccagtgcagagtgcagatgcaggtggtgcagcagctggagctgcagctggccaaggacaaggagagactgcaggccatgatgacccacctgcacgtgaagagcaccgagcccaaggccgccccccagcccctgaacctggtgagcagcgtgaccctgagcaagagcgccagcgaggccagcccccagagcctgccccacacccccaccacccccaccccccccgacagcagacaccccagacccctgtgccaccacaaccaccagcacgcccacggcggcacccacccccaggccgtgctgagacagatccagagagcccacttcgtgagcagatactgcgccgagcccagaatcctgtag

SEQ ID NO: 81966 - DNA, 1509 bp, Artificial Sequence
  Description of Artificial Sequence: Synthetic coding sequence
atgatgcaggagagcggcaccgagaccaagagcaacggcagcgccatccagaacggcagcggcggcagcaaccacctgctggagtgcggcggcctgagagagggcagaagcaacggcgagacccccgccgtggacatcggcgccgccgacctggcccacgcccagcagcagcagcagcaggccctgcaggtggccagacagctgctgctgcagcagcagcagcagcagcaggtgagcggcctgaagagccccaagagaaacgacaagcagcccgccctgcaggtgcccgtgagcgtggccatgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagagacagggcctgctgaccatccagcccggccagcccgccctgcccctgcagcccctggcccagggcatgatccccaccgagctgcagcagctgtggaaggaggtgaccagcgcccacaccgccgaggagaccaccggcaacaaccacagcagcctggacctgaccaccacctgcgtgagcagcagcgcccccagcaagaccagcctgatcatgaacccccacgccagcaccaacggccagctgagcgtgcacacccccaagagagagagcctgagccacgaggagcacccccacagccaccccctgtacggccacggcgtgtgcaagtggcccggctgcgaggccgtgtgcgaggacttccagagcttcctgaagcacctgaacagcgagcacgccctggacgacagaagcaccgcccagtgcagagtgcagatgcaggtggtgcagcagctggagctgcagctggccaaggacaaggagagactgcaggccatgatgacccacctgcacgtgaagagcaccgagcccaaggccgccccccagcccctgaacctggtgagcagcgtgaccctgagcaagagcgccagcgaggccagcccccagagcctgccccacacccccaccacccccaccgcccccctgacccccgtgacccagggccccagcgtgatcaccaccaccagcatgcacaccgtgggccccatcagaagaagatacagcgacaagtacaacgtgcccatcagcagcgccgacatcgcccagaaccaggagttctacaagaacgccgaggtgagaccccccttcacctacgccagcctgatcagacaggccatcctggagagccccgagaagaagaagaaggagagacagaccctgggcaccatgcccatccacagcacccagcagtag

SEQ ID NO: 81967 - DNA, 1470 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggtgctgctgcagcagcagcaggccctgatgctgcagctgcagcagctgtggaaggaggtgaccagcgcccacaccgccgaggagaccaccggcaacaaccacagcagcctggacctgaccaccacctgcgtgagcagcagcgcccccagcaagaccagcctgatcatgaacccccacgccagcaccaacggccagctgagcgtgcacacccccaagagagagagcctgagccacgaggagcacccccacagccaccccctgtacggccacggcgtgtgcaagtggcccggctgcgaggccgtgtgcgaggacttccagagcttcctgaagcacctgaacagcgagcacgccctggacgacagaagcaccgcccagtgcagagtgcagatgcaggtggtgcagcagctggagctgcagctggccaaggacaaggagagactgcaggccatgatgacccacctgcacgtgaagagcaccgagcccaaggccgccccccagcccctgaacctggtgagcagcgtgaccctgagcaagagcgccagcgaggccagcccccagagcctgccccacacccccaccacccccaccgcccccctgacccccgtgacccagggccccagcgtgatcaccaccaccagcatgcacaccgtgggccccatcagaagaagatacagcgacaagtacaacgtgcccatcagcagcgccgacatcgcccagaaccaggagttctacaagaacgccgaggtgagaccccccttcacctacgccagcctgatcagacaggccatcctggagagccccgagaagcagctgaccctgaacgagatctacaactggttcaccagaatgttcgcctacttcagaagaaacgccgccacctggaagaacgccgtgagacacaacctgagcctgcacaagtgcttcgtgagagtggagaacgtgaagggcgccgtgtggaccgtggacgaggtggagttccagaagagaagaccccagaagatcagcggcaaccccagcctgatcaagaacatgcagagcagccacgcctactgcacccccctgaacgccgccctgcaggccagcatggccgagaacagcatccccctgtacaccaccgccagcatgggcaaccccaccctgggcaacctggccagcgccatcagagaggagctgaacggcgccatggagcacaccaacagcaacgagagcgacagcagccccggcagaagccccatgcaggccgtgcaccccgtgcacgtgaaggaggagcccctggaccccgaggaggccgagggccccctgagcctggtgaccaccgccaaccacagccccgacttcgaccacgacagagactacgaggacgagcccgtgaacgaggacatggagtag

SEQ ID NO: 81968 - DNA, 2034 bp, Artificial Sequence; identical to SEQ ID NO: 81964
  Description of Artificial Sequence: Synthetic coding sequence

SEQ ID NO: 81969 - DNA, 1806 bp, Artificial Sequence
  Description of Artificial Sequence: Synthetic coding sequence
atgatgcaggagagcggcaccgagaccaagagcaacggcagcgccatccagaacggcagcggcggcagcaaccacctgctggagtgcggcggcctgagagagggcagaagcaacggcgagacccccgccgtggacatcggcgccgccgacctggcccacgcccagcagcagcagcagcaggccctgcaggtggccagacagctgctgctgcagcagcagcagcagcagcaggtgagcggcctgaagagccccaagagaaacgacaagcagcccgccctgcagcagcagcaggtggccacccagcagctggccttccagcagcagctgctgcagatgcagcagctgcagcagcagcacctgctgagcctgcagagacagggcctgctgaccatccagcccggccagcccgccctgcccctgcagcccctggcccagggcatgatccccaccgagctgcagcagctgtggaaggaggtgaccagcgcccacaccgccgaggagaccaccggcaacaaccacagcagcctggacctgaccaccacctgcgtgagcagcagcgcccccagcaagaccagcctgatcatgaacccccacgccagcaccaacggccagctgagcgtgcacacccccaagagagagagcctgagccacgaggagcacccccacagccaccccctgtacggccacggcgtgtgcaagtggcccggctgcgaggccgtgtgcgaggacttccagagcttcctgaagcacctgaacagcgagcacgccctggacgacagaagcaccgcccagtgcagagtgcagatgcaggtggtgcagcagctggagctgcagctggccaaggacaaggagagactgcaggccatgatgacccacctgcacgtgaagagcaccgagcccaaggccgccccccagcccctgaacctggtgagcagcgtgaccctgagcaagagcgccagcgaggccagcccccagagcctgccccacacccccaccacccccaccgcccccctgacccccgtgacccagggccccagcgtgatcaccaccaccagcatgcacaccgtgggccccatcagaagaagatacagcgacaagtacaacgtgcccatcagcagcgccgacatcgcccagaaccaggagttctacaagaacgccgaggtgagaccccccttcacctacgccagcctgatcagacaggccatcctggagagccccgagaagcagctgaccctgaacgagatctacaactggttcaccagaatgttcgcctacttcagaagaaacgccgccacctggaagaacgccgtgagacacaacctgagcctgcacaagtgcttcgtgagagtggagaacgtgaagggcgccgtgtggaccgtggacgaggtggagttccagaagagaagaccccagaagatcagcggcaaccccagcctgatcaagaacatgcagagcagccacgcctactgcacccccctgaacgccgccctgcaggccagcatggccgagaacagcatccccctgtacaccaccgccagcatgggcaaccccaccctgggcaacctggccagcgccatcagagaggagctgaacggcgccatggagcacaccaacagcaacgagagcgacagcagccccggcagaagccccatgcaggccgtgcaccccgtgcacgtgaaggaggagcccctggaccccgaggaggccgagggccccctgagcctggtgaccaccgccaaccacagccccgacttcgaccacgacagagactacgaggacgagcccgtgaacgaggacatggagtag

SEQ ID NO: 81970 - DNA, 675 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagagacagggcctgctgaccatccagcccggccagcccgccctgcccctgcagcccctggcccagggcatgatccccaccgagctgcagcagctgtggaaggaggtgaccagcgcccacaccgccgaggagaccaccggcaacaaccacagcagcctggacctgaccaccacctgcgtgagcagcagcgcccccagcaagaccagcctgatcatgaacccccacgccagcaccaacggccagctgagcgtgcacacccccaagagagagagcctgagccacgaggagcacccccacagccaccccctgtacggccacggcgtgtgcaagtggcccggctgcgaggccgtgtgcgaggacttccagagcttcctgtag

SEQ ID NO: 81971 - DNA, 2040 bp, Artificial Sequence
  Description of Artificial Sequence: Synthetic coding sequence
atgttccagtgcgtgttcagcagcagcgtgctgcagccccacagcaccagctgcctgttcaagcacctgttctaccacagcgccacccccgccagccagaagcagcccgagcccatctacagcaagaagaccgagatccagagacagaccgtgagagcccccttcgccaagctgttcatcttcagcgccctgcaggtggccagacagctgctgctgcagcagcagcagcagcagcaggtgagcggcctgaagagccccaagagaaacgacaagcagcccgccctgcaggtgcccgtgagcgtggccatgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagagacagggcctgctgaccatccagcccggccagcccgccctgcccctgcagcccctggcccagggcatgatccccaccgagctgcagcagctgtggaaggaggtgaccagcgcccacaccgccgaggagaccaccggcaacaaccacagcagcctggacctgaccaccacctgcgtgagcagcagcgcccccagcaagaccagcctgatcatgaacccccacgccagcaccaacggccagctgagcgtgcacacccccaagagagagagcctgagccacgaggagcacccccacagccaccccctgtacggccacggcgtgtgcaagtggcccggctgcgaggccgtgtgcgaggacttccagagcttcctgaagcacctgaacagcgagcacgccctggacgacagaagcaccgcccagtgcagagtgcagatgcaggtggtgcagcagctggagctgcagctggccaaggacaaggagagactgcaggccatgatgacccacctgcacgtgaagagcaccgagcccaaggccgccccccagcccctgaacctggtgagcagcgtgaccctgagcaagagcgccagcgaggccagcccccagagcctgccccacacccccaccacccccaccgcccccctgacccccgtgacccagggccccagcgtgatcaccaccaccagcatgcacaccgtgggccccatcagaagaagatacagcgacaagtacaacgtgcccatcagcagcgccgacatcgcccagaaccaggagttctacaagaacgccgaggtgagaccccccttcacctacgccagcctgatcagacaggccatcctggagagccccgagaagcagctgaccctgaacgagatctacaactggttcaccagaatgttcgcctacttcagaagaaacgccgccacctggaagaacgccgtgagacacaacctgagcctgcacaagtgcttcgtgagagtggagaacgtgaagggcgccgtgtggaccgtggacgaggtggagttccagaagagaagaccccagaagatcagcggcaaccccagcctgatcaagaacatgcagagcagccacgcctactgcacccccctgaacgccgccctgcaggccagcatggccgagaacagcatccccctgtacaccaccgccagcatgggcaaccccaccctgggcaacctggccagcgccatcagagaggagctgaacggcgccatggagcacaccaacagcaacgagagcgacagcagccccggcagaagccccatgcaggccgtgcaccccgtgcacgtgaaggaggagcccctggaccccgaggaggccgagggccccctgagcctggtgaccaccgccaaccacagccccgacttcgaccacgacagagactacgaggacgagcccgtgaacgaggacatggagtag

SEQ ID NO: 81972 - DNA, 372 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggtgctgctgcagcagcagcaggccctgatgctgcagcagcagcagctgcaggagttctacaagaagcagcaggagcagctgcagctgcagctgctgcagcagcagcacgccggcaagcagcccaaggagcagcagcaggtggccacccagcagctggccttccagcagcagctgctgcagatgcagcagctgcagcagcagcacctgctgagcctgcagagacagggcctgctgaccatccagcccggccagcccgccctgcccctgcagcccctggcccagggcatgtag

SEQ ID NO: 81973 - DNA, 2034 bp, Artificial Sequence; identical to SEQ ID NO: 81964
  Description of Artificial Sequence: Synthetic coding sequence

SEQ ID NO: 81974 - DNA, 345 bp, Artificial Sequence
  Description of Artificial Sequence: Synthetic coding sequence
atgatgcaggagagcggcaccgagaccaagagcaacggcagcgccatccagaacggcagcggcggcagcaaccacctgctggagtgcggcggcctgagagagggcagaagcaacggcgagacccccgccgtggacatcggcgccgccgacctggcccacgcccagcagcagcagcagcagtggcacctgatcaaccaccagcccagcagaagccccagcagctggctgaagagactgatcagcagcccctgggagctggaggtgctgcaggtgcccctgtggggcgccgtggccgagaccaagatgagcggccccgtgtgccagcccaaccccagccccttctag

SEQ ID NO: 81975 - DNA, 669 bp, Artificial Sequence
  Description of Artificial Sequence: Synthetic coding sequence
atgatgcaggagagcgccaccgagaccatcagcaacagcagcatgaaccagaacggcatgagcaccctgagcagccagctggacgccggcagcagagacggcagaagcagcggcgacaccagcagcgaggtgagcaccgtggagctgctgcacctgcagcagcagcaggccctgcaggccgccagacagctgctgctgcagcagcagaccagcggcctgaagagccccaagagcagcgacaagcagagacccctgcaggtgcccgtgagcgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgtag

SEQ ID NO: 81976 - DNA, 2148 bp, Artificial Sequence
  Description of Artificial Sequence: Synthetic coding sequence
atgatgcaggagagcgccaccgagaccatcagcaacagcagcatgaaccagaacggcatgagcaccctgagcagccagctggacgccggcagcagagacggcagaagcagcggcgacaccagcagcgaggtgagcaccgtggagctgctgcacctgcagcagcagcaggccctgcaggccgccagacagctgctgctgcagcagcagaccagcggcctgaagagccccaagagcagcgacaagcagagacccctgcaggtgcccgtgagcgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgcagatgcagcagctgcagcagcagcagcacctgctgagcctgcagagacagggcctgatcagcatcccccccggccaggccgccctgcccgtgcagagcctgccccaggccggcctgagccccgccgagatccagcagctgtggaaggaggtgaccggcgtgcacagcatggaggacaacggcatcaagcacggcggcctggacctgaccaccaacaacagcagcagcaccaccagcagcaacaccagcaaggccagcccccccatcacccaccacagcatcgtgaacggccagagcagcgtgctgagcgccagaagagacagcagcagccacgaggagaccggcgccagccacaccctgtacggccacggcgtgtgcaagtggcccggctgcgagagcatctgcgaggacttcggccagttcctgaagcacctgaacaacgagcacgccctggacgacagaagcaccgcccagtgcagagtgcagatgcaggtggtgcagcagctggagatccagctgagcaaggagagagagagactgcaggccatgatgacccacctgcacatgagacccagcgagcccaagcccagccccaagcccctgaacctggtgagcagcgtgaccatgagcaagaacatgctggagaccagcccccagagcctgccccagacccccaccacccccaccgcccccgtgacccccatcacccagggccccagcgtgatcacccccgccagcgtgcccaacgtgggcgccatcagaagaagacacagcgacaagtacaacatccccatgagcagcgagatcgcccccaactacgagttctacaagaacgccgacgtgagaccccccttcacctacgccaccctgatcagacaggccatcatggagagcagcgacagacagctgaccctgaacgagatctacagctggttcaccagaaccttcgcctacttcagaagaaacgccgccacctggaagaacgccgtgagacacaacctgagcctgcacaagtgcttcgtgagagtggagaacgtgaagggcgccgtgtggaccgtggacgaggtggagtaccagaagagaagaagccagaagatcaccggcagccccaccctggtgaagaacatccccaccagcctgggctacggcgccgccctgaacgccagcctgcaggccgccctggccgagagcagcctgcccctgctgagcaaccccggcctgatcaacaacgccagcagcggcctgctgcaggccgtgcacgaggacctgaacggcagcctggaccacatcgacagcaacggcaacagcagccccggctgcagcccccagccccacatccacagcatccacgtgaaggaggagcccgtgatcgccgaggacgaggactgccccatgagcctggtgaccaccgccaaccacagccccgagctggaggacgacagagagatcgaggaggagcccctgagcgaggacctggagtag

SEQ ID NO: 81977 - DNA, 1299 bp, Artificial Sequence
  Description of Artificial Sequence: Synthetic coding sequence
atgatgcaggagagcgccaccgagaccatcagcaacagcagcatgaaccagaacggcatgagcaccctgagcagccagctggacgccggcagcagagacggcagaagcagcggcgacaccagcagcgaggtgagcaccgtggagctgctgcacctgcagcagcagcaggccctgcaggccgccagacagctgctgctgcagcagcagaccagcggcctgaagagccccaagagcagcgacaagcagagacccctgcaggtgcccgtgagcgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgcagatgcagcagctgcagcagcagcagcacctgctgagcctgcagagacagggcctgatcagcatcccccccggccaggccgccctgcccgtgcagagcctgccccaggccggcctgagccccgccgagatccagcagctgtggaaggaggtgaccggcgtgcacagcatggaggacaacggcatcaagcacggcggcctggacctgaccaccaacaacagcagcagcaccaccagcagcaacaccagcaaggccagcccccccatcacccaccacagcatcgtgaacggccagagcagcgtgctgagcgccagaagagacagcagcagccacgaggagaccggcgccagccacaccctgtacggccacggcgtgtgcaagtggcccggctgcgagagcatctgcgaggacttcggccagttcctgaagcacctgaacaacgagcacgccctggacgacagaagcaccgcccagtgcagagtgcagatgcaggtggtgcagcagctggagatccagctgagcaaggagagagagagactgcaggccatgatgacccacctgcacatgagacccagcgagcccaagcccagccccaagcccgtgagcgcctactgcttcatcaacagcaagtag

SEQ ID NO: 81978 - DNA, 1371 bp, Artificial Sequence
  Description of Artificial Sequence: Synthetic coding sequence
atgcaggagagcgccaccgagaccatcagcaacagcagcatgaaccagaacggcatgagcaccctgagcagccagctggacgccggcagcagagacggcagaagcagcggcgacaccagcagcgaggtgagcaccgtggagctgctgcacctgcagcagcagcaggccctgcaggccgccagacagctgctgctgcagcagcagaccagcggcctgaagagccccaagagcagcgacaagcagagacccctgcaggagctgctgcccgagaccaagctgtgcatctgcggccacagcagcggcgacggccacccccacaacaccttcgccgtgcccgtgagcgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgcagatgcagcagctgcagcagcagcagcacctgctgagcctgcagagacagggcctgatcagcatcccccccggccaggccgccctgcccgtgcagagcctgccccaggccggcctgagccccgccgagatccagcagctgtggaaggaggtgaccggcgtgcacagcatggaggacaacggcatcaagcacggcggcctggacctgaccaccaacaacagcagcagcaccaccagcagcaacaccagcaaggccagcccccccatcacccaccacagcatcgtgaacggccagagcagcgtgctgagcgccagaagagacagcagcagccacgaggagaccggcgccagccacaccctgtacggccacggcgtgtgcaagtggcccggctgcgagagcatctgcgaggacttcggccagttcctgaagcacctgaacaacgagcacgccctggacgacagaagcaccgcccagtgcagagtgcagatgcaggtggtgcagcagctggagatccagctgagcaaggagagagagagactgcaggccatgatgacccacctgcacatgagacccagcgagcccaagcccagccccaagcccgtgagcgcctactgcttcatcaacagcaagtag

SEQ ID NO: 81979 - DNA, 1872 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgcagatgcagcagctgcagcagcagcagcacctgctgagcctgcagagacagggcctgatcagcatcccccccggccaggccgccctgcccgtgcagagcctgccccaggccggcctgagccccgccgagatccagcagctgtggaaggaggtgaccggcgtgcacagcatggaggacaacggcatcaagcacggcggcctggacctgaccaccaacaacagcagcagcaccaccagcagcaacaccagcaaggccagcccccccatcacccaccacagcatcgtgaacggccagagcagcgtgctgagcgccagaagagacagcagcagccacgaggagaccggcgccagccacaccctgtacggccacggcgtgtgcaagtggcccggctgcgagagcatctgcgaggacttcggccagttcctgaagcacctgaacaacgagcacgccctggacgacagaagcaccgcccagtgcagagtgcagatgcaggtggtgcagcagctggagatccagctgagcaaggagagagagagactgcaggccatgatgacccacctgcacatgagacccagcgagcccaagcccagccccaagcccctgaacctggtgagcagcgtgaccatgagcaagaacatgctggagaccagcccccagagcctgccccagacccccaccacccccaccgcccccgtgacccccatcacccagggccccagcgtgatcacccccgccagcgtgcccaacgtgggcgccatcagaagaagacacagcgacaagtacaacatccccatgagcagcgagatcgcccccaactacgagttctacaagaacgccgacgtgagaccccccttcacctacgccaccctgatcagacaggccatcatggagagcagcgacagacagctgaccctgaacgagatctacagctggttcaccagaaccttcgcctacttcagaagaaacgccgccacctggaagaacgccgtgagacacaacctgagcctgcacaagtgcttcgtgagagtggagaacgtgaagggcgccgtgtggaccgtggacgaggtggagtaccagaagagaagaagccagaagatcaccggcagccccaccctggtgaagaacatccccaccagcctgggctacggcgccgccctgaacgccagcctgcaggccgccctggccgagagcagcctgcccctgctgagcaaccccggcctgatcaacaacgccagcagcggcctgctgcaggccgtgcacgaggacctgaacggcagcctggaccacatcgacagcaacggcaacagcagccccggctgcagcccccagccccacatccacagcatccacgtgaaggaggagcccgtgatcgccgaggacgaggactgccccatgagcctggtgaccaccgccaaccacagccccgagctggaggacgacagagagatcgaggaggagcccctgagcgaggacctggagtag

SEQ ID NO: 81980 - DNA, 1593 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgcagatgcagcagctgcagcagcagcagcacctgctgagcctgcagagacagggcctgatcagcatcccccccggccaggccgccctgcccgtgcagagcctgccccaggccggcctgagccccgccgagatccagcagctgtggaaggaggtgaccggcgtgcacagcatggaggacaacggcatcaagcacggcggcctggacctgaccaccaacaacagcagcagcaccaccagcagcaacaccagcaaggccagcccccccatcacccaccacagcatcgtgaacggccagagcagcgtgctgagcgccagaagagacagcagcagccacgaggagaccggcgccagccacaccctgtacggccacggcgtgtgcaagtggcccggctgcgagagcatctgcgaggacttcggccagttcctgaagcacctgaacaacgagcacgccctggacgacagaagcaccgcccagtgcagagtgcagatgcaggtggtgcagcagctggagatccagctgagcaaggagagagagagactgcaggccatgatgacccacctgcacatgagacccagcgagcccaagcccagccccaagcccgccatcatggagagcagcgacagacagctgaccctgaacgagatctacagctggttcaccagaaccttcgcctacttcagaagaaacgccgccacctggaagaacgccgtgagacacaacctgagcctgcacaagtgcttcgtgagagtggagaacgtgaagggcgccgtgtggaccgtggacgaggtggagtaccagaagagaagaagccagaagatcaccggcagccccaccctggtgaagaacatccccaccagcctgggctacggcgccgccctgaacgccagcctgcaggccgccctggccgagagcagcctgcccctgctgagcaaccccggcctgatcaacaacgccagcagcggcctgctgcaggccgtgcacgaggacctgaacggcagcctggaccacatcgacagcaacggcaacagcagccccggctgcagcccccagccccacatccacagcatccacgtgaaggaggagcccgtgatcgccgaggacgaggactgccccatgagcctggtgaccaccgccaaccacagccccgagctggaggacgacagagagatcgaggaggagcccctgagcgaggacctggagtag

SEQ ID NO: 81981 - DNA, 2148 bp, Artificial Sequence; identical to SEQ ID NO: 81976
  Description of Artificial Sequence: Synthetic coding sequence

SEQ ID NO: 81982 - DNA, 1149 bp, Artificial Sequence
  Description of Artificial Sequence: Synthetic coding sequence
atgatgaccccccaggtgatcaccccccagcagatgcagcagatcctgcagcagcaggtgctgagcccccagcagctgcaggccctgctgcagcagcagcaggccgtgatgctgcagcaggacttcctggacagcggcctggagaacttcagagccgccctggagaagaaccagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgcagatgcagcagctgcagcagcagcagcacctgctgagcctgcagagacagggcctgatcagcatcccccccggccaggccgccctgcccgtgcagagcctgccccaggccggcctgagccccgccgagatccagcagctgtggaaggaggtgaccggcgtgcacagcatggaggacaacggcatcaagcacggcggcctggacctgaccaccaacaacagcagcagcaccaccagcagcaacaccagcaaggccagcccccccatcacccaccacagcatcgtgaacggccagagcagcgtgctgagcgccagaagagacagcagcagccacgaggagaccggcgccagccacaccctgtacggccacggcgtgtgcaagtggcccggctgcgagagcatctgcgaggacttcggccagttcctgaagcacctgaacaacgagcacgccctggacgacagaagcaccgcccagtgcagagtgcagatgcaggtggtgcagcagctggagatccagctgagcaaggagagagagagactgcaggccatgatgacccacctgcacatgagacccagcgagcccaagcccagccccaagcccaacatctgcaaggtgacctacagatgcatctggatgttcctgagattcagcaactacgccgaggtgctgctgtacatccccgagaagctgacccccgtggccctgtag

SEQ ID NO: 81983 - DNA, 2199 bp, Artificial Sequence
  Description of Artificial Sequence: Synthetic coding sequence
atgatgcaggagagcgccaccgagaccatcagcaacagcagcatgaaccagaacggcatgagcaccctgagcagccagctggacgccggcagcagagacggcagaagcagcggcgacaccagcagcgaggtgagcaccgtggagctgctgcacctgcagcagcagcaggccctgcaggccgccagacagctgctgctgcagcagcagaccagcggcctgaagagccccaagagcagcgacaagcagagacccctgcaggtgcccgtgagcgtggccatgatgaccccccaggtgatcaccccccagcagatgcagcagatcctgcagcagcaggtgctgagcccccagcagctgcaggccctgctgcagcagcagcaggccgtgatgctgcagcaggacttcctggacagcggcctggagaacttcagagccgccctggagaagaaccagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgcagatgcagcagctgcagcagcagcagcacctgctgagcctgcagagacagggcctgatcagcatcccccccggccaggccgccctgcccgtgcagagcctgccccaggccggcctgagccccgccgagatccagcagctgtggaaggaggtgaccggcgtgcacagcatggaggacaacggcatcaagcacggcggcctggacctgaccaccaacaacagcagcagcaccaccagcagcaacaccagcaaggccagcccccccatcacccaccacagcatcgtgaacggccagagcagcgtgctgagcgccagaagagacagcagcagccacgaggagaccggcgccagccacaccctgtacggccacggcgtgtgcaagtggcccggctgcgagagcatctgcgaggacttcggccagttcctgaagcacctgaacaacgagcacgccctggacgacagaagcaccgcccagtgcagagtgcagatgcaggtggtgcagcagctggagatccagctgagcaaggagagagagagactgcaggccatgatgacccacctgcacatgagacccagcgagcccaagcccagccccaagcccctgaacctggtgagcagcgtgaccatgagcaagaacatgctggagaccagcccccagagcctgccccagacccccaccacccccaccgcccccgtgacccccatcacccagggccccagcgtgatcacccccgccagcgtgcccaacgtgggcgccatcagaagaagacacagcgacaagtacaacatccccatgagcagcgagatcgcccccaactacgagttctacaagaacgccgacgtgagaccccccttcacctacgccaccctgatcagacaggccatcatggagagcagcgacagacagctgaccctgaacgagatctacagctggttcaccagaaccttcgcctacttcagaagaaacgccgccacctggaagaacgccgtgagacacaacctgagcctgcacaagtgcttcgtgagagtggagaacgtgaagggcgccgtgtggaccgtggacgaggtggagtaccagaagagaagaagccagaagatcaccggcagccccaccctggtgaagaacatccccaccagcctgggctacggcgccgccctgaacgccagcctgcaggccgccctggccgagagcagcctgcccctgctgagcaaccccggcctgatcaacaacgccagcagcggcctgctgcaggccgtgcacgaggacctgaacggcagcctggaccacatcgacagcaacggcaacagcagccccggctgcagcccccagccccacatccacagcatccacgtgaaggaggagcccgtgatcgccgaggacgaggactgccccatgagcctggtgaccaccgccaaccacagccccgagctggaggacgacagagagatcgaggaggagcccctgagcgaggacctggagtag

SEQ ID NO: 81984 - DNA, 2223 bp, Artificial Sequence
  Description of Artificial Sequence: Synthetic coding sequence
atgatgcaggagagcgccaccgagaccatcagcaacagcagcatgaaccagaacggcatgagcaccctgagcagccagctggacgccggcagcagagacggcagaagcagcggcgacaccagcagcgaggtgagcaccgtggagctgctgcacctgcagcagcagcaggccctgcaggccgccagacagctgctgctgcagcagcagaccagcggcctgaagagccccaagagcagcgacaagcagagacccctgcaggagctgctgcccgagaccaagctgtgcatctgcggccacagcagcggcgacggccacccccacaacaccttcgccgtgcccgtgagcgtggccatgatgaccccccaggtgatcaccccccagcagatgcagcagatcctgcagcagcaggtgctgagcccccagcagctgcaggccctgctgcagcagcagcaggccgtgatgctgcagcagcagcagctgcaggagttctacaagaagcagcaggagcagctgcacctgcagctgctgcagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcagctggccgcccagcagctggtgttccagcagcagctgctgcagatgcagcagctgcagcagcagcagcacctgctgagcctgcagagacagggcctgatcagcatcccccccggccaggccgccctgcccgtgcagagcctgccccaggccggcctgagccccgccgagatccagcagctgtggaaggaggtgaccggcgtgcacagcatggaggacaacggcatcaagcacggcggcctggacctgaccaccaacaacagcagcagcaccaccagcagcaacaccagcaaggccagcccccccatcacccaccacagcatcgtgaacggccagagcagcgtgctgagcgccagaagagacagcagcagccacgaggagaccggcgccagccacaccctgtacggccacggcgtgtgcaagtggcccggctgcgagagcatctgcgaggacttcggccagttcctgaagcacctgaacaacgagcacgccctggacgacagaagcaccgcccagtgcagagtgcagatgcaggtggtgcagcagctggagatccagctgagcaaggagagagagagactgcaggccatgatgacccacctgcacatgagacccagcgagcccaagcccagccccaagcccctgaacctggtgagcagcgtgaccatgagcaagaacatgctggagaccagcccccagagcctgccccagacccccaccacccccaccgcccccgtgacccccatcacccagggccccagcgtgatcacccccgccagcgtgcccaacgtgggcgccatcagaagaagacacagcgacaagtacaacatccccatgagcagcgagatcgcccccaactacgagttctacaagaacgccgacgtgagaccccccttcacctacgccaccctgatcagacaggccatcatggagagcagcgacagacagctgaccctgaacgagatctacagctggttcaccagaaccttcgcctacttcagaagaaacgccgccacctggaagaacgccgtgagacacaacctgagcctgcacaagtgcttcgtgagagtggagaacgtgaagggcgccgtgtggaccgtggacgaggtggagtaccagaagagaagaagccagaagatcaccggcagccccaccctggtgaagaacatccccaccagcctgggctacggcgccgccctgaacgccagcctgcaggccgccctggccgagagcagcctgcccctgctgagcaaccccggcctgatcaacaacgccagcagcggcctgctgcaggccgtgcacgaggacctgaacggcagcctggaccacatcgacagcaacggcaacagcagccccggctgcagcccccagccccacatccacagcatccacgtgaaggaggagcccgtgatcgccgaggacgaggactgccccatgagcctggtgaccaccgccaaccacagccccgagctggaggacgacagagagatcgaggaggagcccctgagcgaggacctggagtag

SEQ ID NO: 81985 - DNA, 1191 bp, Artificial Sequence
  Description of Artificial Sequence: Synthetic coding sequence
atgcccaaccccagacccggcaagcccagcgcccccagcctggccctgggccccagccccggcgccagccccagctggagagccgcccccaaggccagcgacctgctgggcgccagaggccccggcggcaccttccagggcagagacctgagaggcggcgcccacgccagcagcagcagcctgaaccccatgccccccagccagctgcagctgagcaccgtggacgcccacgccagaacccccgtgctgcaggtgcaccccctggagagccccgccatgatcagcctgaccccccccaccaccgccaccggcgtgttcagcctgaaggccagacccggcctgccccccggcatcaacgtggccagcctggagtgggtgagcagagagcccgccctgctgtgcaccttccccaaccccagcgcccccagaaaggacagcaccctgagcgccgtgccccagagcagctaccccctgctggccaacggcgtgtgcaagtggcccggctgcgagaaggtgttcgaggagcccgaggacttcctgaagcactgccaggccgaccacctgctggacgagaagggcagagcccagtgcctgctgcagagagagatggtgcagagcctggagcagcagctggtgctggagaaggagaagctgagcgccatgcaggcccacctggccggcaagatggccctgaccaaggccagcagcgtggccagcagcgacaagggcagctgctgcatcgtggccgccggcagccagggccccgtggtgcccgcctggagcggccccagagaggcccccgacagcctgttcgccgtgagaagacacctgtggggcagccacggcaacagcaccttccccgagttcctgcacaacatggactacttcaagttccacaacatgagaccccccttcacctacgccaccctgatcagatgggccatcctggaggcccccgagaagcagagaaccctgaacgagatctaccactggttcaccagaatgttcgccttcttcagaaaccaccccgccacctggaagaacgccatcagacacaacctgagcctgcacaagtgcttcgtgagagtggagagcgagaagggcgccgtgtggaccgtggacgagctggagttcagaaagaagagaagccagagacccagcagatgcagcaaccccacccccggcccctag

SEQ ID NO: 81986 - DNA, 1296 bp, Artificial Sequence
  Description of Artificial Sequence: Synthetic coding sequence
atgcccaaccccagacccggcaagcccagcgcccccagcctggccctgggccccagccccggcgccagccccagctggagagccgcccccaaggccagcgacctgctgggcgccagaggccccggcggcaccttccagggcagagacctgagaggcggcgcccacgccagcagcagcagcctgaaccccatgccccccagccagctgcagctgcccaccctgcccctggtgatggtggcccccagcggcgccagactgggccccctgccccacctgcaggccctgctgcaggacagaccccacttcatgcaccagctgagcaccgtggacgcccacgccagaacccccgtgctgcaggtgcaccccctggagagccccgccatgatcagcctgaccccccccaccaccgccaccggcgtgttcagcctgaaggccagacccggcctgccccccggcatcaacgtggccagcctggagtgggtgagcagagagcccgccctgctgtgcaccttccccaaccccagcgcccccagaaaggacagcaccctgagcgccgtgccccagagcagctaccccctgctggccaacggcgtgtgcaagtggcccggctgcgagaaggtgttcgaggagcccgaggacttcctgaagcactgccaggccgaccacctgctggacgagaagggcagagcccagtgcctgctgcagagagagatggtgcagagcctggagcagcagctggtgctggagaaggagaagctgagcgccatgcaggcccacctggccggcaagatggccctgaccaaggccagcagcgtggccagcagcgacaagggcagctgctgcatcgtggccgccggcagccagggccccgtggtgcccgcctggagcggccccagagaggcccccgacagcctgttcgccgtgagaagacacctgtggggcagccacggcaacagcaccttccccgagttcctgcacaacatggactacttcaagttccacaacatgagaccccccttcacctacgccaccctgatcagatgggccatcctggaggcccccgagaagcagagaaccctgaacgagatctaccactggttcaccagaatgttcgccttcttcagaaaccaccccgccacctggaagaacgccatcagacacaacctgagcctgcacaagtgcttcgtgagagtggagagcgagaagggcgccgtgtggaccgtggacgagctggagttcagaaagaagagaagccagagacccagcagatgcagcaaccccacccccggcccctag

SEQ ID NO: 81987 - DNA, 1215 bp, Artificial Sequence
  Description of Artificial Sequence: Synthetic coding sequence
atgcccaaccccagacccggcaagcccagcgcccccagcctggccctgggccccagccccggcgccagccccagctggagagccgcccccaaggccagcgacctgctgggcgccagaggccccggcggcaccttccagggcagagacctgagaggcggcgcccacgccagcagcagcagcctgaaccccatgccccccagccagctgcagctgcccaccctgcccctggtgatggtggcccccagcggcgccagactgggccccctgccccacctgcaggccctgctgcaggacagaccccacttcatgcaccagctgagcaccgtggacgcccacgccagaacccccgtgctgcaggtgcaccccctggagagccccgccatgatcagcctgaccccccccaccaccgccaccggcgtgttcagcctgaaggccagacccggcctgccccccggcatcaacgtggccagcctggagtgggtgagcagagagcccgccctgctgtgcaccttccccaaccccagcgcccccagaaaggacagcaccctgagcgccgtgccccagagcagctaccccctgctggccaacggcgtgtgcaagtggcccggctgcgagaaggtgttcgaggagcccgaggacttcctgaagcactgccaggccgaccacctgctggacgagaagggcagagcccagtgcctgctgcagagagagatggtgcagagcctggagcagcaggccagcagcgacaagggcagctgctgcatcgtggccgccggcagccagggccccgtggtgcccgcctggagcggccccagagaggcccccgacagcctgttcgccgtgagaagacacctgtggggcagccacggcaacagcaccttccccgagttcctgcacaacatggactacttcaagttccacaacatgagaccccccttcacctacgccaccctgatcagatgggccatcctggaggcccccgagaagcagagaaccctgaacgagatctaccactggttcaccagaatgttcgccttcttcagaaaccaccccgccacctggaagaacgccatcagacacaacctgagcctgcacaagtgcttcgtgagagtggagagcgagaagggcgccgtgtggaccgtggacgagctggagttcagaaagaagagaagccagagacccagcagatgcagcaaccccacccccggcccctag

SEQ ID NO: 81988 - DNA, 1191 bp, Artificial Sequence; identical to SEQ ID NO: 81985
  Description of Artificial Sequence: Synthetic coding sequence

SEQ ID NO: 81989 - DNA, 2043 bp, Artificial Sequence
  Description of Artificial Sequence: Synthetic coding sequence
atgatggtggagagcgccagcgagaccatcagaagcgcccccagcggccagaacggcgtgggcagcctgagcggccaggccgacggcagcagcggcggcgccaccggcaccaccgccagcggcaccggcagagaggtgaccaccggcgccgacagcaacggcgagatgagccccgccgagctgctgcacttccagcagcagcaggccctgcaggtggccagacagttcctgctgcagcaggccagcggcctgagcagccccggcaacaacgacagcaagcagagcgccagcgccgtgcaggtgcccgtgagcgtggccatgatgagcccccagatgctgaccccccagcagatgcagcagatcctgagccccccccagctgcaggccctgctgcagcagcagcaggccctgatgctgcagcagctgcaggagtactacaagaagcagcaggagcagctgcacctgcagctgctgacccagcagcaggccggcaagccccagcccaaggaggccctgggcaacaagcagctggccttccagcagcagctgctgcagatgcagcagctgcagcagcagcacctgctgaacctgcagagacagggcctggtgagcctgcagcccaaccaggccagcggccccctgcagaccctgccccaggccgccgtgtgccccaccgacctgccccagctgtggaagggcgagggcgcccccggccagcccgccgaggacagcgtgaagcaggagggcctggacctgaccggcaccgccgccaccgccaccagcttcgccgccccccccaaggtgagcccccccctgagccaccacaccctgcccaacggccagcccaccgtgctgaccagcagaagagacagcagcagccacgaggagacccccggcagccaccccctgtacggccacggcgagtgcaagtggcccggctgcgagaccctgtgcgaggacctgggccagttcatcaagcacctgaacaccgagcacgccctggacgacagaagcaccgcccagtgcagagtgcagatgcaggtggtgcagcagctggagatccagctggccaaggagagcgagagactgcaggccatgatggcccacctgcacatgagacccagcgagcccaagcccttcagccagcccctgaaccccgtgcccggcagcagcagcttcagcaaggtgaccgtgagcgccgccgacagcttccccgacggcctggtgcacccccccaccagcgccgccgcccccgtgacccccctgagaccccccggcctgggcagcgccagcctgcacggcggcggccccgccagaagaagaagcagcgacaagttctgcagccccatcagcagcgagctggcccagaaccacgagttctacaagaacgccgacgtgagaccccccttcacctacgccagcctgatcagacaggccatcctggagacccccgacagacagctgaccctgaacgagatctacaactggttcaccagaatgttcgcctacttcagaagaaacaccgccacctggaagaacgccgtgagacacaacctgagcctgcacaagtgcttcgtgagagtggagaacgtgaagggcgccgtgtggaccgtggacgagagagagtaccagaagagaagaccccccaagatgaccggcagccccaccctggtgaagaacatgatcagcggcctgagctacggcgccctgaacgccagctaccaggccgccctggccgagagcagcttccccctgctgaacagccccggcatgctgaaccccggcagcgccagcagcctgctgcccctgagccacgacgacgtgggcgcccccgtggagcccctgcccagcaacggcagcagcagcccccccagactgagccccccccagtacagccaccaggtgcaggtgaaggaggagcccgccgaggccgaggaggacagacagcccggcccccccctgggcgcccccaaccccagcgccagcggcccccccgaggacagagacctggaggaggagctgcccggcgaggagctgagctag

SEQ ID NO: 81990 - DNA, 2037 bp, Artificial Sequence
  Description of Artificial Sequence: Synthetic coding sequence
atgatggtggagagcgccagcgagaccatcagaagcgcccccagcggccagaacggcgtgggcagcctgagcggccaggccgacggcagcagcggcggcgccaccggcaccaccgccagcggcaccggcagagaggtgaccaccggcgccgacagcaacggcgagatgagccccgccgagctgctgcacttccagcagcagcaggccctgcaggtggccagacagttcctgctgcagcaggccagcggcctgagcagccccggcaacaacgacagcaagcagagcgccagcgccgtgcaggtgcccgtgagcgtggccatgatgagcccccagatgctgaccccccagcagatgcagcagatcctgagccccccccagctgcaggccctgctgcagcagcagcaggccctgatgctgcagcaggagtactacaagaagcagcaggagcagctgcacctgcagctgctgacccagcagcaggccggcaagccccagcccaaggaggccctgggcaacaagcagctggccttccagcagcagctgctgcagatgcagcagctgcagcagcagcacctgctgaacctgcagagacagggcctggtgagcctgcagcccaaccaggccagcggccccctgcagaccctgccccaggccgccgtgtgccccaccgacctgccccagctgtggaagggcgagggcgcccccggccagcccgccgaggacagcgtgaagcaggagggcctggacctgaccggcaccgccgccaccgccaccagcttcgccgccccccccaaggtgagcccccccctgagccaccacaccctgcccaacggccagcccaccgtgctgaccagcagaagagacagcagcagccacgaggagacccccggcagccaccccctgtacggccacggcgagtgcaagtggcccggctgcgagaccctgtgcgaggacctgggccagttcatcaagcacctgaacaccgagcacgccctggacgacagaagcaccgcccagtgcagagtgcagatgcaggtggtgcagcagctggagatccagctggccaaggagagcgagagactgcaggccatgatggcccacctgcacatgagacccagcgagcccaagcccttcagccagcccctgaaccccgtgcccggcagcagcagcttcagcaaggtgaccgtgagcgccgccgacagcttccccgacggcctggtgcacccccccaccagcgccgccgcccccgtgacccccctgagaccccccggcctgggcagcgccagcctgcacggcggcggccccgccagaagaagaagcagcgacaagttctgcagccccatcagcagcgagctggcccagaaccacgagttctacaagaacgccgacgtgagaccccccttcacctacgccagcctgatcagacaggccatcctggagacccccgacagacagctgaccctgaacgagatctacaactggttcaccagaatgttcgcctacttcagaagaaacaccgccacctggaagaacgccgtgagacacaacctgagcctgcacaagtgcttcgtgagagtggagaacgtgaagggcgccgtgtggaccgtggacgagagagagtaccagaagagaagaccccccaagatgaccggcagccccaccctggtgaagaacatgatcagcggcctgagctacggcgccctgaacgccagctaccaggccgccctggccgagagcagcttccccctgctgaacagccccggcatgctgaaccccggcagcgccagcagcctgctgcccctgagccacgacgacgtgggcgcccccgtggagcccctgcccagcaacggcagcagcagcccccccagactgagccccccccagtacagccaccaggtgcaggtgaaggaggagcccgccgaggccgaggaggacagacagcccggcccccccctgggcgcccccaaccccagcgccagcggcccccccgaggacagagacctggaggaggagctgcccggcgaggagctgagctag

SEQ ID NO: 81991 - DNA, 2043 bp, Artificial Sequence; identical to SEQ ID NO: 81989
  Description of Artificial Sequence: Synthetic coding sequence

SEQ ID NO: 81992 - DNA, 2004 bp, Artificial Sequence
  Description of Artificial Sequence: Synthetic coding sequence
atgatggtggagagcgccagcgagaccatcagaagcgcccccagcggccagaacggcgtgggcagcctgagcggccaggccgacggcagcagcggcggcgccaccggcaccaccgccagcggcaccggcagagaggtgaccaccggcgccgacagcaacggcgagatgagccccgccgagctgctgcacttccagcagcagcaggccctgcaggtggccagacagttcctgctgcagcaggccagcggcctgagcagccccggcaacaacgacagcaagcagagcgccagcgccgtgcaggtgcccgtgagcgtggccatgatgagcccccagatgctgaccccccagcagatgcagcagatcctgagccccccccagctgcaggccctgctgcagcagcagcaggccctgatgctgcagcagctgcaggagtactacaagaagcagcaggagcagctgcacctgcagctgctgacccagcagcaggccggcaagccccagcccaaggaggccctgggcaacaagcagctggccttccagcagcagctgctgcagatgcagcagctgcagcagcagcacctgctgaacctgcagagacagggcctggtgagcctgcagcccaaccaggccagcggccccctgcagaccctgccccaggccgtgtgccccaccgacctgccccagctgtggaagggcgagggcgcccccggccagcccgccgaggacagcgtgaagcaggagggcctggacctgaccggcaccgccgccaccgccaccagcttcgccgccccccccaaggtgagcccccccctgagccaccacaccctgcccaacggccagcccaccgtgctgaccagcagaagagacagcagcagccacgaggagacccccggcagccaccccctgtacggccacggcgagtgcaagtggcccggctgcgagaccctgtgcgaggacctgggccagttcatcaagcacctgaacaccgagcacgccctggacgacagaagcaccgcccagtgcagagtgcagatgcaggtggtgcagcagctggagatccagctggccaaggagagcgagagactgcaggccatgatggcccacctgcacatgagacccagcgagcccaagcccttcagccagcccgtgaccgtgagcgccgccgacagcttccccgacggcctggtgcacccccccaccagcgccgccgcccccgtgacccccctgagaccccccggcctgggcagcgccagcctgcacggcggcggccccgccagaagaagaagcagcgacaagttctgcagccccatcagcagcgagctggcccagaaccacgagttctacaagaacgccgacgtgagaccccccttcacctacgccagcctgatcagacaggccatcctggagacccccgacagacagctgaccctgaacgagatctacaactggttcaccagaatgttcgcctacttcagaagaaacaccgccacctggaagaacgccgtgagacacaacctgagcctgcacaagtgcttcgtgagagtggagaacgtgaagggcgccgtgtggaccgtggacgagagagagtaccagaagagaagaccccccaagatgaccggcagccccaccctggtgaagaacatgatcagcggcctgagctacggcgccctgaacgccagctaccaggccgccctggccgagagcagcttccccctgctgaacagccccggcatgctgaaccccggcagcgccagcagcctgctgcccctgagccacgacgacgtgggcgcccccgtggagcccctgcccagcaacggcagcagcagcccccccagactgagccccccccagtacagccaccaggtgcaggtgaaggaggagcccgccgaggccgaggaggacagacagcccggcccccccctgggcgcccccaaccccagcgccagcggcccccccgaggacagagacctggaggaggagctgcccggcgaggagctgagctag

SEQ ID NO: 81993 - DNA, 2007 bp, Artificial Sequence
  Description of Artificial Sequence: Synthetic coding sequence
atgatggtggagagcgccagcgagaccatcagaagcgcccccagcggccagaacggcgtgggcagcctgagcggccaggccgacggcagcagcggcggcgccaccggcaccaccgccagcggcaccggcagagaggtgaccaccggcgccgacagcaacggcgagatgagccccgccgagctgctgcacttccagcagcagcaggccctgcaggtggccagacagttcctgctgcagcaggccagcggcctgagcagccccggcaacaacgacagcaagcagagcgccagcgccgtgcaggtgcccgtgagcgtggccatgatgagcccccagatgctgaccccccagcagatgcagcagatcctgagccccccccagctgcaggccctgctgcagcagcagcaggccctgatgctgcagcagctgcaggagtactacaagaagcagcaggagcagctgcacctgcagctgctgacccagcagcaggccggcaagccccagcccaaggaggccctgggcaacaagcagctggccttccagcagcagctgctgcagatgcagcagctgcagcagcagcacctgctgaacctgcagagacagggcctggtgagcctgcagcccaaccaggccagcggccccctgcagaccctgccccaggccgccgtgtgccccaccgacctgccccagctgtggaagggcgagggcgcccccggccagcccgccgaggacagcgtgaagcaggagggcctggacctgaccggcaccgccgccaccgccaccagcttcgccgccccccccaaggtgagcccccccctgagccaccacaccctgcccaacggccagcccaccgtgctgaccagcagaagagacagcagcagccacgaggagacccccggcagccaccccctgtacggccacggcgagtgcaagtggcccggctgcgagaccctgtgcgaggacctgggccagttcatcaagcacctgaacaccgagcacgccctggacgacagaagcaccgcccagtgcagagtgcagatgcaggtggtgcagcagctggagatccagctggccaaggagagcgagagactgcaggccatgatggcccacctgcacatgagacccagcgagcccaagcccttcagccagcccgtgaccgtgagcgccgccgacagcttccccgacggcctggtgcacccccccaccagcgccgccgcccccgtgacccccctgagaccccccggcctgggcagcgccagcctgcacggcggcggccccgccagaagaagaagcagcgacaagttctgcagccccatcagcagcgagctggcccagaaccacgagttctacaagaacgccgacgtgagaccccccttcacctacgccagcctgatcagacaggccatcctggagacccccgacagacagctgaccctgaacgagatctacaactggttcaccagaatgttcgcctacttcagaagaaacaccgccacctggaagaacgccgtgagacacaacctgagcctgcacaagtgcttcgtgagagtggagaacgtgaagggcgccgtgtggaccgtggacgagagagagtaccagaagagaagaccccccaagatgaccggcagccccaccctggtgaagaacatgatcagcggcctgagctacggcgccctgaacgccagctaccaggccgccctggccgagagcagcttccccctgctgaacagccccggcatgctgaaccccggcagcgccagcagcctgctgcccctgagccacgacgacgtgggcgcccccgtggagcccctgcccagcaacggcagcagcagcccccccagactgagccccccccagtacagccaccaggtgcaggtgaaggaggagcccgccgaggccgaggaggacagacagcccggcccccccctgggcgcccccaaccccagcgccagcggcccccccgaggacagagacctggaggaggagctgcccggcgaggagctgagctag

SEQ ID NO: 81994 - DNA, 1212 bp, Artificial Sequence
  Description of Artificial Sequence: Synthetic coding sequence
atgaagctggaggtgttcgtgcccagagccgcccacggcgacaagcagggcagcgacctggagggcgccggcggcagcgacgcccccagccccctgagcgccgccggcgacgacagcctgggcagcgacggcgactgcgccgccaacagccccgccgccggcggcggcgccagagacacccagggcgacggcgagcagagcgccggcggcggccccggcgccgaggaggccatccccgccgccgccgccgccgccgtggtggccgagggcgccgaggccggcgccgccggccccggcgccggcggcgccggcagcggcgagggcgccagaagcaagccctacaccagaagacccaagcccccctacagctacatcgccctgatcgccatggccatcagagacagcgccggcggcagactgaccctggccgagatcaacgagtacctgatgggcaagttccccttcttcagaggcagctacaccggctggagaaacagcgtgagacacaacctgagcctgaacgactgcttcgtgaaggtgctgagagaccccagcagaccctggggcaaggacaactactggatgctgaaccccaacagcgagtacaccttcgccgacggcgtgttcagaagaagaagaaagagactgagccacagagcccccgtgcccgcccccggcctgagacccgaggaggcccccggcctgcccgccgcccccccccccgcccccgccgcccccgccagccccagaatgagaagccccgccagacaggaggagagagccagccccgccggcaagttcagcagcagcttcgccatcgacagcatcctgagaaagcccttcagaagcagaagactgagagacaccgcccccggcaccaccctgcagtggggcgccgccccctgcccccccctgcccgccttccccgccctgctgcccgccgccccctgcagagccctgctgcccctgtgcgcctacggcgccggcgagcccgccagactgggcgccagagaggccgaggtgccccccaccgccccccccctgctgctggcccccctgcccgccgccgcccccgccaagcccctgagaggccccgccgccggcggcgcccacctgtactgccccctgagactgcccgccgccctgcaggccgccagcgtgagaagacccggcccccacctgccctaccccgtggagaccctgctggcctag

SEQ ID NO: 81995 - DNA, 1626 bp, Artificial Sequence
  Description of Artificial Sequence: Synthetic coding sequence
atgagccagctggtggagtgcgtgcccaacttcagcgagggcaagaaccaggaggtgatcgacgccatcagcggcgccatcacccagacccccggctgcgtgctgctggacgtggacgccggccccagcaccaacagaaccgtgtacaccttcgtgggcccccccgagtgcgtggtggagggcgccctgaacgccgccagagtggccagcagactgatcgacatgagcagacaccagggcgagcaccccagaatgggcgccctggacgtgtgccccttcatccccgtgagaggcgtgagcgtggacgagtgcgtgctgtgcgcccaggccttcggccagagactggccgaggagctggacgtgcccgtgtacctgtacggcgaggccgccagaatggacagcagaagaaccctgcccgccatcagagccggcgagtacgaggccctgcccaagaagctgcagcaggccgactgggcccccgacttcggccccagcagcttcgtgcccagctggggcgccaccgccaccggcgccagaaagttcctgatcgccttcaacatcaacctgctgggcaccaaggagcaggcccacagaatcgccctgaacctgagagagcagggcagaggcaaggaccagcccggcagactgaagaaggtgcagggcatcggctggtacctggacgagaagaacctggcccaggtgagcaccaacctgctggacttcgaggtgaccgccctgcacaccgtgtacgaggagacctgcagagaggcccaggagctgagcctgcccgtggtgggcagccagctggtgggcctggtgcccctgaaggccctgctggacgccgccgccttctactgcgagaaggagaacctgttcatcctggaggaggagcagagaatcagactggtggtgagcagactgggcctggacagcctgtgccccttcagccccaaggagagaatcatcgagtacctggtgcccgagagaggccccgagagaggcctgggcagcaagagcctgagagccttcgtgggcgaggtgggcgccagaagcgccgcccccggcggcggcagcgtggccgccgccgccgccgccatgggcgccgccctgggcagcatggtgggcctgatgacctacggcagaagacagttccagagcctggacaccaccatgagaagactgatcccccccttcagagaggccagcgccaagctgaccaccctggtggacgccgacgccgaggccttcaccgcctacctggaggccatgagactgcccaagaacacccccgaggagaaggacagaagaaccgccgccctgcaggagggcctgagaagagccgtgagcgtgcccctgaccctggccgagaccgtggccagcctgtggcccgccctgcaggagctggccagatgcggcaacctggcctgcagaagcgacctgcaggtggccgccaaggccctggagatgggcgtgttcggcgcctacttcaacgtgctgatcaacctgagagacatcaccgacgaggccttcaaggaccagatccaccacagagtgagcagcctgctgcaggaggccaagacccaggccgccctggtgctggactgcctggagaccagacaggagtag

SEQ ID NO: 81996 - DNA, 1488 bp, Artificial Sequence
  Description of Artificial Sequence: Synthetic coding sequence
atgagccagctggtggagtgcgtgcccaacttcagcgagggcaagaaccaggaggtgatcgacgccatcagcggcgccatcacccagacccccggctgcgtgctgctggacgtggacgccggccccagcaccaacagaaccgtgtacaccttcgtgggcccccccgagtgcgtggtggagggcgccctgaacgccgccagagtggccagcagactgatcgacatgagcagacaccagggcgagcaccccagaatgggcgccctggacgtgtgccccttcatccccgtgagaggcgtgagcgtggacgagtgcgtgctgtgcgcccaggccttcggccagagactggccgaggagctggacgtgcccgtgtacctgtacggcgaggccgccagaatggacagcagaagaaccctgcccgccatcagagccggcgagtacgaggccctgcccaagaagctgcagcaggccgactgggcccccgacttcggccccagcagcttcgtgcccagctggggcgccaccgccaccggcgccagaaagttcctgatcgccttcaacatcaacctgctgggcaccaaggagcaggcccacagaatcgccctgaacctgagagagcagggcagaggcaaggaccagcccggcagactgaagaaggtgcagggcatcggctggtacctggacgagaagaacctggcccaggtgagcaccaacctgctggacttcgaggtgaccgccctgcacaccgtgtacgaggagacctgcagagaggcccaggagctgagcctgcccgtggtgggcagccagctggtgggcctggtgcccctgaaggccctgctggacgccgccgccttctactgcgagaaggagaacctgttcatcctggaggaggagcagagaatcagactggtggtgagcagactgggcctggacagcctgtgccccttcagccccaaggagagaatcatcgagtacctggtgcccgagagaggccccgagagaggcctgggcagcaagagcctgagagccttcgtgggcgaggtgggcgccagaagcgccgcccccggcggcggcagcgtggccgccgccgccgccgccatgggcgccgccctgggcagcatggtgggcctgatgacctacggcagaagacagttccagagcctggacaccaccatgagaagactgatcccccccttcagagaggccagcgccaagctgaccaccctggtggacgccgacgccgaggccttcaccgcctacctggcccacggcggccccaccggcggcagcgaggccggcagcctgtgcgccgccgacgccggcggcgacggcggcctggccgtggccggccccgccggcaccggccccgtgtgggagcccggcctgcccgtgagaccccccggcggcggccagagccccggcgacggcagagtgtggagaatcttccagagagcccaccagcccgagggccaccacagaagaggcatctag

SEQ ID NO: 81997 - DNA, 1719 bp, Artificial Sequence
  Description of Artificial Sequence: Synthetic coding sequence
atgagccagctggtggagtgcgtgcccaacttcagcgagggcaagaaccaggaggtgatcgacgccatcagcggcgccatcacccagacccccggctgcgtgctgctggacgtggacgccggccccagcaccaacagaaccgtgtacaccttcgtgggcccccccgagtgcgtggtggagggcgccctgaacgccgccagagtggccagcagactgatcgacatgagcagacaccagggcgagcaccccagaatgggcgccctggacgtgtgccccttcatccccgtgagaggcgtgagcgtggacgagtgcgtgctgtgcgcccaggccttcggccagagactggccgaggagctggacgtgcccgtgtacctgtacggcgaggccgccagaatggacagcagaagaaccctgcccgccatcagagccggcgagtacgaggccctgcccaagaagctgcagcaggccgactgggcccccgacttcggccccagcagcttcgtgcccagctggggcgccaccgccaccggcgccagaaagttcctgatcgccttcaacatcaacctgctgggcaccaaggagcaggcccacagaatcgccctgaacctgagagagcagggcagaggcaaggaccagcccggcagactgaagaaggtgcagggcatcggctggtacctggacgagaagaacctggcccaggtgagcaccaacctgctggacttcgaggtgaccgccctgcacaccgtgtacgaggagacctgcagagaggcccaggagctgagcctgcccgtggtgggcagccagctggtgggcctggtgcccctgaaggccctgctggacgccgccgccttctactgcgagaaggagaacctgttcatcctggaggaggagcagagaatcagactggtggtgagcagactgggcctggacagcctgtgccccttcagccccaaggagagaatcatcgagtacctggtgcccgagagaggccccgagagaggcctgggcagcaagagcctgagagccttcgtgggcgaggtgggcgccagaagcgccgcccccggcggcggcagcgtggccgccgccgccgccgccatgggcgccgccctgggcagcatggtgggcctgatgacctacggcagaagacagttccagagcctggacaccaccatgagaagactgatcccccccttcagagaggccagcgccaagctgaccaccctggtggacgccgacgccgaggccttcaccgcctacctggaggccatgagactgcccaagaacacccccgaggagaaggacagaagaaccgccgccctgcaggagggcctgagaagagccgtgagcgtgcccctgaccctggccgagaccgtggccagcctgtggcccgccctgcaggagctggccagatgcggcaacctggcctgcagaagcgacctgcaggtggccgccaaggccctggagatgggcgtgttcggcgcctacttcaacgtgctgatcaacctgagagacatcaccgacgaggccttcaaggaccagccccccgccggcagccaggaccccggctgcaccggcgccggcctgctgggcgaccccgccggcgtgaccgtgagagaggccagccccggcagcgtggccccccccagccccatccccagaggccagagctgcgacctggagacccccggcaccgccggccccagcaccctggagggctag

SEQ ID NO: 81998 - DNA, 1488 bp, Artificial Sequence; identical to SEQ ID NO: 81996
  Description of Artificial Sequence: Synthetic coding sequence

SEQ ID NO: 81999 - DNA, 1626 bp, Artificial Sequence; identical to SEQ ID NO: 81995
  Description of Artificial Sequence: Synthetic coding sequence

SEQ ID NO: 82000 - DNA, 1719 bp, Artificial Sequence; identical to SEQ ID NO: 81997
  Description of Artificial Sequence: Synthetic coding sequence

SEQ ID NO: 82001 - DNA, 1779 bp, Artificial Sequence
  Description of Artificial Sequence: Synthetic coding sequence
atgagctggggcaccgagctgtgggaccagttcgacaacctggagaagcacacccagtggggcatcgacatcctggagaagtacatcaagttcgtgaaggagagaaccgagatcgagctgagctacgccaagcagctgagaaacctgagcaagaagtaccagcccaagaagaacagcaaggaggaggaggagtacaagtacaccagctgcaaggccttcatcagcaacctgaacgagatgaacgactacgccggccagcacgaggtgatcagcgagaacatggccagccagatcatcgtggacctggccagatacgtgcaggagctgaagcaggagagaaagagcaacttccacgacggcagaaaggcccagcagcacatcgagacctgctggaagcagctggagagcagcaagagaagattcgagagagactgcaaggaggccgacagagcccagcagtacttcgagaagatggacgccgacatcaacgtgaccaaggccgacgtggagaaggccagacagcaggcccagatcagacaccagatggccgaggacagcaaggccgactacagcagcatcctgcagaagttcaaccacgagcagcacgagtactaccacacccacatccccaacatcttccagaagatccaggagatggaggagagaagaatcgtgagaatgggcgagagcatgaagacctacgccgaggtggacagacaggtgatccccatcatcggcaagtgcctggacggcatcgtgaaggccgccgagagcatcgaccagaagaacgacagccagctggtgatcgaggcctacaagagcggcttcgagccccccggcgacatcgagttcgaggactacacccagcccatgaagagaaccgtgagcgacaacagcctgagcaacagcagaggcgagggcaagcccgacctgaagttcggcggcaagagcaagggcaagctgtggcccttcatcaagaagaacaagagccccaagcagcagaaggagcccctgagccacagattcaacgagttcatgaccagcaagcccaagatccactgcttcagaagcctgaagagaggccacagcctgctgaagggcgccacccccgaggacttcagcaacctgccccccgagcagagaagaaagaagctgcagcagaaggtggacgagctgaacaaggagatccagaaggagatggaccagagagacgccatcaccaagatgaaggacgtgtacctgaagaacccccagatgggcgaccccgccagcctggaccacaagctggccgaggtgagccagaacatcgagaagctgagagtggagacccagaagttcgaggcctggctggccgaggtggagggcagactgcccgccagaagcgagcaggccagaagacagagcggcctgtacgacagccagaacccccccaccgtgaacaactgcgcccaggacagagagagccccgacggcagctacaccgaggagcagagccaggagagcgagatgaaggtgctggccaccgacttcgacgacgagttcgacgacgaggagcccctgcccgccatcggcacctgcaaggccctgtacaccttcgagggccagaacgagggcaccatcagcgtggtggagggcgagaccctgtacgtgatcgaggaggacaagggcgacggctggaccagaatcagaagaaacgaggacgaggagggctacgtgcccaccagctacgtggaggtgtgcctggacaagaacgccaagggcgccaagacctacatctag

SEQ ID NO: 82002 - DNA, 1854 bp, Artificial Sequence
  Description of Artificial Sequence: Synthetic coding sequence
atcagatggaccgacgagctgtgggaccagttcgacaacctggagaagcacacccagtggggcatcgacatcctggagaagtacatcaagttcgtgaaggagagaaccgagatcgagctgagctacgccaagcagctgagaaacctgagcaagaagtaccagcccaagaagaacagcaaggaggaggaggagtacaagtacaccagctgcaaggccttcatcagcaacctgaacgagatgaacgactacgccggccagcacgaggtgatcagcgagaacatggccagccagatcatcgtggacctggccagatacgtgcaggagctgaagcaggagagaaagagcaacttccacgacggcagaaaggcccagcagcacatcgagacctgctggaagcagctggagagcagcaagagaagattcgagagagactgcaaggaggccgacagagcccagcagtacttcgagaagatggacgccgacatcaacgtgaccaaggccgacgtggagaaggccagacagcaggcccagatcagacaccagatggccgaggacagcaaggccgactacagcagcatcctgcagaagttcaaccacgagcagcacgagtactaccacacccacatccccaacatcttccagaagatccaggagatggaggagagaagaatcgtgagaatgggcgagagcatgaagacctacgccgaggtggacagacaggtgatccccatcatcggcaagtgcctggacggcatcgtgaaggccgccgagagcatcgaccagaagaacgacagccagctggtgatcgaggcctacaagagcggcttcgagccccccggcgacatcgagttcgaggactacacccagcccatgaagagaaccgtgagcgacaacagcctgagcaacagcagaggcgagggcaagcccgacctgaagttcggcggcaagagcaagggcaagctgtggcccttcatcaagaagaacaagctgatgagcctgctgaccagcccccaccagccccccccccccccccccgccagcgccagccccagcgccgtgcccaacggcccccagagccccaagcagcagaaggagcccctgagccacagattcaacgagttcatgaccagcaagcccaagatccactgcttcagaagcctgaagagaggccccagcttcaagcagggcgccacccccgaggacttcagcaacctgccccccgagcagagaagaaagaagctgcagcagaaggtggacgagctgaacaaggagatccagaaggagatggaccagagagacgccatcaccaagatgaaggacgtgtacctgaagaacccccagatgggcgaccccgccagcctggaccacaagctggccgaggtgagccagaacatcgagaagctgagagtggagacccagaagttcgaggcctggctggccgaggtggagggcagactgcccgccagaagcgagcaggccagaagacagagcggcctgtacgacagccagaacccccccaccgtgaacaactgcgcccaggacagagagagccccgacggcagctacaccgaggagcagagccaggagagcgagatgaaggtgctggccaccgacttcgacgacgagttcgacgacgaggagcccctgcccgccatcggcacctgcaaggccctgtacaccttcgagggccagaacgagggcaccatcagcgtggtggagggcgagaccctgtacgtgatcgaggaggacaagggcgacggctggaccagaatcagaagaaacgaggacgaggagggctacgtgcccaccagctacgtggaggtgtgcctggacaagaacgccaaggacagctag

SEQ ID NO: 82003 - DNA, 1854 bp, Artificial Sequence
  Description of Artificial Sequence: Synthetic coding sequence
atgagctggggcaccgagctgtgggaccagttcgacaacctggagaagcacacccagtggggcatcgacatcctggagaagtacatcaagttcgtgaaggagagaaccgagatcgagctgagctacgccaagcagctgagaaacctgagcaagaagtaccagcccaagaagaacagcaaggaggaggaggagtacaagtacaccagctgcaaggccttcatcagcaacctgaacgagatgaacgactacgccggccagcacgaggtgatcagcgagaacatggccagccagatcatcgtggacctggccagatacgtgcaggagctgaagcaggagagaaagagcaacttccacgacggcagaaaggcccagcagcacatcgagacctgctggaagcagctggagagcagcaagagaagattcgagagagactgcaaggaggccgacagagcccagcagtacttcgagaagatggacgccgacatcaacgtgaccaaggccgacgtggagaaggccagacagcaggcccagatcagacaccagatggccgaggacagcaaggccgactacagcagcatcctgcagaagttcaaccacgagcagcacgagtactaccacacccacatccccaacatcttccagaagatccaggagatggaggagagaagaatcgtgagaatgggcgagagcatgaagacctacgccgaggtggacagacaggtgatccccatcatcggcaagtgcctggacggcatcgtgaaggccgccgagagcatcgaccagaagaacgacagccagctggtgatcgaggcctacaagagcggcttcgagccccccggcgacatcgagttcgaggactacacccagcccatgaagagaaccgtgagcgacaacagcctgagcaacagcagaggcgagggcaagcccgacctgaagttcggcggcaagagcaagggcaagctgtggcccttcatcaagaagaacaagctgatgagcctgctgaccagcccccaccagccccccccccccccccccgccagcgccagccccagcgccgtgcccaacggcccccagagccccaagcagcagaaggagcccctgagccacagattcaacgagttcatgaccagcaagcccaagatccactgcttcagaagcctgaagagaggccacagcctgctgaagggcgccacccccgaggacttcagcaacctgccccccgagcagagaagaaagaagctgcagcagaaggtggacgagctgaacaaggagatccagaaggagatggaccagagagacgccatcaccaagatgaaggacgtgtacctgaagaacccccagatgggcgaccccgccagcctggaccacaagctggccgaggtgagccagaacatcgagaagctgagagtggagacccagaagttcgaggcctggctggccgaggtggagggcagactgcccgccagaagcgagcaggccagaagacagagcggcctgtacgacagccagaacccccccaccgtgaacaactgcgcccaggacagagagagccccgacggcagctacaccgaggagcagagccaggagagcgagatgaaggtgctggccaccgacttcgacgacgagttcgacgacgaggagcccctgcccgccatcggcacctgcaaggccctgtacaccttcgagggccagaacgagggcaccatcagcgtggtggagggcgagaccctgtacgtgatcgaggaggacaagggcgacggctggaccagaatcagaagaaacgaggacgaggagggctacgtgcccaccagctacgtggaggtgtgcctggacaagaacgccaaggacagctag

SEQ ID NO: 82004 - DNA, 1827 bp, Artificial Sequence
  Description of Artificial Sequence: Synthetic coding sequence
atgagctggggcaccgagctgtgggaccagttcgacaacctggagaagcacacccagtggggcatcgacatcctggagaagtacatcaagttcgtgaaggagagaaccgagatcgagctgagctacgccaagcagctgagaaacctgagcaagaagtaccagcccaagaagaacagcaaggaggaggaggagtacaagtacaccagctgcaaggccttcatcagcaacctgaacgagatgaacgactacgccggccagcacgaggtgatcagcgagaacatggccagccagatcatcgtggacctggccagatacgtgcaggagctgaagcaggagagaaagagcaacttccacgacggcagaaaggcccagcagcacatcgagacctgctggaagcagctggagagcagcaagagaagattcgagagagactgcaaggaggccgacagagcccagcagtacttcgagaagatggacgccgacatcaacgtgaccaaggccgacgtggagaaggccagacagcaggcccagatcagacaccagatggccgaggacagcaaggccgactacagcagcatcctgcagaagttcaaccacgagcagcacgagtactaccacacccacatccccaacatcttccagaagatccaggagatggaggagagaagaatcgtgagaatgggcgagagcatgaagacctacgccgaggtggacagacaggtgatccccatcatcggcaagtgcctggacggcatcgtgaaggccgccgagagcatcgaccagaagaacgacagccagctggtgatcgaggcctacaagagcggcttcgagccccccggcgacatcgagttcgaggactacacccagcccatgaagagaaccgtgagcgacaacagcctgagcaacagcagaggcgagggcaagcccgacctgaagttcggcggcaagagcaagggcaagctgtggcccttcatcaagaagaacaagccccccccccccccccccgccagcgccagccccagcgccgtgcccaacggcccccagagccccaagcagcagaaggagcccctgagccacagattcaacgagttcatgaccagcaagcccaagatccactgcttcagaagcctgaagagaggccacagcctgaccctgcagggcgccacccccgaggacttcagcaacctgccccccgagcagagaagaaagaagctgcagcagaaggtggacgagctgaacaaggagatccagaaggagatggaccagagagacgccatcaccaagatgaaggacgtgtacctgaagaacccccagatgggcgaccccgccagcctggaccacaagctggccgaggtgagccagaacatcgagaagctgagagtggagacccagaagttcgaggcctggctggccgaggtggagggcagactgcccgccagaagcgagcaggccagaagacagagcggcctgtacgacagccagaacccccccaccgtgaacaactgcgcccaggacagagagagccccgacggcagctacaccgaggagcagagccaggagagcgagatgaaggtgctggccaccgacttcgacgacgagttcgacgacgaggagcccctgcccgccatcggcacctgcaaggccctgtacaccttcgagggccagaacgagggcaccatcagcgtggtggagggcgagaccctgtacgtgatcgaggaggacaagggcgacggctggaccagaatcagaagaaacgaggacgaggagggctacgtgcccaccagctacgtggaggtgtgcctggacaagaacgccaaggacagctag

SEQ ID NO: 82005 - DNA, 738 bp, Artificial Sequence
  Description of Artificial Sequence: Synthetic coding sequence
atgaagagaaccatcggcaagcccacctacgccttcgaggccagagactacgtgctgagcctgaagctgggcgccacccccgaggacttcagcaacctgccccccgagcagagaagaaagaagctgcagcagaaggtggacgagctgaacaaggagatccagaaggagatggaccagagagacgccatcaccaagatgaaggacgtgtacctgaagaacccccagatgggcgaccccgccagcctggaccacaagctggccgaggtgagccagaacatcgagaagctgagagtggagacccagaagttcgaggcctggctggccgaggtggagggcagactgcccgccagaagcgagcaggccagaagacagagcggcctgtacgacagccagaacccccccaccgtgaacaactgcgcccaggacagagagagccccgacggcagctacaccgaggagcagagccaggagagcgagatgaaggtgctggccaccgacttcgacgacgagttcgacgacgaggagcccctgcccgccatcggcacctgcaaggccctgtacaccttcgagggccagaacgagggcaccatcagcgtggtggagggcgagaccctgtacgtgatcgaggaggacaagggcgacggctggaccagaatcagaagaaacgaggacgaggagggctacgtgcccaccagctacgtggaggtgtgcctggacaagaacgccaaggacagctag

SEQ ID NO: 82006 - DNA, 1854 bp, Artificial Sequence
  Description of Artificial Sequence: Synthetic coding sequence
atgagctggggcaccgagctgtgggaccagttcgacaacctggagaagcacacccagtggggcatcgacatcctggagaagtacatcaagttcgtgaaggagagaaccgagatcgagctgagctacgccaagcagctgagaaacctgagcaagaagtaccagcccaagaagaacagcaaggaggaggaggagtacaagtacaccagctgcaaggccttcatcagcaacctgaacgagatgaacgactacgccggccagcacgaggtgatcagcgagaacatggccagccagatcatcgtggacctggccagatacgtgcaggagctgaagcaggagagaaagagcaacttccacgacggcagaaaggcccagcagcacatcgagacctgctggaagcagctggagagcagcaagagaagattcgagagagactgcaaggaggccgacagagcccagcagtacttcgagaagatggacgccgacatcaacgtgaccaaggccgacgtggagaaggccagacagcaggcccagatcagacaccagatggccgaggacagcaaggccgactacagcagcatcctgcagaagttcaaccacgagcagcacgagtactaccacacccacatccccaacatcttccagaagatccaggagatggaggagagaagaatcgtgagaatgggcgagagcatgaagacctacgccgaggtggacagacaggtgatccccatcatcggcaagtgcctggacggcatcgtgaaggccgccgagagcatcgaccagaagaacgacagccagctggtgatcgaggcctacaagagcggcttcgagccccccggcgacatcgagttcgaggactacacccagcccatgaagagaaccgtgagcgacaacagcctgagcaacagcagaggcgagggcaagcccgacctgaagttcggcggcaagagcaagggcaagctgtggcccttcatcaagaagaacaagctgatgagcctgctgaccagcccccaccagccccccccccccccccccgccagcgccagccccagcgccgtgcccaacggcccccagagccccaagcagcagaaggagcccctgagccacagattcaacgagttcatgaccagcaagcccaagatccactgcttcagaagcctgaagagaggcctgagcctgaagctgggcgccacccccgaggacttcagcaacctgccccccgagcagagaagaaagaagctgcagcagaaggtggacgagctgaacaaggagatccagaaggagatggaccagagagacgccatcaccaagatgaaggacgtgtacctgaagaacccccagatgggcgaccccgccagcctggaccacaagctggccgaggtgagccagaacatcgagaagctgagagtggagacccagaagttcgaggcctggctggccgaggtggagggcagactgcccgccagaagcgagcaggccagaagacagagcggcctgtacgacagccagaacccccccaccgtgaacaactgcgcccaggacagagagagccccgacggcagctacaccgaggagcagagccaggagagcgagatgaaggtgctggccaccgacttcgacgacgagttcgacgacgaggagcccctgcccgccatcggcacctgcaaggccctgtacaccttcgagggccagaacgagggcaccatcagcgtggtggagggcgagaccctgtacgtgatcgaggaggacaagggcgacggctggaccagaatcagaagaaacgaggacgaggagggctacgtgcccaccagctacgtggaggtgtgcctggacaagaacgccaaggacagctag

SEQ ID NO: 82007 - DNA, 1722 bp, Artificial Sequence
  Description of Artificial Sequence: Synthetic coding sequence
tgactgagctacgccaagcagctgagaaacctgagcaagaagtaccagcccaagaagaacagcaaggaggaggaggagtacaagtacaccagctgcaaggccttcatcagcaacctgaacgagatgaacgactacgccggccagcacgaggtgatcagcgagaacatggccagccagatcatcgtggacctggccagatacgtgcaggagctgaagcaggagagaaagagcaacttccacgacggcagaaaggcccagcagcacatcgagacctgctggaagcagctggagagcagcaagagaagattcgagagagactgcaaggaggccgacagagcccagcagtacttcgagaagatggacgccgacatcaacgtgaccaaggccgacgtggagaaggccagacagcaggcccagatcagacaccagatggccgaggacagcaaggccgactacagcagcatcctgcagaagttcaaccacgagcagcacgagtactaccacacccacatccccaacatcttccagaagatccaggagatggaggagagaagaatcgtgagaatgggcgagagcatgaagacctacgccgaggtggacagacaggtgatccccatcatcggcaagtgcctggacggcatcgtgaaggccgccgagagcatcgaccagaagaacgacagccagctggtgatcgaggcctacaagagcggcttcgagccccccggcgacatcgagttcgaggactacacccagcccatgaagagaaccgtgagcgacaacagcctgagcaacagcagaggcgagggcaagcccgacctgaagttcggcggcaagagcaagggcaagctgtggcccttcatcaagaagaacaagccccccccccccccccccgccagcgccagccccagcgccgtgcccaacggcccccagagccccaagcagcagaaggagcccctgagccacagattcaacgagttcatgaccagcaagcccaagatccactgcttcagaagcctgaagagaggccacagcctgctgaagggcgccacccccgaggacttcagcaacctgccccccgagcagagaagaaagaagctgcagcagaaggtggacgagctgaacaaggagatccagaaggagatggaccagagagacgccatcaccaagatgaaggacgtgtacctgaagaacccccagatgggcgaccccgccagcctggaccacaagctggccgaggtgagccagaacatcgagaagctgagagtggagacccagaagttcgaggcctggctggccgaggtggagggcagactgcccgccagaagcgagcaggccagaagacagagcggcctgtacgacagccagaacccccccaccgtgaacaactgcgcccaggacagagagagccccgacggcagctacaccgaggagcagagccaggagagcgagatgaaggtgctggccaccgacttcgacgacgagttcgacgacgaggagcccctgcccgccatcggcacctgcaaggccctgtacaccttcgagggccagaacgagggcaccatcagcgtggtggagggcgagaccctgtacgtgatcgaggaggacaagggcgacggctggaccagaatcagaagaaacgaggacgaggagggctacgtgcccaccagctacgtggaggtgtgcctggacaagaacgccaagggcgccaagacctacatctag

SEQ ID NO: 82008 - DNA, 3495 bp, Artificial Sequence
  Description of Artificial Sequence: Synthetic coding sequence
atggccggcggcgaggacagaggcgacggcgagcccgtgagcgtggtgaccgtgagagtgcagtacctggaggacaccgaccccttcgcctgcgccaacttccccgagcccagaagagcccccacctgcagcctggacggcgccctgcccctgggcgcccagatccccgccgtgcacagactgctgggcgcccccctgaagctggaggactgcgccctgcaggtgagccccagcggctactacctggacaccgagctgagcctggaggagcagagagagatgctggagggcttctacgaggagatcagcaagggcagaaagcccaccctgatcctgagaacccagctgagcgtgagagtgaacgccatcctggagaagctgtacagcagcagcggccccgagctgagaagaagcctgttcagcctgaagcagatcttccaggaggacaaggacctggtgcccgagttcgtgcacagcgagggcctgagctgcctgatcagagtgggcgccgccgccgaccacaactaccagagctacatcctgagagccctgggccagctgatgctgttcgtggacggcatgctgggcgtggtggcccacagcgacaccatccagtggctgtacaccctgtgcgccagcctgagcagactggtggtgaagaccgccctgaagctgctgctggtgttcgtggagtacagcgagaacaacgcccccctgttcatcagagccgtgaacagcgtggccagcaccaccggcgcccccccctgggccaacctggtgagcatcctggaggagaagaacggcgccgaccccgagctgctggtgtacaccgtgaccctgatcaacaagaccctggccgccctgcccgaccaggacagcttctacgacgtgaccgacgccctggagcagcagggcatggaggccctggtgcagagacacctgggcaccgccggcaccgacgtggacctgagaacccagctggtgctgtacgagaacgccctgaagctggaggacggcgacatcgaggaggcccccggcgccggcggcagaagagagagaagaaagcccagcagcgaggagggcaagagaagcagaagaagcctggagggcggcggctgccccgccagagcccccgagcccggccccaccggccccgccagccccgtgggccccaccagcagcaccggccccgccctgctgaccggccccgccagcagccccgtgggcccccccagcggcctgcaggccagcgtgaacctgttccccaccatcagcgtggcccccagcgccgacaccagcagcgagagaagcatctacaaggccagattcctggagaacgtggccgccgccgagaccgagaagcaggtggccctggcccagggcagagccgagaccctggccggcgccatgcccaacgaggccggcggccaccccgacgccagacagctgtgggacagccccgagaccgcccccgccgccagaaccccccagagccccgccccctgcgtgctgctgagagcccagagaagcctggcccccgagcccaaggagcccctgatccccgccagccccaaggccgagcccatctgggagctgcccaccagagcccccagactgagcatcggcgacctggacttcagcgacctgggcgaggacgaggaccaggacatgctgaacgtggagagcgtggaggccggcaaggacatccccgcccccagcccccccctgcccctgctgagcggcgtgcccccccccccccccctgcccccccccccccccatcaagggccccttccccccccccccccccctgcccctggccgcccccctgccccacagcgtgcccgacagcagcgccctgcccaccaagagaaagaccgtgaagctgttctggagagagctgaagctggccggcggccacggcgtgagcgccagcagattcggcccctgcgccaccctgtgggccagcctggaccccgtgagcgtggacaccgccagactggagcacctgttcgagagcagagccaaggaggtgctgcccagcaagaaggccggcgagggcagaagaaccatgaccaccgtgctggaccccaagagaagcaacgccatcaacatcggcctgaccaccctgccccccgtgcacgtgatcaaggccgccctgctgaacttcgacgagttcgccgtgagcaaggacggcatcgagaagctgctgaccatgatgcccaccgaggaggagagacagaagatcgaggaggcccagctggccaaccccgacatccccctgggccccgccgagaacttcctgatgaccctggccagcatcggcggcctggccgccagactgcagctgtgggccttcaagctggactacgacagcatggagagagagatcgccgagcccctgttcgacctgaaggtgggcatggagcagctggtgcagaacgccaccttcagatgcatcctggccaccctgctggccgtgggcaacttcctgaacggcagccagagcagcggcttcgagctgagctacctggagaaggtgagcgaggtgaaggacaccgtgagaagacagagcctgctgcaccacctgtgcagcctggtgctgcagaccagacccgagagcagcgacctgtacagcgagatccccgccctgaccagatgcgccaaggtggacttcgagcagctgaccgagaacctgggccagctggagagaagaagcagagccgccgaggagagcctgagaagcctggccaagcacgagctggcccccgccctgagagccagactgacccacttcctggaccagtgcgccagaagagtggccatgctgagaatcgtgcacagaagagtgtgcaacagattccacgccttcctgctgtacctgggctacaccccccaggccgccagagaggtgagaatcatgcagttctgccacaccctgagagagttcgccctggagtacagaacctgcagagagagagtgctgcagcagcagcagaagcaggccacctacagagagagaaacaagaccagaggcagaatgatcaccgagaccgagaagttcagcggcgtggccggcgaggcccccagcaaccccagcgtgcccgtggccgtgagcagcggccccggcagaggcgacgccgacagccacgccagcatgaagagcctgctgaccagcagacccgaggacaccacccacaacagaagaagcagaggcatggtgcagagcagcagccccatcatgcccaccgtgggccccagcaccgccagccccgaggagccccccggcagcagcctgcccagcgacaccagcgacgagatcatggacctgctggtgcagagcgtgaccaagagcagccccagagccctggccgccagagagagaaagagaagcagaggcaacagaaagagcctgagaagaaccctgaagagcggcctgggcgacgacctggtgcaggccctgggcctgagcaagggccccggcctggaggtgtag

SEQ ID NO: 82009 - DNA, 4320 bp, Artificial Sequence
  Description of Artificial Sequence: Synthetic coding sequence
atggccaccctggcctgcagagtgcagttcctggacgacaccgaccccttcaacagcaccaacttccccgagcccagcagaccccccctgttcaccttcagagaggacctggccctgggcacccagctggccggcgtgcacagactgctgcaggccccccacaagctggacgactgcaccctgcagctgagccacaacggcgcctacctggacctggaggccaccctggccgagcagagagacgagctggagggcttccaggacgacgccggcagaggcaagaagcacagcatcatcctgagaacccagctgagcgtgagagtgcacgcctgcatcgagaagctgtacaacagcagcggcagagacctgagaagagccctgttcagcctgaagcagatcttccaggacgacaaggacctggtgcacgagttcgtggtggccgagggcctgacctgcctgatcaaggtgggcgccgaggccgaccagaactaccagaactacatcctgagagccctgggccagatcatgctgtacgtggacggcatgaacggcgtgatcaacagaaacgagaccatccagtggctgtacaccctgatcggcagcaagttcagactggtggtgaagaccgccctgaagctgctgctggtgttcgtggagtacagcgagagcaacgcccccctgctgatccaggccgtgaccgccgtggacaccaagagaggcgtgaagccctggagcaacatcatggagatcctggaggagaaggacggcgtggacaccgagctgctggtgtacgccatgaccctggtgaacaagaccctgagcggcctgcccgaccaggacaccttctacgacgtggtggactgcctggaggagctgggcatcgccgccgtgagccagagacacctgaacaagaagggcaccgacctggacctggtggagcagctgaacatctacgaggtggccctgagacacgaggacggcgacgagaccaccgagcccccccccagcggctgcagagacagaagaagagccagcgtgtgcagcagcggcggcggcgagcacagaggcctggacagaagaagaagcagaagacacagcgtgcagagcatcaagagcaccctgagcgcccccaccagcccctgcagccagagcgcccccagcttcaagcccaaccaggtgagagacctgagagagaagtacagcaacttcggcaacaacagctaccacagcagcagacccagcagcggcagcagcgtgcccaccacccccaccagcagcgtgagccccccccaggaggccagactggagagaagcagccccagcggcctgctgaccagcagcttcagacagcaccaggagagcctggccgccgagagagagagaagaagacaggagagagaggagagactgcagagaatcgagagagaggagagaaacaagttcagcagagactacctggacaagagagaggagcagagacaggccagagaggagagatacaagtacctggagcagctggccgccgaggagcacgagaaggagctgagaagcagaagcgtgagcagaggcagagccgacctgagcctggacctgaccagccccgccgcccccgcctgcctggcccccctgagccacagccccagcagcagcgacagccaggaggccctgaccgtgagcgccagcagccccggcaccccccaccacccccaggccagcgccggcgaccccgagcccgagagcgaggccgagcccgaggccgaggccggcgccggccaggtggccgacgaggccggccaggacatcgccagcgcccacgagggcgccgagaccgaggtggagcaggccctggagcaggagcccgaggagagagccagcctgagcgagaaggagagacagaacgagggcgtgaacgagagagacaactgcagcgccagcagcgtgagcagcagcagcagcaccctggagagagaggagaaggaggacaagctgagcagagacagaaccaccggcctgtggcccgccggcgtgcaggacgccggcgtgaacggccagtgcggcgacatcctgaccaacaagagattcatgctggacatgctgtacgcccacaacagaaagagccccgacgacgaggagaagggcgacggcgaggccggcagaacccagcaggaggccgaggccgtggccagcctggccaccagaatcagcaccctgcaggccaacagccagacccaggacgagagcgtgagaagagtggacgtgggctgcctggacaacagaggcagcgtgaaggccttcgccgagaagttcaacagcggcgacctgggcagaggcagcatcagccccgacgccgagcccaacgacaaggtgcccgagaccgcccccgtgcagcccaagaccgagagcgactacatctgggaccagctgatggccaaccccagagagctgagaatccaggacatggacttcaccgacctgggcgaggaggacgacatcgacgtgctggacgtggacctgggccacagagaggcccccggccccccccccccccccccccccaccttcctgggcctgcccccccccccccccccccccctgctggacagcatcccccccccccccgtgcccggcaacctgctggtgccccccccccccgtgttcaacgccccccagggcctgggctggagccaggtgcccagaggccagcccaccttcaccaagaagaagaagaccatcagactgttctggaacgaggtgagacccttcgactggccctgcaagaacaacagaagatgcagagagttcctgtggagcaagctggagcccatcaaggtggacaccagcagactggagcacctgttcgagagcaagagcaaggagctgagcgtgagcaagaagaccgccgccgacggcaagagacaggagatcatcgtgctggacagcaagagaagcaacgccatcaacatcggcctgaccgtgctgcccccccccagaaccatcaagatcgccatcctgaacttcgacgagtacgccctgaacaaggagggcatcgagaagatcctgaccatgatccccaccgacgaggagaagcagaagatccaggaggcccagctggccaaccccgagatccccctgggcagcgccgagcagttcctgctgaccctgagcagcatcagcgagctgagcgccagactgcacctgtgggccttcaagatggactacgagaccaccgagaaggaggtggccgagcccctgctggacctgaaggagggcatcgaccagctggagaacaacaagaccctgggcttcatcctgagcaccctgctggccatcggcaacttcctgaacggcaccaacgccaaggccttcgagctgagctacctggagaaggtgcccgaggtgaaggacaccgtgcacaagcagagcctgctgcaccacgtgtgcaccatggtggtggagaacttccccgacagcagcgacctgtacagcgagatcggcgccatcaccagaagcgccaaggtggacttcgaccagctgcaggacaacctgtgccagatggagagaagatgcaaggccagctgggaccacctgaaggccatcgccaagcacgagatgaagcccgtgctgaagcagagaatgagcgagttcctgaaggactgcgccgagagaatcatcatcctgaagatcgtgcacagaagaatcatcaacagattccacagcttcctgctgttcatgggccaccccccctacgccatcagagaggtgaacatcaacaagttctgcagaatcatcagcgagttcgccctggagtacagaaccaccagagagagagtgctgcagcagaagcagaagagagccaaccacagagagagaaacaagaccagaggcaagatgatcaccgacagcggcaagttcagcggcagcagccccgccccccccagccagccccagggcctgagctacgccgaggacgccgccgagcacgagaacatgaaggccgtgctgaagaccagcagccccagcgtggaggacgccacccccgccctgggcgtgagaaccagaagcagagccagcagaggcagcaccagcagctggaccatgggcaccgacgacagccccaacgtgaccgacgacgccgccgacgagatcatggacagaatcgtgaagagcgccacccaggtgcccagccagagagtggtgcccagagagagaaagagaagcagagccaacagaaagagcctgagaagaaccctgaagagcggcctgacccccgaggaggccagagccctgggcctggtgggcaccagcgagctgcagctgtag

SEQ ID NO: 82010 - DNA, 4269 bp, Artificial Sequence
  Description of Artificial Sequence: Synthetic coding sequence
atggccaccctggcctgcagagtgcagttcctggacgacaccgaccccttcaacagcaccaacttccccgagcccagcagaccccccctgttcaccttcagagaggacctggccctgggcacccagctggccggcgtgcacagactgctgcaggccccccacaagctggacgactgcaccctgcagctgagccacaacggcgcctacctggacctggaggccaccctggccgagcagagagacgagctggagggcttccaggacgacgccggcagaggcaagaagcacagcatcatcctgagaacccagctgagcgtgagagtgcacgcctgcatcgagaagctgtacaacagcagcggcagagacctgagaagagccctgttcagcctgaagcagatcttccaggacgacaaggacctggtgcacgagttcgtggtggccgagggcctgacctgcctgatcaaggtgggcgccgaggccgaccagaactaccagaactacatcctgagagccctgggccagatcatgctgtacgtggacggcatgaacggcgtgatcaacagaaacgagaccatccagtggctgtacaccctgatcggcagcaagttcagactggtggtgaagaccgccctgaagctgctgctggtgttcgtggagtacagcgagagcaacgcccccctgctgatccaggccgtgaccgccgtggacaccaagagaggcgtgaagccctggagcaacatcatggagatcctggaggagaaggacggcgtggacaccgagctgctggtgtacgccatgaccctggtgaacaagaccctgagcggcctgcccgaccaggacaccttctacgacgtggtggactgcctggaggagctgggcatcgccgccgtgagccagagacacctgaacaagaagggcaccgacctggacctggtggagcagctgaacatctacgaggtggccctgagacacgaggacggcgacgagaccaccgagcccccccccagcggctgcagagacagaagaagagccagcgtgtgcagcagcggcggcggcgagcacagaggcctggacagaagaagaagcagaagacacagcgtgcagagcatcaagagcaccctgagcgcccccaccagcccctgcagccagagcgcccccagcttcaagcccaaccaggtgagagacctgagagagaagtacagcaacttcggcaacaacagctaccacagcagcagacccagcagcggcagcagcgtgcccaccacccccaccagcagcgtgagccccccccaggaggccagactggagagaagcagccccagcggcctgctgaccagcagcttcagacagcaccaggagagcctggccgccgagagagagagaagaagacaggagagagaggagagactgcagagaatcgagagagaggagagaaacaagttcagatacaagtacctggagcagctggccgccgaggagcacgagaaggagctgagaagcagaagcgtgagcagaggcagagccgacctgagcctggacctgaccagccccgccgcccccgcctgcctggcccccctgagccacagccccagcagcagcgacagccaggaggccctgaccgtgagcgccagcagccccggcaccccccaccacccccaggccagcgccggcgaccccgagcccgagagcgaggccgagcccgaggccgaggccggcgccggccaggtggccgacgaggccggccaggacatcgccagcgcccacgagggcgccgagaccgaggtggagcaggccctggagcaggagcccgaggagagagccagcctgagcgagaaggagagacagaacgagggcgtgaacgagagagacaactgcagcgccagcagcgtgagcagcagcagcagcaccctggagagagaggagaaggaggacaagctgagcagagacagaaccaccggcctgtggcccgccggcgtgcaggacgccggcgtgaacggccagtgcggcgacatcctgaccaacaagagattcatgctggacatgctgtacgcccacaacagaaagagccccgacgacgaggagaagggcgacggcgaggccggcagaacccagcaggaggccgaggccgtggccagcctggccaccagaatcagcaccctgcaggccaacagccagacccaggacgagagcgtgagaagagtggacgtgggctgcctggacaacagaggcagcgtgaaggccttcgccgagaagttcaacagcggcgacctgggcagaggcagcatcagccccgacgccgagcccaacgacaaggtgcccgagaccgcccccgtgcagcccaagaccgagagcgactacatctgggaccagctgatggccaaccccagagagctgagaatccaggacatggacttcaccgacctgggcgaggaggacgacatcgacgtgctggacgtggacctgggccacagagaggcccccggccccccccccccccccccccccaccttcctgggcctgcccccccccccccccccccccctgctggacagcatcccccccccccccgtgcccggcaacctgctggtgccccccccccccgtgttcaacgccccccagggcctgggctggagccaggtgcccagaggccagcccaccttcaccaagaagaagaagaccatcagactgttctggaacgaggtgagacccttcgactggccctgcaagaacaacagaagatgcagagagttcctgtggagcaagctggagcccatcaaggtggacaccagcagactggagcacctgttcgagagcaagagcaaggagctgagcgtgagcaagaagaccgccgccgacggcaagagacaggagatcatcgtgctggacagcaagagaagcaacgccatcaacatcggcctgaccgtgctgcccccccccagaaccatcaagatcgccatcctgaacttcgacgagtacgccctgaacaaggagggcatcgagaagatcctgaccatgatccccaccgacgaggagaagcagaagatccaggaggcccagctggccaaccccgagatccccctgggcagcgccgagcagttcctgctgaccctgagcagcatcagcgagctgagcgccagactgcacctgtgggccttcaagatggactacgagaccaccgagaaggaggtggccgagcccctgctggacctgaaggagggcatcgaccagctggagaacaacaagaccctgggcttcatcctgagcaccctgctggccatcggcaacttcctgaacggcaccaacgccaaggccttcgagctgagctacctggagaaggtgcccgaggtgaaggacaccgtgcacaagcagagcctgctgcaccacgtgtgcaccatggtggtggagaacttccccgacagcagcgacctgtacagcgagatcggcgccatcaccagaagcgccaaggtggacttcgaccagctgcaggacaacctgtgccagatggagagaagatgcaaggccagctgggaccacctgaaggccatcgccaagcacgagatgaagcccgtgctgaagcagagaatgagcgagttcctgaaggactgcgccgagagaatcatcatcctgaagatcgtgcacagaagaatcatcaacagattccacagcttcctgctgttcatgggccaccccccctacgccatcagagaggtgaacatcaacaagttctgcagaatcatcagcgagttcgccctggagtacagaaccaccagagagagagtgctgcagcagaagcagaagagagccaaccacagagagagaaacaagaccagaggcaagatgatcaccgacagcggcaagttcagcggcagcagccccgccccccccagccagccccagggcctgagctacgccgaggacgccgccgagcacgagaacatgaaggccgtgctgaagaccagcagccccagcgtggaggacgccacccccgccctgggcgtgagaaccagaagcagagccagcagaggcagcaccagcagctggaccatgggcaccgacgacagccccaacgtgaccgacgacgccgccgacgagatcatggacagaatcgtgaagagcgccacccaggtgcccagccagagagtggtgcccagagagagaaagagaagcagagccaacagaaagagcctgagaagaaccctgaagagcggcctgacccccgaggaggccagagccctgggcctggtgggcaccagcgagctgcagctgtag

SEQ ID NO: 82011 - DNA, 4206 bp, Artificial Sequence
  Description of Artificial Sequence: Synthetic coding sequence
atggccaccctggcctgcagagtgcagttcctggacgacaccgaccccttcaacagcaccaacttccccgagcccagcagaccccccctgttcaccttcagagaggacctggccctgggcacccagctggccggcgtgcacagactgctgcaggccccccacaagctggacgactgcaccctgcagctgagccacaacggcgcctacctggacctggaggccaccctggccgagcagagagacgagctggagggcttccaggacgacgccggcagaggcaagaagcacagcatcatcctgagaacccagctgagcgtgagagtgcacgcctgcatcgagaagctgtacaacagcagcggcagagacctgagaagagccctgttcagcctgaagcagatcttccaggacgacaaggacctggtgcacgagttcgtggtggccgagggcctgacctgcctgatcaaggtgggcgccgaggccgaccagaactaccagaactacatcctgagagccctgggccagatcatgctgtacgtggacggcatgaacggcgtgatcaacagaaacgagaccatccagtggctgtacaccctgatcggcagcaagttcagactggtggtgaagaccgccctgaagctgctgctggtgttcgtggagtacagcgagagcaacgcccccctgctgatccaggccgtgaccgccgtggacaccaagagaggcgtgaagccctggagcaacatcatggagatcctggaggagaaggacggcgtggacaccgagctgctggtgtacgccatgaccctggtgaacaagaccctgagcggcctgcccgaccaggacaccttctacgacgtggtggactgcctggaggagctgggcatcgccgccgtgagccagagacacctgaacaagaagggcaccgacctggacctggtggagcagctgaacatctacgaggtggccctgagacacgaggacggcgacgagaccaccgagcccccccccagcggctgcagagacagaagaagagccagcgtgtgcagcagcggcggcggcgagcacagaggcctggacagaagaagaagcagaagacacagcgtgcagagcatcaagagcaccctgagcgcccccaccagcccctgcagccagagcgcccccagcttcaagcccaaccaggtgagagacctgagagagaagagcagccccagcggcctgctgaccagcagcttcagacagcaccaggagagcctggccgccgagagagagagaagaagacaggagagagaggagagactgcagagaatcgagagagaggagagaaacaagttcagcagagactacctggacaagagagaggagcagagacaggccagagaggagagatacaagtacctggagcagctggccgccgaggagcacgagaaggagctgagaagcagaagcgtgagcagaggcagagccgacctgagcctggacctgaccagccccgccgcccccgcctgcctggcccccctgagccacagccccagcagcagcgacagccaggaggccctgaccgtgagcgccagcagccccggcaccccccaccacccccaggccagcgccggcgaccccgagcccgagagcgaggccgagcccgaggccgaggccggcgccggccaggtggccgacgaggccggccaggacatcgccagcgcccacgagggcgccgagaccgaggtggagcaggccctggagcaggagcccgaggagagagccagcctgagcgagaaggagagacagaacgagggcgtgaacgagagagacaactgcagcgccagcagcgtgagcagcagcagcagcaccctggagagagaggagaaggaggacaagctgagcagagacagaaccaccggcctgtggcccgccggcgtgcaggacgccggcgtgaacggccagtgcggcgacatcctgaccaacaagagattcatgctggacatgctgtacgcccacaacagaaagagccccgacgacgaggagaagggcgacggcgaggccggcagaacccagcaggaggccgaggccgtggccagcctggccaccagaatcagcaccctgcaggccaacagccagacccaggacgagagcgtgagaagagtggacgtgggctgcctggacaacagaggcagcgtgaaggccttcgccgagaagttcaacagcggcgacctgggcagaggcagcatcagccccgacgccgagcccaacgacaaggtgcccgagaccgcccccgtgcagcccaagaccgagagcgactacatctgggaccagctgatggccaaccccagagagctgagaatccaggacatggacttcaccgacctgggcgaggaggacgacatcgacgtgctggacgtggacctgggccacagagaggcccccggccccccccccccccccccccccaccttcctgggcctgcccccccccccccccccccccctgctggacagcatcccccccccccccgtgcccggcaacctgctggtgccccccccccccgtgttcaacgccccccagggcctgggctggagccaggtgcccagaggccagcccaccttcaccaagaagaagaagaccatcagactgttctggaacgaggtgagacccttcgactggccctgcaagaacaacagaagatgcagagagttcctgtggagcaagctggagcccatcaaggtggacaccagcagactggagcacctgttcgagagcaagagcaaggagctgagcgtgagcaagaagaccgccgccgacggcaagagacaggagatcatcgtgctggacagcaagagaagcaacgccatcaacatcggcctgaccgtgctgcccccccccagaaccatcaagatcgccatcctgaacttcgacgagtacgccctgaacaaggagggcatcgagaagatcctgaccatgatccccaccgacgaggagaagcagaagatccaggaggcccagctggccaaccccgagatccccctgggcagcgccgagcagttcctgctgaccctgagcagcatcagcgagctgagcgccagactgcacctgtgggccttcaagatggactacgagaccaccgagaaggaggtggccgagcccctgctggacctgaaggagggcatcgaccagctggagaacaacaagaccctgggcttcatcctgagcaccctgctggccatcggcaacttcctgaacggcaccaacgccaaggccttcgagctgagctacctggagaaggtgcccgaggtgaaggacaccgtgcacaagcagagcctgctgcaccacgtgtgcaccatggtggtggagaacttccccgacagcagcgacctgtacagcgagatcggcgccatcaccagaagcgccaaggtggacttcgaccagctgcaggacaacctgtgccagatggagagaagatgcaaggccagctgggaccacctgaaggccatcgccaagcacgagatgaagcccgtgctgaagcagagaatgagcgagttcctgaaggactgcgccgagagaatcatcatcctgaagatcgtgcacagaagaatcatcaacagattccacagcttcctgctgttcatgggccaccccccctacgccatcagagaggtgaacatcaacaagttctgcagaatcatcagcgagttcgccctggagtacagaaccaccagagagagagtgctgcagcagaagcagaagagagccaaccacagagagagaaacaagaccagaggcaagatgatcaccgacagcggcaagttcagcggcagcagccccgccccccccagccagccccagggcctgagctacgccgaggacgccgccgagcacgagaacatgaaggccgtgctgaagaccagcagccccagcgtggaggacgccacccccgccctgggcgtgagaaccagaagcagagccagcagaggcagcaccagcagctggaccatgggcaccgacgacagccccaacgtgaccgacgacgccgccgacgagatcatggacagaatcgtgaagagcgccacccaggtgcccagccagagagtggtgcccagagagagaaagagaagcagagccaacagaaagagcctgagaagaaccctgaagagcggcctgacccccgaggaggccagagccctgggcctggtgggcaccagcgagctgcagctgtag

SEQ ID NO: 82012 - DNA, 1053 bp, Artificial Sequence
  Description of Artificial Sequence: Synthetic coding sequence
atggagaccaacagcagcctgcccaccaacatcagcggcggcacccccgccgtgagcgccggctacctgttcctggacatcatcacctacctggtgttcgccgtgaccttcgtgctgggcgtgctgggcaacggcctggtgatctgggtggccggcttcagaatgacccacaccgtgaccaccatcagctacctgaacctggccgtggccgacttctgcttcaccagcaccctgcccttcttcatggtgagaaaggccatgggcggccactggcccttcggctggttcctgtgcaagttcgtgttcaccatcgtggacatcaacctgttcggcagcgtgttcctgatcgccctgatcgccctggacagatgcgtgtgcgtgctgcaccccgtgtggacccagaaccacagaaccgtgagcctggccaagaaggtgatcatcggcccctgggtgatggccctgctgctgaccctgcccgtgatcatcagagtgaccaccgtgcccggcaagaccggcaccgtggcctgcaccttcaacttcagcccctggaccaacgaccccaaggagagaatcaacgtggccgtggccatgctgaccgtgagaggcatcatcagattcatcatcggcttcagcgcccccatgagcatcgtggccgtgagctacggcctgatcgccaccaagatccacaagcagggcctgatcaagagcagcagacccctgagagtgctgagcttcgtggccgccgccttcttcctgtgctggagcccctaccaggtggtggccctgatcgccaccgtgagaatcagagagctgctgcagggcatgtacaaggagatcggcatcgccgtggacgtgaccagcgccctggccttcttcaacagctgcctgaaccccatgctgtacgtgttcatgggccaggacttcagagagagactgatccacgccctgcccgccagcctggagagagccctgaccgaggacagcacccagaccagcgacaccgccaccaacagcaccctgcccagcgccgaggtggagctgcaggccaagtag

SEQ ID NO: 82013 - DNA, 1053 bp, Artificial Sequence; identical to SEQ ID NO: 82012
  Description of Artificial Sequence: Synthetic coding sequence

SEQ ID NO: 82014 - DNA, 1056 bp, Artificial Sequence
  Description of Artificial Sequence: Synthetic coding sequence
atggagaccaacttcagcacccccctgaacgagtacgaggaggtgagctacgagagcgccggctacaccgtgctgagaatcctgcccctggtggtgctgggcgtgaccttcgtgctgggcgtgctgggcaacggcctggtgatctgggtggccggcttcagaatgaccagaaccgtgaccaccatctgctacctgaacctggccctggccgacttcagcttcaccgccaccctgcccttcctgatcgtgagcatggccatgggcgagaagtggcccttcggctggttcctgtgcaagctgatccacatcgtggtggacatcaacctgttcggcagcgtgttcctgatcggcttcatcgccctggacagatgcatctgcgtgctgcaccccgtgtgggcccagaaccacagaaccgtgagcctggccatgaaggtgatcgtgggcccctggatcctggccctggtgctgaccctgcccgtgttcctgttcctgaccaccgtgaccatccccaacggcgacacctactgcaccttcaacttcgccagctggggcggcacccccgaggagagactgaaggtggccatcaccatgctgaccgccagaggcatcatcagattcgtgatcggcttcagcctgcccatgagcatcgtggccatctgctacggcctgatcgccgccaagatccacaagaagggcatgatcaagagcagcagacccctgagagtgctgaccgccgtggtggccagcttcttcatctgctggttccccttccagctggtggccctgctgggcaccgtgtggctgaaggagatgctgttctacggcaagtacaagatcatcgacatcctggtgaaccccaccagcagcctggccttcttcaacagctgcctgaaccccatgctgtacgtgttcgtgggccaggacttcagagagagactgatccacagcctgcccaccagcctggagagagccctgagcgaggacagcgcccccaccaacgacaccgccgccaacagcgccagcccccccgccgagaccgagctgcaggccatgtag

SEQ ID NO: 82015 - DNA, 1056 bp, Artificial Sequence; identical to SEQ ID NO: 82014
  Description of Artificial Sequence: Synthetic coding sequence

SEQ ID NO: 82016 - DNA, 1062 bp, Artificial Sequence
  Description of Artificial Sequence: Synthetic coding sequence
atggagaccaacttcagcatccccctgaacgagaccgaggaggtgctgcccgagcccgccggccacaccgtgctgtggatcttcagcctgctggtgcacggcgtgaccttcgtgttcggcgtgctgggcaacggcctggtgatctgggtggccggcttcagaatgaccagaaccgtgaacaccatctgctacctgaacctggccctggccgacttcagcttcagcgccatcctgcccttcagaatggtgagcgtggccatgagagagaagtggcccttcggcagcttcctgtgcaagctggtgcacgtgatgatcgacatcaacctgttcgtgagcgtgtacctgatcaccatcatcgccctggacagatgcatctgcgtgctgcaccccgcctgggcccagaaccacagaaccatgagcctggccaagagagtgatgaccggcctgtggatcttcaccatcgtgctgaccctgcccaacttcatcttctggaccaccatcagcaccaccaacggcgacacctactgcatcttcaacttcgccttctggggcgacaccgccgtggagagactgaacgtgttcatcaccatggccaaggtgttcctgatcctgcacttcatcatcggcttcagcgtgcccatgagcatcatcaccgtgtgctacggcatcatcgccgccaagatccacagaaaccacatgatcaagagcagcagacccctgagagtgttcgccgccgtggtggccagcttcttcatctgctggttcccctacgagctgatcggcatcctgatggccgtgtggctgaaggagatgctgctgaacggcaagtacaagatcatcctggtgctgatcaaccccaccagcagcctggccttcttcaacagctgcctgaaccccatcctgtacgtgttcatgggcagaaacttccaggagagactgatcagaagcctgcccaccagcctggagagagccctgaccgaggtgcccgacagcgcccagaccagcaacaccgacaccaccagcgccagcccccccgaggagaccgagctgcaggccatgtag

SEQ ID NO: 82017 - DNA, 816 bp, Artificial Sequence
  Description of Artificial Sequence: Synthetic coding sequence
atgttcagagacttcggcgagcccggccccagcagcggcaacggcggcggctacggcggccccgcccagccccccgccgccgcccaggccgcccagcagaagttccacctggtgcccagcatcaacaccatgagcggcagccaggagctgcagtggatggtgcagccccacttcctgggccccagcagctaccccagacccctgacctacccccagtacagccccccccagcccagacccggcgtgatcagagccctgggccccccccccggcgtgagaagaagaccctgcgagcagatcagccccgaggaggaggagagaagaagagtgagaagagagagaaacaagctggccgccgccaagtgcagaaacagaagaaaggagctgaccgacttcctgcaggccgagaccgacaagctggaggacgagaagagcggcctgcagagagagatcgaggagctgcagaagcagaaggagagactggagctggtgctggaggcccacagacccatctgcaagatccccgagggcgccaaggagggcgacaccggcagcaccagcggcaccagcagcccccccgccccctgcagacccgtgccctgcatcagcctgagccccggccccgtgctggagcccgaggccctgcacacccccaccctgatgaccacccccagcctgacccccttcacccccagcctggtgttcacctaccccagcacccccgagccctgcgccagcgcccacagaaagagcagcagcagcagcggcgaccccagcagcgaccccctgggcagccccaccctgctggccctgtag

SEQ ID NO: 82018 - DNA, 510 bp, Artificial Sequence
  Description of Artificial Sequence: Synthetic coding sequence
atgttcagagacttcggcgagcccggccccagcagcggcaacggcggcggctacggcggccccgcccagccccccgccgccgcccaggccgcccagcaggagaccgacaagctggaggacgagaagagcggcctgcagagagagatcgaggagctgcagaagcagaaggagagactggagctggtgctggaggcccacagacccatctgcaagatccccgagggcgccaaggagggcgacaccggcagcaccagcggcaccagcagcccccccgccccctgcagacccgtgccctgcatcagcctgagccccggccccgtgctggagcccgaggccctgcacacccccaccctgatgaccacccccagcctgacccccttcacccccagcctggtgttcacctaccccagcacccccgagccctgcgccagcgcccacagaaagagcagcagcagcagcggcgaccccagcagcgaccccctgggcagccccaccctgctggccctgtag

SEQ ID NO: 82019 - DNA, 351 bp, Artificial Sequence
  Description of Artificial Sequence: Synthetic coding sequence
atgttcagagacttcggcgagcccggccccagcagcggcaacggcggcggctacggcggccccgcccagccccccgccgccgcccaggccgcccagcagaagttccacctggtgcccagcatcaacaccatgagcggcagccaggagctgcagtggatggtgcagccccacttcctgggccccagcagctaccccagacccctgacctacccccagtacagccccccccagcccagacccggcgtgatcagagccctgggccccccccccggcgtgagaagaagaccctgcgagcagatcagccccgaggaggaggagagctggcagcccagagacttcgtggacccctag

SEQ ID NO: 82020 - DNA, 981 bp, Artificial Sequence
  Description of Artificial Sequence: Synthetic coding sequence
atgtaccaggactaccccggcaacttcgacaccagcagcagaggcagcagcggcagccccgcccacgccgagagctacagcagcggcggcggcggccagcagaagttcagagtggacatgcccggcagcggcagcgccttcatccccaccatcaacgccatcaccaccagccaggacctgcagtggatggtgcagcccaccgtgatcaccagcatgagcaacccctaccccagaagccacccctacagccccctgcccggcctggccagcgtgcccggccacatggccctgcccagacccggcgtgatcaagaccatcggcaccaccgtgggcagaagaagaagagacgagcagctgagccccgaggaggaggagaagagaagaatcagaagagagagaaacaagctggccgccgccaagtgcagaaacagaagaagagagctgaccgagaagctgcaggccgagaccgaggagctggaggaggagaagagcggcctgcagaaggagatcgccgagctgcagaaggagaaggagaagctggagttcatgctggtggcccacggccccgtgtgcaagatcagccccgaggagagaagaagcccccccgcccccggcctgcagcccatgagaagcggcggcggcagcgtgggcgccgtggtggtgaagcaggagcccctggaggaggacagccccagcagcagcagcgccggcctggacaaggcccagagaagcgtgatcaagcccatcagcatcgccggcggcttctacggcgaggagcccctgcacacccccatcgtggtgaccagcacccccgccgtgacccccggcaccagcaacctggtgttcacctaccccagcgtgctggagcaggagagccccgccagccccagcgagagctgcagcaaggcccacagaagaagcagcagcagcggcgaccagagcagcgacagcctgaacagccccaccctgctggccctgtag

SEQ ID NO: 82021 - DNA, 864 bp, Artificial Sequence
  Description of Artificial Sequence: Synthetic coding sequence
atgcccggcagcggcagcgccttcatccccaccatcaacgccatcaccaccagccaggacctgcagtggatggtgcagcccaccgtgatcaccagcatgagcaacccctaccccagaagccacccctacagccccctgcccggcctggccagcgtgcccggccacatggccctgcccagacccggcgtgatcaagaccatcggcaccaccgtgggcagaagaagaagagacgagcagctgagccccgaggaggaggagaagagaagaatcagaagagagagaaacaagctggccgccgccaagtgcagaaacagaagaagagagctgaccgagaagctgcaggccgagaccgaggagctggaggaggagaagagcggcctgcagaaggagatcgccgagctgcagaaggagaaggagaagctggagttcatgctggtggcccacggccccgtgtgcaagatcagccccgaggagagaagaagcccccccgcccccggcctgcagcccatgagaagcggcggcggcagcgtgggcgccgtggtggtgaagcaggagcccctggaggaggacagccccagcagcagcagcgccggcctggacaaggcccagagaagcgtgatcaagcccatcagcatcgccggcggcttctacggcgaggagcccctgcacacccccatcgtggtgaccagcacccccgccgtgacccccggcaccagcaacctggtgttcacctaccccagcgtgctggagcaggagagccccgccagccccagcgagagctgcagcaaggcccacagaagaagcagcagcagcggcgaccagagcagcgacagcctgaacagccccaccctgctggccctgtag

SEQ ID NO: 82022 - DNA, 972 bp, Artificial Sequence
  Description of Artificial Sequence: Synthetic coding sequence
atggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactactgcgtggactgctacaagaacttcgtggccaagaagtgcgccggctgcaagaaccccatcaccggcaagagaaccgtgagcagagtgagccaccccgtgagcaaggccagaaagccccccgtgtgccacggcaagagactgcccctgaccctgttccccagcgccaacctgagaggcagacaccccggcggcgagagaacctgccccagctgggtggtggtgctgtacagaaagaacagaagcctggccgcccccagaggccccggcctggtgaaggcccccgtgtggtggcccatgaaggacaaccccggcaccaccaccgccagcaccgccaagaacgccccctag

SEQ ID NO: 82023 - DNA, 774 bp, Artificial Sequence
  Description of Artificial Sequence: Synthetic coding sequence
atggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactactgcgtggactgctacaagaacttcgtggccaagaagtgcgccggctgcaagaaccccatcaccggcttcggcaagggcagcagcgtggtggcctacgagggccagagctggcacgactactgcttccactgcaagaagtgcagcgtgtag

SEQ ID NO: 82024 - DNA, 633 bp, Artificial Sequence
  Description of Artificial Sequence: Synthetic coding sequence
atggccagccacagacacagcggccccagcagctacaaggtgggcaccatggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaagggcctggtgaaggcccccgtgtggtggcccatgaaggacaaccccggcaccaccaccgccagcaccgccaagaacgccccctag

SEQ ID NO: 82025 - DNA, 891 bp, Artificial Sequence
  Description of Artificial Sequence: Synthetic coding sequence
atggccagccacagacacagcggccccagcagctacaaggtgggcaccatggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactactgcgtggactgctacaagaacttcgtggccaagaagtgcgccggctgcaagaaccccatcaccggcttcggcaagggcagcagcgtggtggcctacgagggccagagctggcacgactactgcttccactgcaagaagtgcagcgtgaacctggccaacaagagattcgtgttccaccaggagcaggtgtactgccccgactgcgccaagaagctgtag

SEQ ID NO: 82026 - DNA, 843 bp, Artificial Sequence
  Description of Artificial Sequence: Synthetic coding sequence
atggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactactgcgtggactgctacaagaacttcgtggccaagaagtgcgccggctgcaagaaccccatcaccggcttcggcaagggcagcagcgtggtggcctacgagggccagagctggcacgactactgcttccactgcaagaagtgcagcgtgaacctggccaacaagagattcgtgttccaccaggagcaggtgtactgccccgactgcgccaagaagctgtag

SEQ ID NO: 82027 - DNA, 843 bp, Artificial Sequence; identical to SEQ ID NO: 82026
  Description of Artificial Sequence: Synthetic coding sequence

SEQ ID NO: 82028 - DNA, 972 bp, Artificial Sequence; identical to SEQ ID NO: 82022
  Description of Artificial Sequence: Synthetic coding sequence

SEQ ID NO: 82029 - DNA, 615 bp, Artificial Sequence
  Description of Artificial Sequence: Synthetic coding sequence
atggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggagtag

SEQ ID NO: 82030 - DNA, 624 bp, Artificial Sequence
  Description of Artificial Sequence: Synthetic coding sequence
atggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactag

SEQ ID NO: 82031 - DNA, 426 bp, Artificial Sequence
  Description of Artificial Sequence: Synthetic coding sequence
atggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttctag

SEQ ID NO: 82032 - DNA, 624 bp, Artificial Sequence; identical to SEQ ID NO: 82030
  Description of Artificial Sequence: Synthetic coding sequence

SEQ ID NO: 82033 - DNA, 963 bp, Artificial Sequence
  Description of Artificial Sequence: Synthetic coding sequence
atgagccacttcatcctgagacacctgggcagctgcttccagccctaccccgccttcgccgagtacatcctgagcgccacccaccccgccagcggccccagcagctacaaggtgggcaccatggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactactgcgtggactgctacaagaacttcgtggccaagaagtgcgccggctgcaagaaccccatcaccggcttcggcaagggcagcagcgtggtggcctacgagggccagagctggcacgactactgcttccactgcaagaagtgcagcgtgaacctggccaacaagagattcgtgttccaccaggagcaggtgtactgccccgactgcgccaagaagctgtag

SEQ ID NO: 82034 - DNA, 618 bp, Artificial Sequence
  Description of Artificial Sequence: Synthetic coding sequence
atggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggactag

SEQ ID NO: 82035 - DNA, 468 bp, Artificial Sequence
  Description of Artificial Sequence: Synthetic coding sequence
atggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagtag

SEQ ID NO: 82036 - DNA, 843 bp, Artificial Sequence; identical to SEQ ID NO: 82026
  Description of Artificial Sequence: Synthetic coding sequence

SEQ ID NO: 82037 - DNA, 783 bp, Artificial Sequence
  Description of Artificial Sequence: Synthetic coding sequence
atggccgagaagttcgactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactactgcgtggactgctacaagaacttcgtggccaagaagtgcgccggctgcaagaaccccatcaccggcttcggcaagggcagcagcgtggtggcctacgagggccagagctggcacgactactgcttccactgcaagaagtgcagcgtgaacctggccaacaagagattcgtgttccaccaggagcaggtgtactgccccgactgcgccaagaagctgtag

SEQ ID NO: 82038 - DNA, 930 bp, Artificial Sequence
  Description of Artificial Sequence: Synthetic coding sequence
atgaccttctacgtggccagcctggccctggagctgatctggatgctgagcagccccgccggccccagcagctacaaggtgggcaccatggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcctgcaccccctggccaacgagaccttcgtggccaaggacaacaagatcctgtgcaacaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactactgcgtggactgctacaagaacttcgtggccaagaagtgcgccggctgcaagaaccccatcaccggcttcggcaagggcagcagcgtggtggcctacgagggccagagctggcacgactactgcttccactgcaagaagtgcagcgtgaacctggccaacaagagattcgtgttccaccaggagcaggtgtactgccccgactgcgccaagaagctgtag

SEQ ID NO: 82039 - DNA, 828 bp, Artificial Sequence
  Description of Artificial Sequence: Synthetic coding sequence
atggccagccacagacacagcggccccagcagctacaaggtgggcaccatggccgagaagttcgactgccactactgcagagaccccctgcagggcaagaagtacgtgcagaaggacggccaccactgctgcctgaagtgcttcgacaagttctgcgccaacacctgcgtggagtgcagaaagcccatcggcgccgacagcaaggaggtgcactacaagaacagattctggcacgacacctgcttcagatgcgccaagtgcaccaccagagaggacagccccaagtgcaagggctgcttcaaggccatcgtggccggcgaccagaacgtggagtacaagggcaccgtgtggcacaaggactgcttcacctgcagcaactgcaagcaggtgatcggcaccggcagcttcttccccaagggcgaggacttctactgcgtgacctgccacgagaccaagttcgccaagcactgcgtgaagtgcaacaaggccatcaccagcggcggcatcacctaccaggaccagccctggcacgccgactgcttcgtgtgcgtgacctgcagcaagaagctggccggccagagattcaccgccgtggaggaccagtactactgcgtggactgctacaagaacttcgtggccaagaagtgcgccggctgcaagaaccccatcaccggcttcggcaagggcagcagcgtggtggcctacgagggccagagctggcacgactactgcttccactgcaagaagtgcagcgtgaacctggccaacaagagattcgtgttccaccaggagcaggtgtactgccccgactgcgccaagaagctgtag

SEQ ID NO: 82040 - DNA, 843 bp, Artificial Sequence; identical to SEQ ID NO: 82026
  Description of Artificial Sequence: Synthetic coding sequence

SEQ ID NO: 82041 - DNA, 840 bp, Artificial Sequence
  Description of Artificial Sequence: Synthetic coding sequence
atgaccgagagattcgactgccaccactgcaacgagagcctgttcggcaagaagtacatcctgagagaggagagcccctactgcgtggtgtgcttcgagaccctgttcgccaacacctgcgaggagtgcggcaagcccatcggctgcgactgcaaggacctgagctacaaggacagacactggcacgaggcctgcttccactgcagccagtgcagaaacagcctggtggacaagcccttcgccgccaaggaggaccagctgctgtgcaccgactgctacagcaacgagtacagcagcaagtgccaggagtgcaagaagaccatcatgcccggcaccagaaagatggagtacaagggcagcagctggcacgagacctgcttcatctgccacagatgccagcagcccatcggcaccaagagcttcatccccaaggacaaccagaacttctgcgtgccctgctacgagaagcagcacgccatgcagtgcgtgcagtgcaagaagcccatcaccaccggcggcgtgacctacagagagcagccctggcacaaggagtgcttcgtgtgcaccgcctgcagaaagcagctgagcggccagagattcaccgccagagacgacttcgcctactgcctgaactgcttctgcgacctgtacgccaagaagtgcgccggctgcaccaaccccatcagcggcctgggcggcaccaagtacatcagcttcgaggagagacagtggcacaacgactgcttcaactgcaagaagtgcagcctgagcctggtgggcagaggcttcctgaccgagagagacgacatcctgtgccccgactgcggcaaggacatctag

SEQ ID NO: 82042 - DNA, 456 bp, Artificial Sequence
  Description of Artificial Sequence: Synthetic coding sequence
atgaccgagagattcgactgccaccactgcaacgagagcctgttcggcaagaagtacatcctgagagaggagagcccctactgcgtggtgtgcttcgagaccctgttcgccaacacctgcgaggagtgcggcaagcccatcggctgcgactgcaaggtgcccgccagatggagcaccagagccgccgccggcatgagacccgccagcagcgccaccgccgccagcagccagctggagcccagagtgagcagccccaagaccatcagaatcagcgtgtgccccgccatgagaaacaacatgccctgcagcgccttcagcgccaagagccccagccccagagagggcagcctgaccggcagcagccccggcaccagaagcgccagctgcgccccccccgccggcagcagctgcctgggcagcgccagccagctggccatgaccctgcccaccgcctag

SEQ ID NO: 82043 - DNA, 1170 bp, Artificial Sequence
  Description of Artificial Sequence: Synthetic coding sequence
atgaccagaagaggcttcagcagagccggcgccgcccagagaagcaccagacccgccgccgagccccagccccccgccgccagagccctgcagcccagacccggcgtgcccggccccctgagatgcagagagtacctgcagccccccgcccccagaagagaggccgagggcctgagccaccagggcagcgaggtgggcgccgagagcggcgccagacccaaggagagaggcgccgagcccgagctgggcagactgtggctgagaaccgtgagcagctggagactgggctggcacttcgacttcggcgtggccgagaagcccggcgtgaagatgaccgagagattcgactgccaccactgcaacgagagcctgttcggcaagaagtacatcctgagagaggagagcccctactgcgtggtgtgcttcgagaccctgttcgccaacacctgcgaggagtgcggcaagcccatcggctgcgactgcaaggacctgagctacaaggacagacactggcacgaggcctgcttccactgcagccagtgcagaaacagcctggtggacaagcccttcgccgccaaggaggaccagctgctgtgcaccgactgctacagcaacgagtacagcagcaagtgccaggagtgcaagaagaccatcatgcccggcaccagaaagatggagtacaagggcagcagctggcacgagacctgcttcatctgccacagatgccagcagcccatcggcaccaagagcttcatccccaaggacaaccagaacttctgcgtgccctgctacgagaagcagcacgccatgcagtgcgtgcagtgcaagaagcccatcaccaccggcggcgtgacctacagagagcagccctggcacaaggagtgcttcgtgtgcaccgcctgcagaaagcagctgagcggccagagattcaccgccagagacgacttcgcctactgcctgaactgcttctgcgacctgtacgccaagaagtgcgccggctgcaccaaccccatcagcggcctgggcggcaccaagtacatcagcttcgaggagagacagtggcacaacgactgcttcaactgcaagaagtgcagcctgagcctggtgggcagaggcttcctgaccgagagagacgacatcctgtgccccgactgcggcaaggacatctag

SEQ ID NO: 82044 - DNA, 840 bp, Artificial Sequence; identical to SEQ ID NO: 82041
  Description of Artificial Sequence: Synthetic coding sequence

SEQ ID NO: 82045 - DNA, 840 bp, Artificial Sequence; identical to SEQ ID NO: 82041
  Description of Artificial Sequence: Synthetic coding sequence

SEQ ID NO: 82046 - DNA, 840 bp, Artificial Sequence; identical to SEQ ID NO: 82041
  Description of Artificial Sequence: Synthetic coding sequence

SEQ ID NO: 82047 - DNA, 840 bp, Artificial Sequence; identical to SEQ ID NO: 82041
  Description of Artificial Sequence: Synthetic coding sequence

SEQ ID NO: 82048 - DNA, 840 bp, Artificial Sequence; identical to SEQ ID NO: 82041
  Description of Artificial Sequence: Synthetic coding sequence

SEQ ID NO: 82049 - DNA, 840 bp, Artificial Sequence; identical to SEQ ID NO: 82041
  Description of Artificial Sequence: Synthetic coding sequence

SEQ ID NO: 82050 - DNA, 60 bp, Artificial Sequence
  Description of Artificial Sequence: Synthetic coding sequence
atgaccgagagattcgactgccaccactgcaacgagagcctgttcggcaagaagtactag

SEQ ID NO: 82051 - DNA, 435 bp, Artificial Sequence
  Description of Artificial Sequence: Synthetic coding sequence
atgaccagaagaggcttcagcagagccggcgccgcccagagaagcaccagacccgccgccgagccccagccccccgccgccagagccctgcagcccagacccggcgtgcccggccccctgagatgcagagagtacctgcagccccccgcccccagaagagaggccgagggcctgagccaccagggcagcgaggtgggcgccgagagcggcgccagacccaaggagagaggcgccgagcccgagctgggcagactgtggctgagaaccgtgagcagctggagactgggctggcacttcgacttcggcaccgagagcagattcgtggcccaggccggcgtgcagtggcacgacctgagcagcctgcaggccctgcccctgggcagcagacacagccccgcccccgccagccaggtggccggcaccaccggctgctag

SEQ ID NO: 82052 - DNA, 843 bp, Artificial Sequence
  Description of Artificial Sequence: Synthetic coding sequence
atgagcgagagcttcgactgcgccaagtgcaacgagagcctgtacggcagaaagtacatccagaccgacagcggcccctactgcgtgccctgctacgacaacaccttcgccaacacctgcgccgagtgccagcagctgatcggccacgacagcagagagctgttctacgaggacagacacttccacgagggctgcttcagatgctgcagatgccagagaagcctggccgacgagcccttcacctgccaggacagcgagctgctgtgcaacgactgctactgcagcgccttcagcagccagtgcagcgcctgcggcgagaccgtgatgcccggcagcagaaagctggagtacggcggccagacctggcacgagcactgcttcctgtgcagcggctgcgagcagcccctgggcagcagaagcttcgtgcccgacaagggcgcccactactgcgtgccctgctacgagaacaagttcgcccccagatgcgccagatgcagcaagaccctgacccagggcggcgtgacctacagagaccagccctggcacagagagtgcctggtgtgcaccggctgccagacccccctggccggccagcagttcaccagcagagacgaggacccctactgcgtggcctgcttcggcgagctgttcgcccccaagtgcagcagctgcaagagacccatcgtgggcctgggcggcggcaagtacgtgagcttcgaggacagacactggcaccacaactgcttcagctgcgccagatgcagcaccagcctggtgggccagggcttcgtgcccgacggcgaccaggtgctgtgccagggctgcagccaggccggcccctag

SEQ ID NO: 82053 - DNA, 855 bp, Artificial Sequence
  Description of Artificial Sequence: Synthetic coding sequence
atgaccaccgcccacttctactgccagtactgcaccgccagcctgctgggcaagaagtacgtgctgaaggacgacagcccctactgcgtgacctgctacgacagagtgttcagcaactactgcgaggagtgcaagaagcccatcgagagcgacagcaaggacctgtgctacaaggacagacactggcacgagggctgcttcaagtgcaccaagtgcaaccacagcctggtggagaagcccttcgccgccaaggacgagagactgctgtgcaccgagtgctacagcaacgagtgcagcagcaagtgcttccactgcaagagaaccatcatgcccggcagcagaaagatggagttcaagggcaactactggcacgagacctgcttcgtgtgcgagaactgcagacagcccatcggcaccaagcccctgatcagcaaggagagcggcaactactgcgtgccctgcttcgagaaggagttcgcccactactgcaacttctgcaagaaggtgatcaccagcggcggcatcaccttctgcgaccagctgtggcacaaggagtgcttcctgtgcagcggctgcagaaaggacctgtgcgaggagcagttcatgagcagagacgactaccccttctgcgtggactgctacaaccacctgtacgccaacaagtgcgtggcctgcagcaagcccatcagcggcctgaccggcgccaagttcatctgcttccaggacagccagtggcacagcgagtgcttcaactgcggcaagtgcagcgtgagcctggtgggcaagggcttcctgacccagaacaaggagatcttctgccagaagtgcggcagcggcatggacaccgacatctag

SEQ ID NO: 82054 - DNA, 633 bp, Artificial Sequence
  Description of Artificial Sequence: Synthetic coding sequence
atgaccaccgcccacttctactgccagtactgcaccgccagcctgctgggcaagaagtacgtgctgaaggacgacagcccctactgcgtgacctgctacgacagagtgttcagcaactactgcgaggagtgcaagaagcccatcgagagcgacagcaaggacctgtgctacaaggacagacactggcacgagggctgcttcaagtgcaccaagtgcaaccacagcctggtggagaagcccttcgccgccaaggacgagagactgctgtgcaccgagtgctacagcaacgagtgcagcagcaagtgcttccactgcaagagaaccatcatgcccggcagcagaaagatggagttcaagggcaactactggcacgagacctgcttcgtgtgcgagaactgcagacagcccatcggcaccaagcccctgatcagcaaggagagcggcaactactgcgtgccctgcttcgagaaggagttcgcccactactgcaacttctgcaagaaggtgatcaccagcggcggcatcaccttctgcgaccagctgtggcacaaggagtgcttcctgtgcagcggctgcagaaaggacctgtgcgaggagcagttcatgagcagagacgactaccccttctgctag

SEQ ID NO: 82055 - DNA, 855 bp, Artificial Sequence; identical to SEQ ID NO: 82053
  Description of Artificial Sequence: Synthetic coding sequence

SEQ ID NO: 82056 - DNA, 1314 bp, Artificial Sequence
  Description of Artificial Sequence: Synthetic coding sequence
atgggcagaagaatgagaggcgccgccgccaccgccggcctgtggctgctggccctgggcagcctgctggccctgtggggcggcctgctgccccccagaaccgagctgcccgccagcagaccccccgaggacagactgcccagaagacccgccagaagcggcggccccgcccccgcccccagattccccctgcccccccccctggcctgggacgccagaggcggcagcctgaagaccttcagagccctgctgaccctggccgccggcgccgacggcccccccagacagagcagaagcgagcccagatggcacgtgagcgccagacagcccagacccgaggagagcgccgccgtgcacggcggcgtgttctggagcagaggcctggaggagcaggtgccccccggcttcagcgaggcccaggccgccgcctggctggaggccgccagaggcgccagaatggtggccctggagagaggcggctgcggcagaagcagcaacagactggccagattcgccgacggcaccagagcctgcgtgagatacggcatcaaccccgagcagatccagggcgaggccctgagctactacctggccagactgctgggcctgcagagacacgtgccccccctggccctggccagagtggaggccagaggcgcccagtgggcccaggtgcaggaggagctgagagccgcccactggaccgagggcagcgtggtgagcctgaccagatggctgcccaacctgaccgacgtggtggtgcccgccccctggagaagcgaggacggcagactgagacccctgagagacgccggcggcgagctggccaacctgagccaggccgagctggtggacctggtgcagtggaccgacctgatcctgttcgactacctgaccgccaacttcgacagactggtgagcaacctgttcagcctgcagtgggaccccagagtgatgcagagagccaccagcaacctgcacagaggccccggcggcgccctggtgttcctggacaacgaggccggcctggtgcacggctacagagtggccggcatgtgggacaagtacaacgagcccctgctgcagagcgtgtgcgtgttcagagagagaaccgccagaagagtgctggagctgcacagaggccaggacgccgccgccagactgctgagactgtacagaagacacgagcccagattccccgagctggccgccctggccgacccccacgcccagctgctgcagagaagactggacttcctggccaagcacatcctgcactgcaaggccaagtacggcagaagaagcggcacctag

SEQ ID NO: 82057 - DNA, 312 bp, Artificial Sequence
  Description of Artificial Sequence: Synthetic coding sequence
atggagagacagcagcagcagcagcagcagctgagaaacctgagagacttcctgctggtgtacaacagaatgaccgagctgtgcttccagagatgcgtgcccagcctgcaccacagagccctggacgccgaggaggaggcctgcctgcacagctgcgccggcaagctgatccacagcaaccacagactgatggccgcctacgtgcagctgatgcccgccctggtgcagagaagaatcgccgactacgaggccgccagcgccgtgcccggcgtggccgccgagcagcccggcgtgagccccagcggcagctag

SEQ ID NO: 82058 - DNA, 312 bp, Artificial Sequence; identical to SEQ ID NO: 82057
  Description of Artificial Sequence: Synthetic coding sequence

SEQ ID NO: 82059 - DNA, 312 bp, Artificial Sequence; identical to SEQ ID NO: 82057
  Description of Artificial Sequence: Synthetic coding sequence

SEQ ID NO: 82060 - DNA, 948 bp, Artificial Sequence
  Description of Artificial Sequence: Synthetic coding sequence
atgcacggccacggcggctacgacagcgacttcagcgacgacgagagatgcggcgagagcagcaagagaaagaagagaaccgtggaggacgacctgctgctgcagaagcccttccagaaggagaagcacggcaaggtggcccacaagcaggtggccgccgagctgctggacagagaggaggccagaaacagaagattccacctgatcgccatggacgcctaccagagacacaccaagttcgtgaacgactacatcctgtactacggcggcaagaaggaggacttcaagagactgggcgagaacgacaagaccgacctggacgtgatcagagagaaccacagattcctgtggaacgaggaggacgagatggacatgacctgggagaagagactggccaagaagtactacgacaagctgttcaaggagtactgcatcgccgacctgagcaagtacaaggagaacaagttcggcttcagatggagagtggagaaggaggtgatcagcggcaagggccagttcttctgcggcaacaagtactgcgacaagaaggagggcctgaagagctgggaggtgaacttcggctacatcgagcacggcgagaagagaaacgccctggtgaagctgagactgtgccaggagtgcagcatcaagctgaacttccaccacagaagaaaggagatcaagagcaagaagagaaaggacaagaccaagaaggactgcgaggagagcagccacaagaagagcagactgagcagcgccgaggaggccagcaagaagaaggacaagggccacagcagcagcaagaagagcgaggacagcctgctgagaaacagcgacgaggaggagagcgccagcgagagcgagctgtggaagggccccctgcccgagaccgacgagaagagccaggaggaggagttcgacgagtacttccaggacctgttcctgtag

SEQ ID NO: 82061 - DNA, 948 bp, Artificial Sequence
  Description of Artificial Sequence: Synthetic coding sequence
atgcacggccacggcggctacgacagcgacttcagcgacgacgagagatgcggcgagagcagcaagagaaagaagagaaccgtggaggacgacctgctgctgcagaagcccttccagaaggagaagcacggcaaggtggcccacaagcaggtggccgccgagctgctggacagagaggaggccagaaacagaagattccacctgatcgccatggacgcctaccagagacacaccaagttcgtgaacgactacatcctgtactacggcggcaagaaggaggacttcaagagactgggcgagaacgacaagaccgacctggacgtgatcagagagaaccacagattcctgtggaacgaggaggacgagatggacatgacctgggagaagagactggccaagaagtactacgacaagctgttcaaggagtactgcatcgccgacctgagcaagtacaaggagaacaagttcggcttcagatggagagtggagaaggaggtgatcagcggcaagggccagttcttctgcggcaacaagtactgcgacaagaaggagggcctgaagagctgggaggtgaacttcggctacatcgagcacggcgagaagagaaacgccctggtgaagctgagactgtgccaggagtgcagcatcaagctgaacttccaccacagaagaaaggagatcaagagcaagaagagaaaggacaagaccaagaaggactgcgaggagagcagccacaagaagagcagactgagcagcgccgaggaggccagcaagaagaaggacaagggccacagcagcagcaagaagagcgaggacagcctgctgagaagaatgctggaggagctgcagatgttcacctgggagaagagcgagagaatgggcggcaagagactgatcatcatcatcggcgaggagctgagcgccaacgtgaccaccttcaagatgtag

SEQ ID NO: 82062 - DNA, 942 bp, Artificial Sequence
  Description of Artificial Sequence: Synthetic coding sequence
atgcacggccacggcggctacgacagcgacttcagcgacgacgagagatgcggcgagagcagcaagagaaagaagagaaccgtggaggacgacctgctgctgcagaagcccttccagaaggagaagcacggcaaggtggcccacaagcaggtggccgccgagctgctggacagagaggaggccagaaacagaagattccacctgatcgccatggacgcctaccagagacacaccaagttcgtgaacgactacatcctgtactacggcggcaagaaggaggacttcaagagactgggcgagaacgacaagaccgacctggacgtgatcagagagaaccacagattcctgtggaacgaggaggacgagatggacatgacctgggagaagagactggccaagaagtactacgacaagctgttcaaggagtactgcatcgccgacctgagcaagtacaaggagaacaagttcggcttcagatggagagtggagaaggaggtgatcagcggcaagggccagttcttctgcggcaacaagtactgcgacaagaaggagggcctgaagagctgggaggtgaacttcggctacatcgagcacggcgagaagagaaacgccctggtgaagctgagactgtgccaggagtgcagcatcaagctgaacttccaccacagaagaaaggagatcaagagcaagaagagaaaggacaagaccaagaaggactgcgaggagagcagccacaagaagagcagactgagcagcgccgaggaggccagcaagaagaaggacaagggccacagcagcagcaagaagagcgaggacagcctgctgaacggcgtgatgctgttccaccccggctggagcgccgtggccagaagccagctgaccgccgcccccgccagccaggtgcagaccaacaaccactactggagaggcgtggtgtgctag

SEQ ID NO: 82063 - DNA, 879 bp, Artificial Sequence
  Description of Artificial Sequence: Synthetic coding sequence
atgcacggccacggcggctacgacagcgacttcagcgacgacgagagatgcggcgagagcagcaagagaaagaagagaaccgtggaggacgacctgctgctgcagaagcccttccagaaggagaagcacggcaaggtggcccacaagcaggtggccgccgagctgctggacagagaggaggccagaaacagaagattccacctgatcgccatggacgcctaccagagacacaccaagttcgtgaacgactacatcctgtactacggcggcaagaaggaggacttcaagagactgggcgagaacgacaagaccgacctggacgtgatcagagagaaccacagattcctgtggaacgaggaggacgagatggacatgacctgggagaagagactggccaagaagtactacgacaagctgttcaaggagtactgcatcgccgacctgagcaagtacaaggagaacaagttcggcttcagatggagagtggagaaggaggtgatcagcggcaagggccagttcttctgcggcaacaagtactgcgacaagaaggagggcctgaagagctgggaggtgaacttcggctacatcgagcacggcgagaagagaaacgccctggtgaagctgagactgtgccaggagtgcagcatcaagctgaacttccaccacagaagaaaggagatcaagagcaagaagagaaaggacaagaccaagaaggactgcgaggagagcagccacaagaagagcagactgagcagcgccgaggaggccagcaagaagaaggacaagggccacagcagcagcaagaagagcgaggacagcctgctgaagacctacttcgtgggcctgctgagcgagagcaacgagaagacctacatgtag

SEQ ID NO: 82064 - DNA, 831 bp, Artificial Sequence
  Description of Artificial Sequence: Synthetic coding sequence
atgcacggccacggcggctacgacagcgacttcagcgacgacgagagatgcggcgagagcagcaagagaaagaagagaaccgtggaggacgacctgctgctgcagaagcccttccagaaggagaagcacggcaaggtggcccacaagcaggtggccgccgagctgctggacagagaggaggccagaaacagaagattccacctgatcgccatggacgcctaccagagacacaccaagttcgtgaacgactacatcctgtactacggcggcaagaaggaggacttcaagagactgggcgagaacgacaagaccgacctggacgtgatcagagagaaccacagattcctgtggaacgaggaggacgagatggacatgacctgggagaagagactggccaagaagtactacgacaagctgttcaaggagtactgcatcgccgacctgagcaagtacaaggagaacaagttcggcttcagatggagagtggagaaggaggtgatcagcggcaagggccagttcttctgcggcaacaagtactgcgacaagaaggagggcctgaagagctgggaggtgaacttcggctacatcgagcacggcgagaagagaaacgccctggtgaagctgagactgtgccaggagtgcagcatcaagctgaacttccaccacagaagaaaggagatcaagagcaagaagagaaaggacaagaccaagaaggactgcgaggagagcagccacaagaagagcagactgagcagcgccgaggaggccagcaagaagaaggacaagggccacagcagcagcaagaagagcgaggacagcctgctgaactag

SEQ ID NO: 82065 - DNA, 978 bp, Artificial Sequence
  Description of Artificial Sequence: Synthetic coding sequence
atgggcatcttccccggcatcatcctgatcttcctgagagtgaagttcgccaccgccgccgtgatcgtgagcggccaccagaagagcaccaccgtgagccacgagatgagcggcctgaactggaagcccttcgtgtacggcggcctggccagcatcgtggccgagttcggcaccttccccgtggacctgaccaagaccagactgcaggtgcagggccagagcatcgacgccagattcaaggagatcaagtacagaggcatgttccacgccctgttcagaatctgcaaggaggagggcgtgctggccctgtacagcggcatcgcccccgccctgctgagacaggccagctacggcaccatcaagatcggcatctaccagagcctgaagagactgttcgtggagagactggaggacgagaccctgctgatcaacatgatctgcggcgtggtgagcggcgtgatcagcagcaccatcgccaaccccaccgacgtgctgaagatcagaatgcaggcccagggcagcctgttccagggcagcatgatcggcagcttcatcgacatctaccagcaggagggcaccagaggcctgtggagaggcgtggtgcccaccgcccagagagccgccatcgtggtgggcgtggagctgcccgtgtacgacatcaccaagaagcacctgatcctgagcggcatgatgggcgacaccatcctgacccacttcgtgagcagcttcacctgcggcctggccggcgccctggccagcaaccccgtggacgtggtgagaaccagaatgatgaaccagagagccatcgtgggccacgtggacctgtacaagggcaccgtggacggcatcctgaagatgtggaagcacgagggcttcttcgccctgtacaagggcttctggcccaactggctgagactgggcccctggaacatcatcttcttcatcacctacgagcagctgaagagactgcagatctag

SEQ ID NO: 82066 - DNA, 894 bp, Artificial Sequence
  Description of Artificial Sequence: Synthetic coding sequence
atggaggagctggtggtggaggtgagaggcagcaacggcgccttctacaaggccttcgtgaaggacgtgcacgaggacagcatcaccgtggccttcgagaacaactggcagcccgacagacagatccccttccacgacgtgagattccccccccccgtgggctacaacaaggacatcaacgagagcgacgaggtggaggtgtacagcagagccaacgagaaggagccctgctgctggtggctggccaaggtgagaatgatcaagggcgagttctacgtgatcgagtacgccgcctgcgacgccacctacaacgagatcgtgaccatcgagagactgagaagcgtgaaccccaacaagcccgccaccaaggacaccttccacaagatcaagctggacgtgcccgaggacctgagacagatgtgcgccaaggaggccgcccacaaggacttcaagaaggccgtgggcgccttcagcgtgacctacgaccccgagaactaccagctggtgatcctgagcatcaacgaggtgaccagcaagagagcccacatgctgatcgacatgcacttcagaagcctgagaaccaagctgagcctgatcatgagaaacgaggaggccagcaagcagctggagagcagcagacagctggccagcagattccacgagcagttcatcgtgagagaggacctgatgggcctggccatcggcacccacggcgccaacatccagcaggccagaaaggtgcccggcgtgaccgccatcgacctggacgaggacacctgcaccttccacatctacggcgaggaccaggacgccgtgaagaaggccagaagcttcctggagttcgccgaggacgtgatccaggtgcccagaaacctggtgggcctgaagatctag

SEQ ID NO: 82067 - DNA, 1773 bp, Artificial Sequence
  Description of Artificial Sequence: Synthetic coding sequence
atggaggagctggtggtggaggtgagaggcagcaacggcgccttctacaaggccttcgtgaaggacgtgcacgaggacagcatcaccgtggccttcgagaacaactggcagcccgacagacagatccccttccacgacgtgagattccccccccccgtgggctacaacaaggacatcaacgagagcgacgaggtggaggtgtacagcagagccaacgagaaggagccctgctgctggtggctggccaaggtgagaatgatcaagggcgagttctacgtgatcgagtacgccgcctgcgacgccacctacaacgagatcgtgaccatcgagagactgagaagcgtgaaccccaacaagcccgccaccaaggacaccttccacaagatcaagctggacgtgcccgaggacctgagacagatgtgcgccaaggaggccgcccacaaggacttcaagaaggccgtgggcgccttcagcgtgacctacgaccccgagaactaccagctggtgatcctgagcatcaacgaggtgaccagcaagagagcccacatgctgatcgacatgcacttcagaagcctgagaaccaagctgagcctgatcatgagaaacgaggaggccagcaagcagctggagagcagcagacagctggccagcagattccacgagcagttcatcgtgagagaggacctgatgggcctggccatcggcacccacggcgccaacatccagcaggccagaaaggtgcccggcgtgaccgccatcgacctggacgaggacacctgcaccttccacatctacggcgaggaccaggacgccgtgaagaaggccagaagcttcctggagttcgccgaggacgtgatccaggtgcccagaaacctggtgggcaaggtgatcggcaagaacggcaagctgatccaggagatcgtggacaagagcggcgtggtgagagtgagaatcgaggccgagaacgagaagaacgtgccccaggaggaggagatcatgccccccaacagcctgcccagcaacaacagcagagtgggccccaacgcccccgaggagaagaagcacctggacatcaaggagaacagcacccacttcagccagcccaacagcaccaaggtgcagagagtgctggtggccagcagcgtggtggccggcgagagccagaagcccgagctgaaggcctggcagggcatggtgcccttcgtgttcgtgggcaccaaggacagcatcgccaacgccaccgtgctgctggactaccacctgaactacctgaaggaggtggaccagctgagactggagagactgcagatcgacgagcagctgagacagatcggcgccagcagcagacccccccccaacagaaccgacaaggagaagagctacgtgaccgacgacggccagggcatgggcagaggcagcagaccctacagaaacagaggccacggcagaagaggccccggctacaccagcgcccccaccgaggaggagagagagagcttcctgagaagaggcgacggcagaagaagaggcggcggcggcagaggccagggcggcagaggcagaggcggcggcttcaagggcaacgacgaccacagcagaaccgacaacagacccagaaaccccagagaggccaagggcagaaccaccgacggcagcctgcagaacaccagcagcgagggcagcagactgagaaccggcaaggacagaaaccagaagaaggagaagcccgacagcgtggacggccagcagcccctggtgaacggcgtgccctag

SEQ ID NO: 82068 - DNA, 1614 bp, Artificial Sequence
  Description of Artificial Sequence: Synthetic coding sequence
atggaggagctggtggtggaggtgagaggcagcaacggcgccttctacaaggccttcgtgaaggacgtgcacgaggacagcatcaccgtggccttcgagaacaactggcagcccgacagacagatccccttccacgacgtgagattccccccccccgtgggctacaacaaggacatcaacgagagcgacgaggtggaggtgtacagcagagccaacgagaaggagccctgctgctggtggctggccaaggtgagaatgatcaagggcgagttctacgtgatcgagtacgccgcctgcgacgccacctacaacgagatcgtgaccatcgagagactgagaagcgtgaaccccaacaagcccgccaccaaggacaccttccacaagatcaagctggacgtgcccgaggacctgagacagatgtgcgccaaggaggccgcccacaaggacttcaagaaggccgtgggcgccttcagcgtgacctacgaccccgagaactaccagctggtgatcctgagcatcaacgaggtgaccagcaagagagcccacatgctgatcgacatgcacttcagaagcctgagaaccaagctgagcctgatcatgagaaacgaggaggccagcaagcagctggagagcagcagacagctggccagcagattccacgagcagttcatcgtgagagaggacctgatgggcctggccatcggcacccacggcgccaacatccagcaggccagaaaggtgcccggcgtgaccgccatcgacctggacgaggacacctgcaccttccacatctacggcgaggaccaggacgccgtgaagaaggccagaagcttcctggagttcgccgaggacgtgatccaggtgcccagaaacctggtgggcaaggtgatcggcaagaacggcaagctgatccaggagatcgtggacaagagcggcgtggtgagagtgagaatcgaggccgagaacgagaagaacgtgccccaggaggaggagatcatgccccccaacagcctgcccagcaacaacagcagagtgggccccaacgcccccgaggagaagaagcacctggacatcaaggagaacagcacccacttcagccagcccaacagcaccaaggtgcagagagtgctggtggccagcagcgtggtggccggcgagagccagaagcccgagctgaaggcctggcagggcatggtgcccttcgtgttcgtgggcaccaaggacagcatcgccaacgccaccgtgctgctggactaccacctgaactacctgaagctgcagcagagaaagagaggcagagccagctgcgccgaggagaccgacggcggcgtggagggcgaggaggaggacaaggaggaggaggacgtggaggaggccagcaaggagaccaccatcacccccgagcagatcatcgtgcacgtgatccaggagagactgaaggaggagcagcagatggaccccttcagaagcgagctgaccgccatcatgaagggcgtgagcaccctgaagcactacagaatcccccccgtgaaggtggtgggctgcgccagagtgaagatcgtgaccagaagaaagagaagccagaccgcctggatggtgagcaaccacagctag

SEQ ID NO: 82069 - DNA, 1899 bp, Artificial Sequence
  Description of Artificial Sequence: Synthetic coding sequence
atggaggagctggtggtggaggtgagaggcagcaacggcgccttctacaaggccttcgtgaaggacgtgcacgaggacagcatcaccgtggccttcgagaacaactggcagcccgacagacagatccccttccacgacgtgagattccccccccccgtgggctacaacaaggacatcaacgagagcgacgaggtggaggtgtacagcagagccaacgagaaggagccctgctgctggtggctggccaaggtgagaatgatcaagggcgagttctacgtgatcgagtacgccgcctgcgacgccacctacaacgagatcgtgaccatcgagagactgagaagcgtgaaccccaacaagcccgccaccaaggacaccttccacaagatcaagctggacgtgcccgaggacctgagacagatgtgcgccaaggaggccgcccacaaggacttcaagaaggccgtgggcgccttcagcgtgacctacgaccccgagaactaccagctggtgatcctgagcatcaacgaggtgaccagcaagagagcccacatgctgatcgacatgcacttcagaagcctgagaaccaagctgagcctgatcatgagaaacgaggaggccagcaagcagctggagagcagcagacagctggccagcagattccacgagcagttcatcgtgagagaggacctgatgggcctggccatcggcacccacggcgccaacatccagcaggccagaaaggtgcccggcgtgaccgccatcgacctggacgaggacacctgcaccttccacatctacggcgaggaccaggacgccgtgaagaaggccagaagcttcctggagttcgccgaggacgtgatccaggtgcccagaaacctggtgggcaaggtgatcggcaagaacggcaagctgatccaggagatcgtggacaagagcggcgtggtgagagtgagaatcgaggccgagaacgagaagaacgtgccccaggaggaggagatcatgccccccaacagcctgcccagcaacaacagcagagtgggccccaacgcccccgaggagaagaagcacctggacatcaaggagaacagcacccacttcagccagcccaacagcaccaaggtgcagagagtgctggtggccagcagcgtggtggccggcgagagccagaagcccgagctgaaggcctggcagggcatggtgcccttcgtgttcgtgggcaccaaggacagcatcgccaacgccaccgtgctgctggactaccacctgaactacctgaaggaggtggaccagctgagactggagagactgcagatcgacgagcagctgagacagatcggcgccagcagcagacccccccccaacagaaccgacaaggagaagagctacgtgaccgacgacggccagggcatgggcagaggcagcagaccctacagaaacagaggccacggcagaagaggccccggctacaccagcggcaccaacagcgaggccagcaacgccagcgagaccgagagcgaccacagagacgagctgagcgactggagcctggcccccaccgaggaggagagagagagcttcctgagaagaggcgacggcagaagaagaggcggcggcggcagaggccagggcggcagaggcagaggcggcggcttcaagggcaacgacgaccacagcagaaccgacaacagacccagaaaccccagagaggccaagggcagaaccaccgacggcagcctgcagatcagagtggactgcaacaacgagagaagcgtgcacaccaagaccctgcagaacaccagcagcgagggcagcagactgagaaccggcaaggacagaaaccagaagaaggagaagcccgacagcgtggacggccagcagcccctggtgaacggcgtgccctag

SEQ ID NO: 82070 - DNA, 1749 bp, Artificial Sequence
  Description of Artificial Sequence: Synthetic coding sequence
atggaggagctggtggtggaggtgagaggcagcaacggcgccttctacaaggccttcgtgaaggacgtgcacgaggacagcatcaccgtggccttcgagaacaactggcagcccgacagacagatccccttccacgacgtgagattccccccccccgtgggctacaacaaggacatcaacgagagcgacgaggtggaggtgtacagcagagccaacgagaaggagccctgctgctggtggctggccaaggtgagaatgatcaagggcgagttctacgtgatcgagtacgccgcctgcgacgccacctacaacgagatcgtgaccatcgagagactgagaagcgtgaaccccaacaagcccgccaccaaggacaccttccacaagatcaagctggacgtgcccgaggacctgagacagatgtgcgccaaggaggccgcccacaaggacttcaagaaggccgtgggcgccttcagcgtgacctacgaccccgagaactaccagctggtgatcctgagcatcaacgaggtgaccagcaagagagcccacatgctgatcgacatgcacttcagaagcctgagaaccaagctgagcctgatcatgagaaacgaggaggccagcaagcagctggagagcagcagacagctggccagcagattccacgagcagttcatcgtgagagaggacctgatgggcctggccatcggcacccacggcgccaacatccagcaggccagaaaggtgcccggcgtgaccgccatcgacctggacgaggacacctgcaccttccacatctacggcgaggaccaggacgccgtgaagaaggccagaagcttcctggagttcgccgaggacgtgatccaggtgcccagaaacctggtgggcaaggtgatcggcaagaacggcaagctgatccaggagatcgtggacaagagcggcgtggtgagagtgagaatcgaggccgagaacgagaagaacgtgccccaggaggaggagatcatgccccccaacagcctgcccagcaacaacagcagagtgggccccaacgcccccgaggagaagaagcacctggacatcaaggagaacagcacccacttcagccagcccaacagcaccaaggtgcagagaggcatggtgcccttcgtgttcgtgggcaccaaggacagcatcgccaacgccaccgtgctgctggactaccacctgaactacctgaaggaggtggaccagctgagactggagagactgcagatcgacgagcagctgagacagatcggcgccagcagcagacccccccccaacagaaccgacaaggagaagagctacgtgaccgacgacggccagggcatgggcagaggcagcagaccctacagaaacagaggccacggcagaagaggccccggctacaccagcgagagcgaccacagagacgagctgagcgactggagcctggcccccaccgaggaggagagagagagcttcctgagaagaggcgacggcagaagaagaggcggcggcggcagaggccagggcggcagaggcagaggcggcggcttcaagggcaacgacgaccacagcagaaccgacaacagacccagaaaccccagagaggccaagggcagaaccaccgacggcagcctgcagaacaccagcagcgagggcagcagactgagaaccggcaaggacagaaaccagaagaaggagaagcccgacagcgtggacggccagcagcccctggtgaacggcgtgccctag

SEQ ID NO: 82071 - DNA, 1779 bp, Artificial Sequence
  Description of Artificial Sequence: Synthetic coding sequence
atggaggagctggtggtggaggtgagaggcagcaacggcgccttctacaaggccttcgtgaaggacgtgcacgaggacagcatcaccgtggccttcgagaacaactggcagcccgacagacagatccccttccacgacgtgagattccccccccccgtgggctacaacaaggacatcaacgagagcgacgaggtggaggtgtacagcagagccaacgagaaggagccctgctgctggtggctggccaaggtgagaatgatcaagggcgagttctacgtgatcgagtacgccgcctgcgacgccacctacaacgagatcgtgaccatcgagagactgagaagcgtgaaccccaacaagcccgccaccaaggacaccttccacaagatcaagctggacgtgcccgaggacctgagacagatgtgcgccaaggaggccgcccacaaggacttcaagaaggccgtgggcgccttcagcgtgacctacgaccccgagaactaccagctggtgatcctgagcatcaacgaggtgaccagcaagagagcccacatgctgatcgacatgcacttcagaagcctgagaaccaagctgagcctgatcatgagaaacgaggaggccagcaagcagctggagagcagcagacagctggccagcagattccacgagcagttcatcgtgagagaggacctgatgggcctggccatcggcacccacggcgccaacatccagcaggccagaaaggtgcccggcgtgaccgccatcgacctggacgaggacacctgcaccttccacatctacggcgaggaccaggacgccgtgaagaaggccagaagcttcctggagttcgccgaggacgtgatccaggtgcccagaaacctggtggtgatcggcaagaacggcaagctgatccaggagatcgtggacaagagcggcgtggtgagagtgagaatcgaggccgagaacgagaagaacgtgccccaggaggaggagatcatgccccccaacagcctgcccagcaacaacagcagagtgggccccaacgcccccgaggagaagaagcacctggacatcaaggagaacagcacccacttcagccagcccaacagcaccaaggtgcagagaggcatggtgcccttcgtgttcgtgggcaccaaggacagcatcgccaacgccaccgtgctgctggactaccacctgaactacctgaaggaggtggaccagctgagactggagagactgcagatcgacgagcagctgagacagatcggcgccagcagcagacccccccccaacagaaccgacaaggagaagagctacgtgaccgacgacggccagggcatgggcagaggcagcagaccctacagaaacagaggccacggcagaagaggccccggctacaccagcggcaccaacagcgaggccagcaacgccagcgagaccgagagcgaccacagagacgagctgagcgactggagcctggcccccaccgaggaggagagagagagcttcctgagaagaggcgacggcagaagaagaggcggcggcggcagaggccagggcggcagaggcagaggcggcggcttcaagggcaacgacgaccacagcagaaccgacaacagacccagaaaccccagagaggccaagggcagaaccaccgacggcagcctgcagaacaccagcagcgagggcagcagactgagaaccggcaaggacagaaaccagaagaaggagaagcccgacagcgtggacggccagcagcccctggtgaacggcgtgccctag

SEQ ID NO: 82072 - DNA, 789 bp, Artificial Sequence
  Description of Artificial Sequence: Synthetic coding sequence
atgccccccaacagcctgcccagcaacaacagcagagtgggccccaacgcccccgaggagaagaagcacctggacatcaaggagaacagcacccacttcagccagcccaacagcaccaaggtgcagagaggcatggtgcccttcgtgttcgtgggcaccaaggacagcatcgccaacgccaccgtgctgctggactaccacctgaactacctgaaggaggtggaccagctgagactggagagactgcagatcgacgagcagctgagacagatcggcgccagcagcagacccccccccaacagaaccgacaaggagaagagctacgtgaccgacgacggccagggcatgggcagaggcagcagaccctacagaaacagaggccacggcagaagaggccccggctacaccagcggcaccaacagcgaggccagcaacgccagcgagaccgagagcgaccacagagacgagctgagcgactggagcctggcccccaccgaggaggagagagagagcttcctgagaagaggcgacggcagaagaagaggcggcggcggcagaggccagggcggcagaggcagaggcggcggcttcaagggcaacgacgaccacagcagaaccgacaacagacccagaaaccccagagaggccaagggcagaaccaccgacggcagcctgcagaacaccagcagcgagggcagcagactgagaaccggcaaggacagaaaccagaagaaggagaagcccgacagcgtggacggccagcagcccctggtgaacggcgtgccctag

SEQ ID NO: 82073 - DNA, 1611 bp, Artificial Sequence
  Description of Artificial Sequence: Synthetic coding sequence
atgatgaagggcgagttctacgtgatcgagtacgccgcctgcgacgccacctacaacgagatcgtgaccttcgagagactgagacccgtgaaccagaacaagaccgtgaagaagaacaccttcttcaagtgcaccgtggacgtgcccgaggacctgagagaggcctgcgccaacgagaacgcccacaaggacttcaagaaggccgtgggcgcctgcagaatcttctaccaccccgagaccacccagctgatgatcctgagcgccagcgaggccaccgtgaagagagtgaacatcctgagcgacatgcacctgagaagcatcagaaccaagctgatgctgatgagcagaaacgaggaggccaccaagcacctggagtgcaccaagcagctggccgccgccttccacgaggagttcgtggtgagagaggacctgatgggcctggccatcggcacccacggcagcaacatccagcaggccagaaaggtgcccggcgtgaccgccatcgagctggacgaggacaccggcaccttcagaatctacggcgagagcgccgacgccgtgaagaaggccagaggcttcctggagttcgtggaggacttcatccaggtgcccagaaacctggtgggcaaggtgatcggcaagaacggcaaggtgatccaggagatcgtggacaagagcggcgtggtgagagtgagaatcgagggcgacaacgagaacaagctgcccagagaggacggcatggtgcccttcgtgttcgtgggcaccaaggagagcatcggcaacgtgcaggtgctgctggagtaccacatcgcctacctgaaggaggtggagcagctgagaatggagagactgcagatcgacgagcagctgagacagatcggcagcagaagctacagcggcagaggcagaggcagaagaggccccaactacaccagcggctacggcaccaacagcgagctgagcaaccccagcgagaccgagagcgagagaaaggacgagctgagcgactggagcctggccggcgaggacgacagagacagcagacaccagagagacagcagaagaagacccggcggcagaggcagaagcgtgagcggcggcagaggcagaggcggccccagaggcggcaagagcagcatcagcagcgtgctgaaggaccccgacagcaacccctacagcctgctggacaacaccgagagcgaccagaccgccgacaccgacgccagcgagagccaccacagcaccaacagaagaagaagaagcagaagaagaagaaccgacgaggacgccgtgctgatggacggcatgaccgagagcgacaccgccagcgtgaacgagaacggcctggtgaccgtggccgactacatcagcagagccgagagccagagcagacagagaaacctgcccagagagaccctggccaagaacaagaaggagatggccaaggacgtgatcgaggagcacggccccagcgagaaggccatcaacggccccaccagcgccagcggcgacgacatcagcaagctgcagagaacccccggcgaggagaagatcaacaccctgaaggaggagaacacccaggaggccgccgtgctgaacggcgtgagctag

SEQ ID NO: 82074 - DNA, 1866 bp, Artificial Sequence
  Description of Artificial Sequence: Synthetic coding sequence
atggccgagctgaccgtggaggtgagaggcagcaacggcgccttctacaagggcttcatcaaggacgtgcacgaggacagcctgaccgtggtgttcgagaacaactggcagcccgagagacaggtgcccttcaacgaggtgagactgccccccccccccgacatcaagaaggagatcagcgagggcgacgaggtggaggtgtacagcagagccaacgaccaggagccctgcggctggtggctggccaaggtgagaatgatgaagggcgagttctacgtgatcgagtacgccgcctgcgacgccacctacaacgagatcgtgaccttcgagagactgagacccgtgaaccagaacaagaccgtgaagaagaacaccttcttcaagtgcaccgtggacgtgcccgaggacctgagagaggcctgcgccaacgagaacgcccacaaggacttcaagaaggccgtgggcgcctgcagaatcttctaccaccccgagaccacccagctgatgatcctgagcgccagcgaggccaccgtgaagagagtgaacatcctgagcgacatgcacctgagaagcatcagaaccaagctgatgctgatgagcagaaacgaggaggccaccaagcacctggagtgcaccaagcagctggccgccgccttccacgaggagttcgtggtgagagaggacctgatgggcctggccatcggcacccacggcagcaacatccagcaggccagaaaggtgcccggcgtgaccgccatcgagctggacgaggacaccggcaccttcagaatctacggcgagagcgccgacgccgtgaagaaggccagaggcttcctggagttcgtggaggacttcatccaggtgcccagaaacctggtgggcaaggtgatcggcaagaacggcaaggtgatccaggagatcgtggacaagagcggcgtggtgagagtgagaatcgagggcgacaacgagaacaagctgcccagagaggacggcatggtgcccttcgtgttcgtgggcaccaaggagagcatcggcaacgtgcaggtgctgctggagtaccacatcgcctacctgaaggaggtggagcagctgagaatggagagactgcagatcgacgagcagctgagacagatcggcagcagaagctacagcggcagaggcagaggcagaagaggccccaactacaccagcggctacggcaccaacagcgagctgagcaaccccagcgagaccgagagcgagagaaaggacgagctgagcgactggagcctggccggcgaggacgacagagacagcagacaccagagagacagcagaagaagacccggcggcagaggcagaagcgtgagcggcggcagaggcagaggcggccccagaggcggcaagagcagcatcagcagcgtgctgaaggaccccgacagcaacccctacagcctgctggacaacaccgagagcgaccagaccgccgacaccgacgccagcgagagccaccacagcaccaacagaagaagaagaagcagaagaagaagaaccgacgaggacgccgtgctgatggacggcatgaccgagagcgacaccgccagcgtgaacgagaacggcctggtgaccgtggccgactacatcagcagagccgagagccagagcagacagagaaacctgcccagagagaccctggccaagaacaagaaggagatggccaaggacgtgatcgaggagcacggccccagcgagaaggccatcaacggccccaccagcgccagcggcgacgacatcagcaagctgcagagaacccccggcgaggagaagatcaacaccctgaaggaggagaacacccaggaggccgccgtgctgaacggcgtgagctag

SEQ ID NO: 82075 - DNA, 1620 bp, Artificial Sequence
  Description of Artificial Sequence: Synthetic coding sequence
atggccgagctgaccgtggaggtgagaggcagcaacggcgccttctacaagggcttcatcaaggacgtgcacgaggacagcctgaccgtggtgttcgagaacaactggcagcccgagagacaggtgcccttcaacgaggtgagactgccccccccccccgacatcaagaaggagatcagcgagggcgacgaggtggaggtgtacagcagagccaacgaccaggagccctgcggctggtggctggccaaggtgagaatgatgaagggcgagttctacgtgatcgagtacgccgcctgcgacgccacctacaacgagatcgtgaccttcgagagactgagacccgtgaaccagaacaagaccgtgaagaagaacaccttcttcaagtgcaccgtggacgtgcccgaggacctgagagaggcctgcgccaacgagaacgcccacaaggacttcaagaaggccgtgggcgcctgcagaatcttctaccaccccgagaccacccagctgatgatcctgagcgccagcgaggccaccgtgaagagagtgaacatcctgagcgacatgcacctgagaagcatcagaaccaagctgatgctgatgagcagaaacgaggaggccaccaagcacctggagtgcaccaagcagctggccgccgccttccacgaggagttcgtggtgagagaggacctgatgggcctggccatcggcacccacggcagcaacatccagcaggccagaaaggtgcccggcgtgaccgccatcgagctggacgaggacaccggcaccttcagaatctacggcgagagcgccgacgccgtgaagaaggccagaggcttcctggagttcgtggaggacttcatccaggtgcccagaaacctggtgggcaaggtgatcggcaagaacggcaaggtgatccaggagatcgtggacaagagcggcgtggtgagagtgagaatcgagggcgacaacgagaacaagctgcccagagaggacggcatggtgcccttcgtgttcgtgggcaccaaggagagcatcggcaacgtgcaggtgctgctggagtaccacatcgcctacctgaaggaggtggagcagctgagaatggagagactgcagatcgacgagcagctgagacagatcggcagcagaagctacagcggcagaggcagaggcagaagaggccccaactacaccagcggctacggcaccaacagcgagctgagcaaccccagcgagaccgagagcgagagaaaggacgagctgagcgactggagcctggccggcgaggacgacagagacagcagacaccagagagacagcagaagaagacccggcggcagaggcagaagcgtgagcggcggcagaggcagaggcggccccagaggcggcaagagcagcatcagcagcgtgctgaaggaccccgacagcaacccctacagcctgctggacaacaccgagagcgaccagaccgccgacaccgacgccagcgagagccaccacagcaccaacagaagaagaagaagcagaagaagaagaaccgacgaggacgccgtgctgatggacggcatgaccgagagcgacaccgccagcgtgaacgagaacggcctgggcaagagatgcgactag

SEQ ID NO: 82076 - DNA, 1827 bp, Artificial Sequence
  Description of Artificial Sequence: Synthetic coding sequence
atggtgaccgagggcttcatcaaggacgtgcacgaggacagcctgaccgtggtgttcgagaacaactggcagcccgagagacaggtgcccttcaacgaggtgagactgccccccccccccgacatcaagaaggagatcagcgagggcgacgaggtggaggtgtacagcagagccaacgaccaggagccctgcggctggtggctggccaaggtgagaatgatgaagggcgagttctacgtgatcgagtacgccgcctgcgacgccacctacaacgagatcgtgaccttcgagagactgagacccgtgaaccagaacaagaccgtgaagaagaacaccttcttcaagtgcaccgtggacgtgcccgaggacctgagagaggcctgcgccaacgagaacgcccacaaggacttcaagaaggccgtgggcgcctgcagaatcttctaccaccccgagaccacccagctgatgatcctgagcgccagcgaggccaccgtgaagagagtgaacatcctgagcgacatgcacctgagaagcatcagaaccaagctgatgctgatgagcagaaacgaggaggccaccaagcacctggagtgcaccaagcagctggccgccgccttccacgaggagttcgtggtgagagaggacctgatgggcctggccatcggcacccacggcagcaacatccagcaggccagaaaggtgcccggcgtgaccgccatcgagctggacgaggacaccggcaccttcagaatctacggcgagagcgccgacgccgtgaagaaggccagaggcttcctggagttcgtggaggacttcatccaggtgcccagaaacctggtgggcaaggtgatcggcaagaacggcaaggtgatccaggagatcgtggacaagagcggcgtggtgagagtgagaatcgagggcgacaacgagaacaagctgcccagagaggacggcatggtgcccttcgtgttcgtgggcaccaaggagagcatcggcaacgtgcaggtgctgctggagtaccacatcgcctacctgaaggaggtggagcagctgagaatggagagactgcagatcgacgagcagctgagacagatcggcagcagaagctacagcggcagaggcagaggcagaagaggccccaactacaccagcggctacggcaccaacagcgagctgagcaaccccagcgagaccgagagcgagagaaaggacgagctgagcgactggagcctggccggcgaggacgacagagacagcagacaccagagagacagcagaagaagacccggcggcagaggcagaagcgtgagcggcggcagaggcagaggcggccccagaggcggcaagagcagcatcagcagcgtgctgaaggaccccgacagcaacccctacagcctgctggacaacaccgagagcgaccagaccgccgacaccgacgccagcgagagccaccacagcaccaacagaagaagaagaagcagaagaagaagaaccgacgaggacgccgtgctgatggacggcatgaccgagagcgacaccgccagcgtgaacgagaacggcctggtgaccgtggccgactacatcagcagagccgagagccagagcagacagagaaacctgcccagagagaccctggccaagaacaagaaggagatggccaaggacgtgatcgaggagcacggccccagcgagaaggccatcaacggccccaccagcgccagcggcgacgacatcagcaagctgcagagaacccccggcgaggagaagatcaacaccctgaaggaggagaacacccaggaggccgccgtgctgaacggcgtgagctag

SEQ ID NO: 82077 - DNA, 2022 bp, Artificial Sequence
  Description of Artificial Sequence: Synthetic coding sequence
atgggcggcctggccagcggcggcgacgtggagcccggcctgcccgtggaggtgagaggcagcaacggcgccttctacaagggcttcgtgaaggacgtgcacgaggacagcgtgaccatcttcttcgagaacaactggcagagcgagagacagatccccttcggcgacgtgagactgcccccccccgccgactacaacaaggagatcaccgagggcgacgaggtggaggtgtacagcagagccaacgagcaggagccctgcggctggtggctggccagagtgagaatgatgaagggcgacttctacgtgatcgagtacgccgcctgcgacgccacctacaacgagatcgtgaccctggagagactgagacccgtgaaccccaaccccctggccaccaagggcagcttcttcaaggtgaccatggccgtgcccgaggacctgagagaggcctgcagcaacgagaacgtgcacaaggagttcaagaaggccctgggcgccaactgcatcttcctgaacatcaccaacagcgagctgttcatcctgagcaccaccgaggcccccgtgaagagagccagcctgctgggcgacatgcacttcagaagcctgagaaccaagctgctgctgatgagcagaaacgaggaggccaccaagcacctggagaccagcaagcagctggccgccgccttccaggaggagttcaccgtgagagaggacctgatgggcctggccatcggcacccacggcgccaacatccagcaggccagaaaggtgcccggcgtgaccgccatcgagctgggcgaggagacctgcaccttcagaatctacggcgagacccccgaggcctgcagacaggccagaagctacctggagttcagcgaggacagcgtgcaggtgcccagaaacctggtgggcaaggtgatcggcaagaacggcaaggtgatccaggagatcgtggacaagagcggcgtggtgagagtgagagtggagggcgacaacgacaagaagaaccccagagaggagggcatggtgcccttcatcttcgtgggcaccagagagaacatcagcaacgcccaggccctgctggagtaccacctgagctacctgcaggaggtggagcagctgagactggagagactgcagatcgacgagcagctgagacagatcggcctgggcttcagaccccccggcagcggcagaggcagcggcggcagcgacaaggccggctacagcaccgacgagagcagcagcagcagcctgcacgccaccagaacctacggcggcagctacggcggcagaggcagaggcagaagaaccggcggccccgcctacggccccagcagcgacgtgagcaccgccagcgagaccgagagcgagaagagagaggagcccaacagagccggccccggcgacagagacccccccaccagaggcgaggagagcagaagaagacccaccggcggcagaggcagaggccccccccccgcccccagacccaccagcagatacaacagcagcagcatcagcagcgtgctgaaggaccccgacagcaacccctacagcctgctggacaccagcgagcccgagccccccgtggacagcgagcccggcgagcccccccccgccagcgccagaagaagaagaagcagaagaagaagaaccgacgaggacagaaccgtgatggacggcggcctggagagcgacggccccaacatgaccgagaacggcctggaggacgagagcagaccccagagaagaaacagaagcagaagaagaagaaacagaggcaacagaaccgacggcagcatcagcggcgacagacagcccgtgaccgtggccgactacatcagcagagccgagagccagagcagacagagaccccccctggagagaaccaagcccagcgaggacagcctgagcggccagaagggcgacagcgtgagcaagctgcccaagggccccagcgagaacggcgagctgagcgcccccctggagctgggcagcatggtgaacggcgtgagctag

SEQ ID NO: 82078 - DNA, 6540 bp, Artificial Sequence
  Description of Artificial Sequence: Synthetic coding sequence
atgaacagcctgagctggggcgccgccaacgccgtgctgctgctgctgctgctggcctgggccagccccaccttcatcagcatcaacagaggcgtgagagtgatgaagggccacagcgccttcctgagcggcgacgacctgaagttcgccatccccaaggagaaggacgcctgcaaggtggaggtggtgatgaacgagcccatcacccagagagtgggcaagctgaccccccaggtgttcgactgccacttcctgcccaacgaggtgaagtacgtgcacaacggctgccccatcctggacgaggacaccgtgaagctgagactgtacagattcaccgagagagacaccttcatcgagaccttcatcctgtgggtgtacctgctggagcccgactgcaacatcatccacatgagcaacaacgtgctggaggtgcccgagttcaacggcctgagccaggccatcgacaagaacctgctgagattcgactacgacagaatggccagcctggagtgcaccgtgagcctggacaccgccagaaccagactgcccgcccacggccagatggtgctgggcgagcccagacccgaggagcccagaggcgaccagccccacagcttcttccccgagagccagctgagagccaagctgaagtgccccggcggcagctgcacccccggcctgaagaagatcggcagcctgaaggtgagctgcgaggagttcctgctgatgggcctgagataccagcacctggacccccccagccccaacatcgactacatcagcatccagctggacctgaccgacaccagaagcaagatcgtgtacaagagcgagagcgcctggctgcccgtgtacatcagagccggcatccccaaccagatccccaaggccgccttcatggccgtgttcatcctggaggtggaccagttcatcctgaccagcctgaccaccagcgtgctggactgcgaggaggacgagacccccaagcccctgctggtgttcaacatcaccaaggcccccctgcagggctacgtgacccacctgctggaccacaccagacccatcagcagcttcacctggaaggacctgagcgacatgcagatcgcctaccagccccccaacagcagccacagcgagagaagacacgacgaggtggagctggaggtgtacgacttcttcttcgagagaagcgcccccatgaccgtgcacatcagcatcagaaccgccgacaccaacgcccccagagtgagctggaacaccggcctgagcctgctggagggccagagcagagccatcacctgggagcagttccaggtggtggacaacgacgacatcggcgccgtgagactggtgaccgtgggcggcctgcagcacggctggctgaccctgagaggcggcaagggcttcctgttcaccgtggccgacctgcaggccggcgtggtgagataccaccacgacgacagcgacagcaccaaggacttcgtggtgttcagaatcttcgacggccaccacagcatcagacacaagttccccatcaacgtgctgcccaaggacgacagcccccccttcctgatcaccaacgtggtgatcgagctggaggagggccagaccatcctgatccagggcagcatgctgagagccagcgacgtggacgccagcgacgactacatcttcttcaacatcaccaagcccccccaggccggcgagatcatgaagaagcccggccccggcctgatcggctaccccgtgcacggcttcctgcagagagacctgttcaacggcatcatctactacagacacttcggcggcgagatcttcgaggacagcttccagttcgtgctgtgggacagccacgagccccccaacctgagcgtgccccaggtggccaccatccacatcacccccgtggacgaccagctgcccaaggaggcccccggcgtgagcagacacctggtggtgaaggagaccgaggtggcctacatcaccaagaagcagctgcacttcatcgacagcgagagctacgacagagagctggtgtacaccatcaccaccccccccttcttcagcttcagccacagacacctggacgccggcaagctgttcatggtggacagcatccccaaggtggtgaagaaccccaccgccctggagctgagaagcttcacccagcacgccgtgaactacatgaaggtggcctacatgccccccatgcaggacatcggcccccactgcagagacgtgcagttcaccttcagcgtgagcaaccagcacggcggcaccctgcacggcatctgcttcaacatcaccatcctgcccgtggacaaccaggtgcccgaggccttcaccaaccccctgaaggtgaccgagggcggccagagcatcatcagcaccgagcacatcctgatcagcgacgccgacaccaagctggacaacatcgacctgagcctgagagagctgcccctgcacggcagagtggagctgaacggcttccccctgaacagcggcggcaccttcagctggggcgacctgcacaccctgaaggtgagataccagcacgacggcaccgaggtgctgcaggacgacctgctgctggaggtgaccgacggcaccaacagcgccgagttcgtgctgcacgtggaggtgttccccgtgaacgacgagccccccgtgctgaaggccgacctgatgcccgtgatgaactgcagcgagggcggcgaggtggtgatcaccagcgagtacatcttcgccaccgacgtggacagcgacaacctgaagctgatgttcgtgatcgccagagagccccagcacggcgtggtgagaagagccggcgtgaccgtggaccagttcagccagagagacgtgatcagcgaggccgtgacctacaagcacaccggcggcgagatcggcctgatgccctgcttcgacaccatcaccctggtggtgagcgacggcgaggccggccccttcgtgaacggctgctgctacaacggccccaaccccagcgtgcccctgcacgccagcttccccgtgtacgacctgaacatcaccgtgtaccccgtggacaaccagccccccagcatcgccatcggccccgtgttcgtggtggacgagggctgcagcaccgccctgaccgtgaaccacctgagcgccaccgaccccgacaccgccgccgacgacctggagttcgtgctggtgagccccccccagttcggctacctggagaacatcctgcccagcgtgggcttcgagaagagcaacatcggcatcagcatcgacagcttccagtggaaggacatgaacgccttccacatcaactacgtgcagagcagacacctgagaatcgagcccaccgccgaccagttcaccgtgtacgtgaccgacggcaagcaccacagcctggagatccccttcagcatcatcatcaaccccaccaacgacgaggcccccgacttcgtggtgcagaacatcaccgtgtgcgagggccagatgaaggagctggacagcagcatcatcagcgccgtggacctggacatcccccaggacgccctgctgttcagcatcacccagaagcccagacacggcctgctgatcgacagaggcttcagcaaggacttcagcgagaacaagcagcccgccaacccccaccagaagcacgcccccgtgcacagcttcagcatggagctgctgaagaccggcatgagactgacctacatgcacgacgacagcgagagcctggccgacgacttcaccatccagctgagcgacggcaagcacaagatcctgaagaccatcagcgtggaggtgatccccgtgaacgacgagaagcccatgctgagcaagaaggccgagatcgccatgaacatgggcgagaccagaatcatcagcagcgccatcctgagcgccatcgacgaggacagccccagagagaagatctactacgtgttcgagagactgccccagaacggccagctgcagctgaagatcggcagagactgggtgcccctgagccccggcatgaagtgcacccaggaggaggtggacctgaacctgctgagatacacccacaccggcgccatggacagccagaaccaggacagcttcaccttctacctgtgggacggcaacaacagaagccccgccctggactgccagatcaccatcaaggacatggagaagggcgacatcgtgatcctgaccaagcccctggtggtgagcaagggcgacagaggcttcctgaccaccaccaccctgctggccgtggacggcaccgacaagcccgaggagctgctgtacgtgatcaccagcccccccagatacggccagatcgagtacgtgcactaccccggcgtgcccatcaccaacttcagccagatggacgtggtgggccagaccgtgtgctacgtgcacaagagcaaggtgaccgtgagcagcgacagattcagattcatcatcagcaacggcctgagaaccgagcacggcgtgttcgagatcaccctggagaccgtggacagagccctgcccgtggtgaccagaaacaagggcctgagactggcccagggcgccgtgggcctgctgagccccgacctgctgcagctgaccgaccccgacacccccgccgagaacctgaccttcctgctggtgcagctgccccagcacggccagctgtacctgtggggcaccggcctgctgcagcacaacttcacccagcaggacgtggacagcaagaacgtggcctacagacacagcggcggcgacagccagaccgactgcttcaccttcatggccaccgacggcaccaaccagggcttcatcgtgaacggcagagtgtgggaggagcccgtgctgttcaccatccaggtggaccagctggacaagaccgcccccagaatcaccctgctgcacagccccagccaggtgggcctgctgaagaacggctgctacggcatctacatcaccagcagagtgctgaaggccagcgaccccgacaccgaggacgaccagatcatcttcaagatcctgcagggccccaagcacggccacctggagaacaccaccaccggcgagttcatccacgagaagttcagccagaaggacctgaacagcaagaccatcctgtacatcatcaaccccagcctggaggtgaacagcgacaccgtggagttccagatcatggaccccaccggcaacagcgccaccccccagatcctggagctgaagtggagccacatcgagtggagccagaccgagtacgaggtgtgcgagaacgtgggcctgctgcccctggagatcatcagaagaggctacagcatggacagcgccttcgtgggcatcaaggtgaaccaggtgagcgccgccgtgggcaaggacttcaccgtgatccccagcaagctgatccagttcgaccccggcatgagcaccaagatgtggaacatcgccatcacctacgacggcctggaggaggacgacgaggtgttcgaggtgatcctgaacagccccgtgaacgccgtgctgggcaccaagaccaaggccgccgtgaagatcctggacagcaagggcggccagtgccaccccagctacagcagcaaccagagcaagcacagcacctgggagaagggcatctggcacctgctgccccccggcagcagcagcagcaccaccagcggcagcttccacctggagagaagacccctgcccagcagcatgcagctggccgtgatcagaggcgacaccctgagaggcttcgacagcaccgacctgagccagagaaagctgagaaccagaggcaacggcaagaccgtgagacccagcagcgtgtacagaaacggcaccgacatcatctacaactaccacggcatcgtgagcctgaagctggaggacgacagcttccccacccacaagagaaaggccaaggtgagcatcatcagccagccccagaagaccatcaaggtggccgagctgccccaggccgacaaggtggagagcaccaccgacagccacttccccagacaggaccagctgcccagcttccccaagaactgcaccctggagctgaagggcctgttccacttcgaggagggcatccagaagctgtaccagtgcaacggcatcgcctggaaggcctggagcccccagaccaaggacgtggaggacaagagctgccccgccggctggcaccagcacagcggctactgccacatcctgatcaccgagcagaagggcacctggaacgccgccgcccaggcctgcagagagcagtacctgggcaacctggtgaccgtgttcagcagacagcacatgagatggctgtgggacatcggcggcagaaagagcttctggatcggcctgaacgaccaggtgcacgccggccactgggagtggatcggcggcgagcccgtggccttcaccaacggcagaagaggccccagccagagaagcaagctgggcaagagctgcgtgctggtgcagagacagggcaagtggcagaccaaggactgcagaagagccaagccccacaactacgtgtgcagcagaaagctgtag

SEQ ID NO: 82079 - DNA, 6543 bp, Artificial Sequence
  Description of Artificial Sequence: Synthetic coding sequence
atgaacagcctgagctggggcgccgccaacgccgtgctgctgctgctgctgctggcctgggccagccccaccttcatcagcatcaacagaggcgtgagagtgatgaagggccacagcgccttcctgagcggcgacgacctgaagttcgccatccccaaggagaaggacgcctgcaaggtggaggtggtgatgaacgagcccatcacccagagagtgggcaagctgaccccccaggtgttcgactgccacttcctgcccaacgaggtgaagtacgtgcacaacggctgccccatcctggacgaggacaccgtgaagctgagactgtacagattcaccgagagagacaccttcatcgagaccttcatcctgtgggtgtacctgctggagcccgactgcaacatcatccacatgagcaacaacgtgctggaggtgcccgagttcaacggcctgagccaggccatcgacaagaacctgctgagattcgactacgacagaatggccagcctggagtgcaccgtgagcctggacaccgccagaaccagactgcccgcccacggccagatggtgctgggcgagcccagacccgaggagcccagaggcgaccagccccacagcttcttccccgagagccagctgagagccaagctgaagtgccccggcggcagctgcacccccggcctgaagaagatcggcagcctgaaggtgagctgcgaggagttcctgctgatgggcctgagataccagcacctggacccccccagccccaacatcgactacatcagcatccagctggacctgaccgacaccagaagcaagatcgtgtacaagaagagcgagagcgcctggctgcccgtgtacatcagagccggcatccccaaccagatccccaaggccgccttcatggccgtgttcatcctggaggtggaccagttcatcctgaccagcctgaccaccagcgtgctggactgcgaggaggacgagacccccaagcccctgctggtgttcaacatcaccaaggcccccctgcagggctacgtgacccacctgctggaccacaccagacccatcagcagcttcacctggaaggacctgagcgacatgcagatcgcctaccagccccccaacagcagccacagcgagagaagacacgacgaggtggagctggaggtgtacgacttcttcttcgagagaagcgcccccatgaccgtgcacatcagcatcagaaccgccgacaccaacgcccccagagtgagctggaacaccggcctgagcctgctggagggccagagcagagccatcacctgggagcagttccaggtggtggacaacgacgacatcggcgccgtgagactggtgaccgtgggcggcctgcagcacggctggctgaccctgagaggcggcaagggcttcctgttcaccgtggccgacctgcaggccggcgtggtgagataccaccacgacgacagcgacagcaccaaggacttcgtggtgttcagaatcttcgacggccaccacagcatcagacacaagttccccatcaacgtgctgcccaaggacgacagcccccccttcctgatcaccaacgtggtgatcgagctggaggagggccagaccatcctgatccagggcagcatgctgagagccagcgacgtggacgccagcgacgactacatcttcttcaacatcaccaagcccccccaggccggcgagatcatgaagaagcccggccccggcctgatcggctaccccgtgcacggcttcctgcagagagacctgttcaacggcatcatctactacagacacttcggcggcgagatcttcgaggacagcttccagttcgtgctgtgggacagccacgagccccccaacctgagcgtgccccaggtggccaccatccacatcacccccgtggacgaccagctgcccaaggaggcccccggcgtgagcagacacctggtggtgaaggagaccgaggtggcctacatcaccaagaagcagctgcacttcatcgacagcgagagctacgacagagagctggtgtacaccatcaccaccccccccttcttcagcttcagccacagacacctggacgccggcaagctgttcatggtggacagcatccccaaggtggtgaagaaccccaccgccctggagctgagaagcttcacccagcacgccgtgaactacatgaaggtggcctacatgccccccatgcaggacatcggcccccactgcagagacgtgcagttcaccttcagcgtgagcaaccagcacggcggcaccctgcacggcatctgcttcaacatcaccatcctgcccgtggacaaccaggtgcccgaggccttcaccaaccccctgaaggtgaccgagggcggccagagcatcatcagcaccgagcacatcctgatcagcgacgccgacaccaagctggacaacatcgacctgagcctgagagagctgcccctgcacggcagagtggagctgaacggcttccccctgaacagcggcggcaccttcagctggggcgacctgcacaccctgaaggtgagataccagcacgacggcaccgaggtgctgcaggacgacctgctgctggaggtgaccgacggcaccaacagcgccgagttcgtgctgcacgtggaggtgttccccgtgaacgacgagccccccgtgctgaaggccgacctgatgcccgtgatgaactgcagcgagggcggcgaggtggtgatcaccagcgagtacatcttcgccaccgacgtggacagcgacaacctgaagctgatgttcgtgatcgccagagagccccagcacggcgtggtgagaagagccggcgtgaccgtggaccagttcagccagagagacgtgatcagcgaggccgtgacctacaagcacaccggcggcgagatcggcctgatgccctgcttcgacaccatcaccctggtggtgagcgacggcgaggccggccccttcgtgaacggctgctgctacaacggccccaaccccagcgtgcccctgcacgccagcttccccgtgtacgacctgaacatcaccgtgtaccccgtggacaaccagccccccagcatcgccatcggccccgtgttcgtggtggacgagggctgcagcaccgccctgaccgtgaaccacctgagcgccaccgaccccgacaccgccgccgacgacctggagttcgtgctggtgagccccccccagttcggctacctggagaacatcctgcccagcgtgggcttcgagaagagcaacatcggcatcagcatcgacagcttccagtggaaggacatgaacgccttccacatcaactacgtgcagagcagacacctgagaatcgagcccaccgccgaccagttcaccgtgtacgtgaccgacggcaagcaccacagcctggagatccccttcagcatcatcatcaaccccaccaacgacgaggcccccgacttcgtggtgcagaacatcaccgtgtgcgagggccagatgaaggagctggacagcagcatcatcagcgccgtggacctggacatcccccaggacgccctgctgttcagcatcacccagaagcccagacacggcctgctgatcgacagaggcttcagcaaggacttcagcgagaacaagcagcccgccaacccccaccagaagcacgcccccgtgcacagcttcagcatggagctgctgaagaccggcatgagactgacctacatgcacgacgacagcgagagcctggccgacgacttcaccatccagctgagcgacggcaagcacaagatcctgaagaccatcagcgtggaggtgatccccgtgaacgacgagaagcccatgctgagcaagaaggccgagatcgccatgaacatgggcgagaccagaatcatcagcagcgccatcctgagcgccatcgacgaggacagccccagagagaagatctactacgtgttcgagagactgccccagaacggccagctgcagctgaagatcggcagagactgggtgcccctgagccccggcatgaagtgcacccaggaggaggtggacctgaacctgctgagatacacccacaccggcgccatggacagccagaaccaggacagcttcaccttctacctgtgggacggcaacaacagaagccccgccctggactgccagatcaccatcaaggacatggagaagggcgacatcgtgatcctgaccaagcccctggtggtgagcaagggcgacagaggcttcctgaccaccaccaccctgctggccgtggacggcaccgacaagcccgaggagctgctgtacgtgatcaccagcccccccagatacggccagatcgagtacgtgcactaccccggcgtgcccatcaccaacttcagccagatggacgtggtgggccagaccgtgtgctacgtgcacaagagcaaggtgaccgtgagcagcgacagattcagattcatcatcagcaacggcctgagaaccgagcacggcgtgttcgagatcaccctggagaccgtggacagagccctgcccgtggtgaccagaaacaagggcctgagactggcccagggcgccgtgggcctgctgagccccgacctgctgcagctgaccgaccccgacacccccgccgagaacctgaccttcctgctggtgcagctgccccagcacggccagctgtacctgtggggcaccggcctgctgcagcacaacttcacccagcaggacgtggacagcaagaacgtggcctacagacacagcggcggcgacagccagaccgactgcttcaccttcatggccaccgacggcaccaaccagggcttcatcgtgaacggcagagtgtgggaggagcccgtgctgttcaccatccaggtggaccagctggacaagaccgcccccagaatcaccctgctgcacagccccagccaggtgggcctgctgaagaacggctgctacggcatctacatcaccagcagagtgctgaaggccagcgaccccgacaccgaggacgaccagatcatcttcaagatcctgcagggccccaagcacggccacctggagaacaccaccaccggcgagttcatccacgagaagttcagccagaaggacctgaacagcaagaccatcctgtacatcatcaaccccagcctggaggtgaacagcgacaccgtggagttccagatcatggaccccaccggcaacagcgccaccccccagatcctggagctgaagtggagccacatcgagtggagccagaccgagtacgaggtgtgcgagaacgtgggcctgctgcccctggagatcatcagaagaggctacagcatggacagcgccttcgtgggcatcaaggtgaaccaggtgagcgccgccgtgggcaaggacttcaccgtgatccccagcaagctgatccagttcgaccccggcatgagcaccaagatgtggaacatcgccatcacctacgacggcctggaggaggacgacgaggtgttcgaggtgatcctgaacagccccgtgaacgccgtgctgggcaccaagaccaaggccgccgtgaagatcctggacagcaagggcggccagtgccaccccagctacagcagcaaccagagcaagcacagcacctgggagaagggcatctggcacctgctgccccccggcagcagcagcagcaccaccagcggcagcttccacctggagagaagacccctgcccagcagcatgcagctggccgtgatcagaggcgacaccctgagaggcttcgacagcaccgacctgagccagagaaagctgagaaccagaggcaacggcaagaccgtgagacccagcagcgtgtacagaaacggcaccgacatcatctacaactaccacggcatcgtgagcctgaagctggaggacgacagcttccccacccacaagagaaaggccaaggtgagcatcatcagccagccccagaagaccatcaaggtggccgagctgccccaggccgacaaggtggagagcaccaccgacagccacttccccagacaggaccagctgcccagcttccccaagaactgcaccctggagctgaagggcctgttccacttcgaggagggcatccagaagctgtaccagtgcaacggcatcgcctggaaggcctggagcccccagaccaaggacgtggaggacaagagctgccccgccggctggcaccagcacagcggctactgccacatcctgatcaccgagcagaagggcacctggaacgccgccgcccaggcctgcagagagcagtacctgggcaacctggtgaccgtgttcagcagacagcacatgagatggctgtgggacatcggcggcagaaagagcttctggatcggcctgaacgaccaggtgcacgccggccactgggagtggatcggcggcgagcccgtggccttcaccaacggcagaagaggccccagccagagaagcaagctgggcaagagctgcgtgctggtgcagagacagggcaagtggcagaccaaggactgcagaagagccaagccccacaactacgtgtgcagcagaaagctgtag

SEQ ID NO: 82080 - DNA, 648 bp, Artificial Sequence
  Description of Artificial Sequence: Synthetic coding sequence
atgctggacgagagcctggccgtgagaagaagcaagaagtgcaaggagatgatcatgcactgggagaagaaggaggacatcgacatcgtgaacaccgtggaccagctggacaagaccgcccccagaatcaccctgctgcacagccccagccaggtgggcctgctgaagaacggctgctacggcatctacatcaccagcagagtgctgaaggccagcgaccccgacaccgaggacgaccagatcatcttcaagatcctgcagggccccaagcacggccacctggagaacaccaccaccggcgagttcatccacgagaagttcagccagaaggacctgaacagcaagaccatcctgtacatcatcaaccccagcctggaggtgaacagcgacaccgtggagttccagatcatggaccccaccggcaacagcgccaccccccagatcctggagctgaagtggagccacatcgagtggagccagaccgagtacgaggtgtgcgagaacgtgggcctgctgcccctggagatcatcagaagaggctacagcatggacagcgccttcgtgggcatcaaggtgaaccaggtgagcgccgccgtgggcaaggacttcaccgtgatccccagcaagctgatccagttcgacccctag

SEQ ID NO: 82081 - DNA, 2148 bp, Artificial Sequence
  Description of Artificial Sequence: Synthetic coding sequence
atggtgacccaggagagcatgctgaaggccgccctgcccctgttcaccagattcatcatcagcaacggcctgagaaccgagcacggcgtgttcgagatcaccctggagaccgtggacagagccctgcccgtggtgaccagaaacaagggcctgagactggcccagggcgccgtgggcctgctgagccccgacctgctgcagctgaccgaccccgacacccccgccgagaacctgaccttcctgctggtgcagctgccccagcacggccagctgtacctgtggggcaccggcctgctgcagcacaacttcacccagcaggacgtggacagcaagaacgtggcctacagacacagcggcggcgacagccagaccgactgcttcaccttcatggccaccgacggcaccaaccagggcttcatcgtgaacggcagagtgtgggaggagcccgtgctgttcaccatccaggtggaccagctggacaagaccgcccccagaatcaccctgctgcacagccccagccaggtgggcctgctgaagaacggctgctacggcatctacatcaccagcagagtgctgaaggccagcgaccccgacaccgaggacgaccagatcatcttcaagatcctgcagggccccaagcacggccacctggagaacaccaccaccggcgagttcatccacgagaagttcagccagaaggacctgaacagcaagaccatcctgtacatcatcaaccccagcctggaggtgaacagcgacaccgtggagttccagatcatggaccccaccggcaacagcgccaccccccagatcctggagctgaagtggagccacatcgagtggagccagaccgagtacgaggtgtgcgagaacgtgggcctgctgcccctggagatcatcagaagaggctacagcatggacagcgccttcgtgggcatcaaggtgaaccaggtgagcgccgccgtgggcaaggacttcaccgtgatccccagcaagctgatccagttcgaccccggcatgagcaccaagatgtggaacatcgccatcacctacgacggcctggaggaggacgacgaggtgttcgaggtgatcctgaacagccccgtgaacgccgtgctgggcaccaagaccaaggccgccgtgaagatcctggacagcaagggcggccagtgccaccccagctacagcagcaaccagagcaagcacagcacctgggagaagggcatctggcacctgctgccccccggcagcagcagcagcaccaccagcggcagcttccacctggagagaagacccctgcccagcagcatgcagctggccgtgatcagaggcgacaccctgagaggcttcgacagcaccgacctgagccagagaaagctgagaaccagaggcaacggcaagaccgtgagacccagcagcgtgtacagaaacggcaccgacatcatctacaactaccacggcatcgtgagcctgaagctggaggacgacagcttccccacccacaagagaaaggccaaggtgagcatcatcagccagccccagaagaccatcaaggtggccgagctgccccaggccgacaaggtggagagcaccaccgacagccacttccccagacaggaccagctgcccagcttccccaagaactgcaccctggagctgaagggcctgttccacttcgaggagggcatccagaagctgtaccagtgcaacggcatcgcctggaaggcctggagcccccagaccaaggacgtggaggacaagagctgccccgccggctggcaccagcacagcggctactgccacatcctgatcaccgagcagaagggcacctggaacgccgccgcccaggcctgcagagagcagtacctgggcaacctggtgaccgtgttcagcagacagcacatgagatggctgtgggacatcggcggcagaaagagcttctggatcggcctgaacgaccaggtgcacgccggccactgggagtggatcggcggcgagcccgtggccttcaccaacggcagaagaggccccagccagagaagcaagctgggcaagagctgcgtgctggtgcagagacagggcaagtggcagaccaaggactgcagaagagccaagccccacaactacgtgtgcagcagaaagctgtag

SEQ ID NO: 82082 - DNA, 6540 bp, Artificial Sequence; identical to SEQ ID NO: 82078
  Description of Artificial Sequence: Synthetic coding sequence

SEQ ID NO: 82083 - DNA, 9510 bp, Artificial Sequence
  Description of Artificial Sequence: Synthetic coding sequence
atgcacagcgccggcacccccggcctgagcagcagaagaaccggcaacagcaccagcttccagcccggccccccccccccccccagactgctgctgctgctgctgctgctgctgagcctggtgagcagagtgcccgcccagcccgccgccttcggcagagccctgctgagccccggcctggccggcgccgccggcgtgcccgccgaggaggccatcgtgctggccaacagaggcctgagagtgcccttcggcagagaggtgtggctggaccccctgcacgacctggtgctgcaggtgcagcccggcgacagatgcgccgtgagcgtgctggacaacgacgccctggcccagagacccggcagactgagccccaagagattcccctgcgacttcggccccggcgaggtgagatacagccacctgggcgccagaagccccagcagagacagagtgagactgcagctgagatacgacgcccccggcggcgccgtggtgctgcccctggtgctggaggtggaggtggtgttcacccagctggaggtggtgaccagaaacctgcccctggtggtggaggagctgctgggcaccagcaacgccctggacgccagaagcctggagttcgccttccagcccgagaccgaggagtgcagagtgggcatcctgagcggcctgggcgccctgcccagatacggcgagctgctgcactacccccaggtgcccggcggcgccagagagggcggcgcccccgagaccctgctgatggactgcaaggccttccaggagctgggcgtgagatacagacacaccgccgccagcagaagccccaacagagactggatccccatggtggtggagctgagaagcagaggcgcccccgtgggcagccccgccctgaagagagagcacttccaggtgctggtgagaatcagaggcggcgccgagaacaccgcccccaagcccagcttcgtggccatgatgatgatggaggtggaccagttcgtgctgaccgccctgacccccgacatgctggccgccgaggacgccgagagccccagcgacctgctgatcttcaacctgaccagccccttccagcccggccagggctacctggtgagcaccgacgacagaagcctgcccctgagcagcttcacccagagagacctgagactgctgaagatcgcctaccagccccccagcgaggacagcgaccaggagagactgttcgagctggagctggaggtggtggacctggagggcgccgccagcgaccccttcgccttcatggtggtggtgaagcccatgaacaccatggcccccgtggtgaccagaaacaccggcctgatcctgtacgagggccagagcagacccctgaccggccccgccggcagcggcccccagaacctggtgatcagcgacgaggacgacctggaggccgtgagactggaggtggtggccggcctgagacacggccacctggtgatcctgggcgccagcagcggcagcagcgcccccaagagcttcaccgtggccgagctggccgccggccaggtggtgtaccagcacgacgacagagacggcagcctgagcgacaacctggtgctgagaatggtggacggcggcggcagacaccaggtgcagttcctgttccccatcaccctggtgcccgtggacgaccagccccccgtgctgaacgccaacaccggcctgaccctggccgagggcgagaccgtgcccatcctgcccctgagcctgagcgccaccgacatggacagcgacgacagcctgctgctgttcgtgctggagagccccttcctgaccaccggccacctgctgctgagacagacccaccccccccacgagaagcaggagctgctgagaggcctgtggagaaaggagggcgccttctacgagagaaccgtgaccgagtggcagcagcaggacatcaccgagggcagactgttctacagacacagcggcccccacagccccggccccgtgaccgaccagttcaccttcagagtgcaggacaaccacgacccccccaaccagagcggcctgcagagattcgtgatcagaatccaccccgtggacagactgccccccgagctgggcagcggctgccccctgagaatggtggtgcaggagagccagctgacccccctgagaaagaagtggctgagatacaccgacctggacaccgacgacagagagctgagatacaccgtgacccagagccccaccgacaccgacgagaaccacctgcccgcccccctgggcaccctggtgctgaccgacaaccccagcgtggtggtgacccacttcacccaggcccagatcaaccaccacaagatcgcctacagaccccccggccaggagctgggcgtggccaccagagtggcccagttccagttccaggtggaggacagagccggcaacgtggcccccggcaccttcaccctgtacctgcaccccgtggacaaccagccccccgagatcctgaacaccggcttcaccatccaggagaagggccaccacatcctgagcgagaccgagctgcacgtgaacgacgtggacaccgacgtggcccacatcagcttcaccctgacccaggcccccaagcacggccacatgagagtgagcggccagatcctgcacgtgggcggcctgttccacctggaggacatcaagcagggcagagtgagctacgcccacaacggcgacaagagcctgaccgacagctgcagcctggaggtgagcgacagacaccacgtggtgcccatcaccctgagagtgaacgtgagacccgtggacgacgaggtgcccatcctgagccaccccaccggcaccctggagagctacctggacgtgctggagaacggcgccaccgagatcaccgccaacgtgatcaagggcaccaacgaggagaccgacgacctgatgctgaccttcctgctggaggacccccccctgtacggcgagatcctggtgaacggcatccccgccgagcagttcacccagagagacatcctggagggcagcgtggtgtacacccacaccagcggcgagatcggcctgctgcccaaggccgacagcttcaacctgagcctgagcgacatgagccaggagtggagaatcggcggcaacaccatccagggcgtgaccatctgggtgaccatcctgcccgtggacagccaggcccccgagatcttcgtgggcgagcagctgatcgtgatggagggcgacaagagcgtgatcaccagcgtgcacatcagcgccgaggacgtggacagcctgaacgacgacatcctgtgcaccatcgtgatccagcccaccagcggctacgtggagaacatcagccccgcccccggcagcgagaagagcagagccggcatcgccatcagcgccttcaacctgaaggacctgagacagggccacatcaactacgtgcagagcgtgcacaagggcgtggagcccgtggaggacagattcgtgttcagatgcagcgacggcatcaacttcagcgagagacagttcttccccatcgtgatcatccccaccaacgacgagcagcccgagatgttcatgagagagttcatggtgatggagggcatgagcctggtgatcgacacccccatcctgaacgccgccgacgccgacgtgcccctggacgacctgaccttcaccatcacccagttccccacccacggccacatcatgaaccagctgatcaacggcaccgtgctggtggagagcttcaccctggaccagatcatcgagagcagcagcatcatctacgagcacgacgacagcgagacccaggaggacagcttcgtgatcaagctgaccgacggcaagcacagcgtggagaagaccgtgctgatcatcgtgatccccgtggacgacgagacccccagaatgaccatcaacaacggcctggagatcgagatcggcgacaccaagatcatcaacaacaagatcctgatggccaccgacctggacagcgaggacaagagcctggtgtacatcatcagatacggccccggccacggcctgctgcagagaagaaagcccaccggcgccttcgagaacatcaccctgggcatgaacttcacccaggacgaggtggacagaaacctgatccagtacgtgcacctgggccaggagggcatcagagacctgatcaagttcgacgtgaccgacggcatcaaccccctgatcgacagatacttctacgtgagcatcggcagcatcgacatcgtgttccccgacgtgatcagcaagggcgtgagcctgaaggagggcggcaaggtgaccctgaccaccgacctgctgagcaccagcgacctgaacagccccgacgagaacctggtgttcaccatcaccagagcccccatgagaggccacctggagtgcaccgaccagcccggcgtgagcatcaccagcttcacccagctgcagctggccggcaacaagatctactacatccacaccgccgacgacgaggtgaagatggacagcttcgagttccaggtgaccgacggcagaaaccccgtgttcagaaccttcagaatcagcatcagcgacgtggacaacaagaagcccgtggtgaccatccacaagctggtggtgagcgagagcgagaacaagctgatcacccccttcgagctgaccgtggaggacagagacacccccgacaagctgctgaagttcaccatcacccaggtgcccatccacggccacctgctgttcaacaacaccagacccgtgatggtgttcaccaagcaggacctgaacgagaacctgatcagctacaagcacgacggcaccgagagcagcgaggacagcttcagcttcaccgtgaccgacggcacccacaccgacttctacgtgttccccgacaccgtgttcgagaccagaagaccccaggtgatgaagatccaggtgctggccgtggacaacagcgtgccccagatcgccgtgaacaagggcgccagcaccctgagaaccctggccaccggccacctgggcttcatgatcaccagcaagatcctgaaggtggaggacagagacagcctgcacatcagcctgagattcatcgtgaccgaggccccccagcacggctacctgctgaacctggacaagggcaaccacagcatcacccagttcacccaggccgacatcgacgacatgaagatctgctacgtgctgagagagggcgccaacgccaccagcgacatgttctacttcgccgtggaggacggcggcggcaacaagctgacctaccagaacttcagactgaactgggcctggatcagcttcgagaaggagtactacctggtgaacgaggacagcaagttcctggacgtggtgctgaagagaagaggctacctgggcgagaccagcttcatcagcatcggcaccagagacagaaccgccgagaaggacaaggacttcaagggcaaggcccagaagcaggtgcagttcaaccccggccagaccagagccacctggagagtgagaatcctgagcgacggcgagcacgagcagagcgagaccttccaggtggtgctgagcgagcccgtgctggccgccctggagttccccaccgtggccaccgtggagatcgtggaccccggcgacgagcccaccgtgttcatcccccagagcaagtacagcgtggaggaggacgtgggcgagctgttcatccccatcagaagaagcggcgacgtgagccaggagctgatggtggtgtgctacacccagcagggcaccgccaccggcaccgtgcccaccagcgtgctgagctacagcgactacatcagcagacccgaggaccacaccagcgtggtgagattcgacaaggacgagagagagaagctgtgcagaatcgtgatcatcgacgacagcctgtacgaggaggaggagaccttccacgtgctgctgagcatgcccatgggcggcagaatcggcagcgagttccccggcgcccaggtgaccatcgtgcccgacaaggacgacgagcccatcttctacttcggcgacgtggagtacagcgtggacgagagcgccggctacgtggaggtgcaggtgtggagaaccggcaccgacctgagcaagagcagcagcgtgaccgtgagaagcagaaagaccgacccccccagcgccgacgccggcaccgactacgtgggcatcagcagaaacctggacttcgcccccggcgtgaacatgcagcccgtgagagtggtgatcctggacgacctgggccagcccgccctggagggcatcgagaagttcgagctggtgctgagaatgcccatgaacgccgccctgggcgagcccagcaaggccaccgtgagcatcaacgacagcgtgagcgacctgcccaagatgcagttcaaggagagaatctacaccggcagcgagagcgacggccagatcgtgaccatgatccacagaaccggcgacgtgcagtacagaagcagcgtgagatgctacaccagacagggcagcgcccaggtgatgatggacttcgaggagagacccaacaccgacaccagcatcatcaccttcctgcccggcgagaccgagaagccctgcatcctggagctgatggacgacgtgctgtacgaggaggtggaggagctgagactggtgctgggcaccccccagagcaacagccccttcggcgccgccgtgggcgagcagaacgagaccctgatcagaatcagagacgacgccgacaagaccgtgatcaagttcggcgagaccaagttcagcgtgaccgagcccaaggagcccggcgagagcgtggtgatcagaatccccgtgatcagacagggcgacaccagcaaggtgagcatcgtgagagtgcacaccaaggacggcagcgccaccagcggcgaggactaccaccccgtgagcgaggagatcgagttcaaggagggcgagacccagcacgtggtggagatcgaggtgaccttcgacggcgtgagagagatgagagaggccttcaccgtgcacctgaagcccgacgagaacatgatcgccgagatgcagctgaccaaggccatcgtgtacatcgaggagatgagcagcatggccgacgtgaccttccccagcgtgccccagatcgtgagcctgctgatgtacgacgacaccagcaaggccaaggagagcgccgagcccatgagcggctaccccgtgatctgcatcaccgcctgcaaccccaagtacagcgactacgacaagaccggcagcatctgcgccagcgagaacatcaacgacaccctgaccagatacagatggctgatcagcgcccccgccggccccgacggcgtgaccagccccatgagagaggtggacttcgacaccttcttcaccagcagcaagatggtgaccctggacagcatctacttccagcccggcagcagagtgcagtgcgccgccagagccgtgaacaccaacggcgacgagggcctggagctgatgagccccatcgtgaccatcagcagagaggagggcctgtgccagcccagagtgcccggcgtggtgggcgccgagcccttcagcgccaagctgagatacaccggccccgaggacgccgactacaccaacctgatcaagctgaccgtgaccatgccccacatcgacggcatgctgcccgtgatcagcaccagagagctgagcaacttcgagctgaccctgagccccgacggcaccagagtgggcaaccacaagtgcagcaacctgctggactacaccgaggtgaagacccactacggcttcctgaccgacgccaccaagaaccccgagatcatcggcgagacctacccctaccagtacagcctgagcatcagaggcagcaccaccctgagattctacagaaacctgaacctggaggcctgcctgtgggagttcgtgagctactacgacatgagcgagctgctggccgactgcggcggcaccatcggcaccgacggccaggtgctgaacctggtgcagagctacgtgaccctgagagtgcccctgtacgtgagctacgtgttccacagccccgtgggcgtgggcggctggcagcacttcgacctgaagagcgagctgagactgaccttcgtgtacgacaccgccatcctgtggaacgacggcatcggcagcccccccgaggccgagctgcagggcagcctgtaccccaccagcatgagaatcggcgacgagggcagactggccgtgcacttcaagaccgaggcccagttccacggcctgttcgtgctgagccaccccgccagcttcaccagcagcgtgatcatgagcgccgaccaccccggcctgaccttcagcctgagactgatcagaagcgagcccacctacaaccagcccgtgcagcagtggagcttcgtgagcgacttcgccgtgagagactacagcggcacctacaccgtgaagctggtgccctgcaccgcccccagccaccaggagtacagactgcccgtgacctgcaaccccagagagcccgtgaccttcgacctggacatcagattccagcaggtgagcgaccccgtggccgccgagttcagcctgaacacccagatgtacctgctgagcaagaagagcctgtggctgagcgacggcagcatgggcttcggccaggagagcgacgtggccttcgccgagggcgacatcatctacggcagagtgatggtggaccccgtgcagaacctgggcgacagcttctactgcagcatcgagaaggtgttcctgtgcaccggcgccgacggctacgtgcccaagtacagccccatgaacgccgagtacggctgcctggccgacagccccagcctgctgtacagattcaagatcgtggacaaggcccagcccgagacccaggccaccagcttcggcaacgtgctgttcaacgccaagctggccgtggacgaccccgaggccatcctgctggtgaaccagcccggcagcgacggcttcaaggtggacagcacccccctgttccaggtggccctgggcagagagtggtacatccacaccatctacaccgtgagaagcaaggacaacgccaacagaggcatcggcaagagaagcgtggagtaccacagcctggtgagccagggcaagccccagagcaccaccaagagcagaaagaagagagagatcagaagcacccccagcctggcctgggagatcggcgccgagaacagcagaggcaccaacatccagcacatcgccctggacagaaccaagagacagatcccccacggcagagccccccccgacggcatcctgccctgggagctgaacagccccagcagcgccgtgagcctggtgaccgtggtgggcggcaccaccgtgggcctgctgaccatctgcctgaccgtgatcgccgtgctgatgtgcagaggcaaggagagcttcagaggcaaggacgcccccaagggcagcagcagcagcgagcccatggtgcccccccagagccaccacaacgacagcagcgaggtgtag

SEQ ID NO: 82084 - DNA, 12039 bp, Artificial Sequence
  Description of Artificial Sequence: Synthetic coding sequence
atgggcgtgctgaaggtgtggctgggcctggccctggccctggccgagttcgccgtgctgccccaccacagcgagggcgcctgcgtgtaccaggacagcctgctggccgacgccaccatctggaagcccgacagctgccagagctgcagatgccacggcgacatcgtgatctgcaagcccgccgtgtgcagaaacccccagtgcgccttcgagaagggcgaggtgctgcagatcgccgccaaccagtgctgccccgagtgcgtgctgagaacccccggcagctgccaccacgagaagaagatccacgagcacggcaccgagtgggccagcagcccctgcagcgtgtgcagctgcaaccacggcgaggtgagatgcaccccccagccctgcccccccctgagctgcggccaccaggagctggccttcatccccgagggcagctgctgccccgtgtgcgtgggcctgggcaagccctgcagctacgagggccacgtgttccaggacggcgaggactggagactgagcagatgcgccaagtgcctgtgcagaaacggcgtggcccagtgcttcaccgcccagtgccagcccctgttctgcaaccaggacgagaccgtggtgagagtgcccggcaagtgctgcccccagtgcagcgccagaagctgcagcgccgccggccaggtgtacgagcacggcgagcagtggagcgagaacgcctgcaccacctgcatctgcgacagaggcgaggtgagatgccacaagcaggcctgcctgcccctgagatgcggcaagggccagagcagagccagaagacacggccagtgctgcgaggagtgcgtgagccccgccggcagctgcagctacgacggcgtggtgagataccaggacgagatgtggaagggcagcgcctgcgagttctgcatgtgcgaccacggccaggtgacctgccagaccggcgagtgcgccaaggtggagtgcgccagagacgaggagctgatccacctggacggcaagtgctgccccgagtgcatcagcagaaacggctactgcgtgtacgaggagaccggcgagttcatgagcagcaacgccagcgaggtgaagagaatccccgagggcgagaagtgggaggacggcccctgcaaggtgtgcgagtgcagaggcgcccaggtgacctgctacgagcccagctgccccccctgccccgtgggcaccctggccctggaggtgaagggccagtgctgccccgactgcaccagcgtgcactgccaccccgactgcctgacctgcagccagagccccgaccactgcgacctgtgccaggaccccaccaagctgctgcagaacggctggtgcgtgcacagctgcggcctgggcttctaccaggccggcagcctgtgcctggcctgccagccccagtgcagcacctgcaccagcggcctggagtgcagcagctgccagccccccctgctgatgagacacggccagtgcgtgcccacctgcggcgacggcttctaccaggacagacacagctgcgccgtgtgccacgagagctgcgccggctgctggggccccaccgagaagcactgcctggcctgcagagaccccctgcacgtgctgagagacggcggctgcgagagcagctgcggcaagggcttctacaacagacagggcacctgcagcgcctgcgaccagagctgcgacagctgcggccccagcagccccagatgcctgacctgcaccgagaagaccgtgctgcacgacggcaagtgcatgagcgagtgccccggcggctactacgccgacgccaccggcagatgcaaggtgtgccacaacagctgcgccagctgcagcggccccacccccagccactgcaccgcctgcagcccccccaaggccctgagacagggccactgcctgcccagatgcggcgagggcttctacagcgaccacggcgtgtgcaaggcctgccacagcagctgcctggcctgcatgggccccgcccccagccactgcaccggctgcaagaagcccgaggagggcctgcaggtggagcagctgagcgacgtgggcatccccagcggcgagtgcctggcccagtgcagagcccacttctacctggagagcaccggcatctgcgaggcctgccaccagagctgcttcagatgcgccggcaagagcccccacaactgcaccgactgcggccccagccacgtgctgctggacggccagtgcctgagccagtgccccgacggctacttccaccaggagggcagctgcaccgagtgccaccccacctgcagacagtgccacggccccctggagagcgactgcatcagctgctacccccacatcagcctgaccaacggcaactgcagaaccagctgcagagaggagcagttcctgaacctggtgggctactgcgccgactgccaccacctgtgccagcactgcgccgccgacctgcacaacaccggcagcatctgcctgagatgccagaacgcccactacctgctgctgggcgaccactgcgtgcccgactgccccagcggctactacgccgagagaggcgcctgcaagaagtgccacagcagctgcagaacctgccagggcagaggccccttcagctgcagcagctgcgacaccaacctggtgctgagccacaccggcacctgcagcaccacctgcttccccggccactacctggacgacaaccacgtgtgccagccctgcaacacccactgcggcagctgcgacagccaggccagctgcaccagctgcagagaccccaacaaggtgctgctgttcggcgagtgccagtacgagagctgcgccccccagtactacctggacttcagcaccaacacctgcaaggagtgcgactggagctgcagcgcctgcagcggccccctgaagaccgactgcctgcagtgcatggacggctacgtgctgcaggacggcgcctgcgtggagcagtgcctgagcagcttctaccaggacagcggcctgtgcaagaactgcgacagctactgcctgcagtgccagggcccccacgagtgcaccagatgcaagggccccttcctgctgctggaggcccagtgcgtgcaggagtgcggcaagggctacttcgccgaccacgccaagcacaagtgcaccgcctgcccccagggctgcctgcagtgcagccacagagacagatgccacctgtgcgaccacggcttcttcctgaagagcggcctgtgcgtgtacaactgcgtgcccggcttcagcgtgcacaccagcaacgagacctgcagcggcaagatccacacccccagcctgcacgtgaacggcagcctgatcctgcccatcggcagcatcaagcccctggacttcagcctgctgaacgtgcaggaccaggagggcagagtggaggacctgctgttccacgtggtgagcacccccaccaacggccagctggtgctgagcagaaacggcaaggaggtgcagctggacaaggccggcagattcagctggaaggacgtgaacgagaagaaggtgagattcgtgcacagcaaggagaagctgagaaagggctacctgttcctgaagatcagcgaccagcagttcttcagcgagccccagctgatcaacatccaggccttcagcacccaggccccctacgtgctgagaaacgaggtgctgcacatcagcagaggcgagagagccaccatcaccacccagatgctggacatcagagacgacgacaacccccaggacgtggtgatcgagatcatcgacccccccctgcacggccagctgctgcagaccctgcagagccccgccacccccatctaccagttccagctggacgagctgagcagaggcctgctgcactacgcccacgacggcagcgacagcaccagcgacgtggccgtgctgcaggccaacgacggccacagcttccacaacatcctgttccaggtgaagaccgtgccccagaacgacagaggcctgcagctggtggccaacagcatggtgtgggtgcccgagggcggcatgctgcagatcaccaacagaatcctgcaggccgaggcccccggcgccagcgccgaggagatcatctacaagatcacccaggactacccccagttcggcgaggtggtgctgctggtgaacatgcccgccgacagccccgccgacgagggccagcacctgcccgacggcagaaccgccacccccaccagcaccttcacccagcaggacatcaacgagggcatcgtgtggtacagacacagcggcgcccccgcccagagcgacagcttcagattcgaggtgagcagcgccagcaacgcccagaccagactggagagccacatgttcaacatcgccatcctgccccagacccccgaggcccccaaggtgagcctggaggccagcctgcacatgaccgccagagaggacggcctgaccgtgatccagccccacagcctgagcttcatcaacagcgagaagcccagcggcaagatcgtgtacaacatcaccctgcccctgcaccccaaccagggcatcatcgagcacagagaccacccccacagccccatcagatacttcacccaggaggacatcaaccagggcaaggtgatgtacagacccccccccgccgccccccacctgcaggagctgatggccttcagcttcgccggcctgcccgagagcgtgaagttccacttcaccgtgagcgacggcgagcacaccagccccgagatggtgctgaccatccacctgctgcccagcgaccagcagctgcccgtgttccaggtgaccgcccccagactggccgtgagccccggcggcagcaccagcgtgggcctgcaggtggtggtgagagacgccgagaccgcccccaaggagctgttcttcgagctgagaagacccccccagcacggcgtgctgctgaagcacaccgccgagttcagaagacccatggccaccggcgacaccttcacctacgaggacgtggagaagaacgccctgcagtacatccacgacggcagcagcaccagagaggacagcatggagatcagcgtgaccgacggcctgaccgtgaccatgctggaggtgagagtggaggtgagcctgagcgaggacagaggccccagactggccgccggcagcagcctgagcatcaccgtggccagcaagagcaccgccatcatcaccagaagccacctggcctacgtggacgacagcagccccgaccccgagatctggatccagctgaactacctgcccagctacggcaccctgctgagaatcagcggcagcgaggtggaggagctgagcgaggtgagcaacttcaccatggaggacatcaacaacaagaagatcagatacagcgccgtgttcgagaccgacggccacctggtgaccgacagcttctacttcagcgtgagcgacatggaccacaaccacctggacaaccagatcttcaccatcatgatcacccccgccgagaaccccccccccgtgatcgccttcgccgacctgatcaccgtggacgagggcggcagagcccccctgagcttccaccacttcttcgccaccgacgacgacgacaacctgcagagagacgccatcatcaagctgagcgccctgcccaagtacggctgcatcgagaacaccggcaccggcgacagattcggccccgagaccgccagcgacctggaggccagcttccccatccaggacgtgctggagaactacatctactacttccagagcgtgcacgagagcatcgagcccacccacgacatcttcagcttctacgtgagcgacggcaccagcagaagcgagatccacagcatcaacatcaccatcgagagaaagaacgacgagccccccagaatgaccctgcagcccctgagagtgcagctgagcagcggcgtggtgatcagcaacagcagcctgagcctgcaggacctggacacccccgacaacgagctgatcttcgtgctgaccaagaagcccgaccacggccacgtgctgtggagacagaccgccagcgagcccctggagaacggcagagtgctggtgcagggcagcaccttcacctaccaggacatcctggccggcctggtgggctacgtgcccagcgtgcccggcatggtggtggacgagttccagttcagcctgaccgacggcctgcacgtggacaccggcagaatgaagatctacaccgagctgcccgccagcgacaccccccacctggccatcaaccagggcctgcagctgagcgccggcagcgtggccagaatcaccgagcagcacctgaaggtgaccgacatcgacagcgacgaccaccaggtgatgtacatcatgaaggaggaccccggcgccggcagactgcagatgatgaagcacggcaacctggagcagatcagcatcaagggccccatcagaagcttcacccaggccgacatcagccagggccacgtggagtacagccacggcaccggcgagcccggcggcagcttcgccttcaagttcgacgtggtggacggcgagggcaacagactgatcgacaagagcttcagcatcagcatcctggaggacaagagcccccccgtgatcaccaccaacaagggcctggtgctggacgagaacagcgtgaagaagatcaccaccctgcagctgagcgccaccgaccaggacagcggccccaccgagctgatctacagaatcaccagacagccccagctgggccacctggagcacgccgccagccccggcatccagatcagcagcttcacccaggccgacctgaccagcagaaacgtgcagtacgtgcacagcagcgaggccgagaagcacagcgacgccttcagcttcaccctgagcgacggcgtgagcgaggtgacccagaccttccacatcaccctgcaccccgtggacgacagcctgcccgtggtgcagaacctgggcatgagagtgcaggagggcatgagaaagaccatcaccgagttcgagctgaaggccgtggacgccgacaccgaggccgagagcgtgaccttcaccatcgtgcagccccccagacacggcaccatcgagagaaccagcaacggccagcacttccacctgaccagcaccttcaccatgaaggacatctaccagaacagagtgagctacagccacgacggcagcaacagcctgaaggacagattcaccttcaccgtgagcgacggcaccaaccccttcttcatcatcgaggagggcggcaaggagatcatgaccgccgccccccagcccttcagagtggacatcctgcccgtggacgacggcacccccagaatcgtgaccaacctgggcctgcagtggctggagtacatggacggcaaggccaccaacctgatcaccaagaaggagctgctgaccatggaccccgacaccgaggacgcccagctggtgtacgagatcaccaccggccccaagcacggcttcgtggagaacaagctgcagcccggcagagccgccgccaccttcacccaggaggacgtgaacctgggcctgatcagatacgtgctgcacaaggagaagatcagagagatgatggacagcttccagttcctggtgaaggacagcaagcccaacgtggtgagcgacaacgtgttccacatccagtggagcctgatcagcttcaagtacaccagctacaacgtgagcgagaaggccggcagcgtgagcgtgaccgtgcagagaaccggcaacctgaaccagtacgccatcgtgctgtgcagaaccgagcagggcaccgccagcagcagcagcagagtgagcagccagcccggccagcaggactacgtggagtacgccggccaggtgcagttcgacgagagagaggacaccaagagctgcaccatcgtgatcaacgacgacgacgtgttcgagaacgtggagagcttcaccgtggagctgagcatgcccgcctacgccctgctgggcgagttcacccaggccaaggtgatcatcaacgacaccgaggacgagcccaccctggagttcgacaagaagatctactgggtgaacgagagcgccggcttcctgttcgcccccatcgagagaaagggcgacgccagcagcatcgtgagcgccatctgctacaccgtgcccaagagcgccatgggcagcagcctgtacgccctggagagcggcagcgacttcaagagcagaggcatgagcgccgccagcagagtgatcttcggccccggcgtgaccatgagcacctgcgacgtgatgctgatcgacgacagcgagtacgaggaggaggaggagttcgagatcgccctggccgacgccagcgacaacgccagaatcggcagagtggccaccgccaaggtgctgatcagcggccccaacgacgccagcaccgtgagcctgggcaacaccgccttcaccgtgagcgaggacgccggcaccgtgaagatccccgtgatcagacacggcaccgacctgagcaccttcgccagcgtgtggtgcgccaccagacccagcgaccccgccagcgccacccccggcgtggactacgtgcccagcagcagaaaggtggagttcggccccggcgtgatcgagcagtactgcaccctgaccatcctggacgacacccagtaccccgtgatcgagggcctggagaccttcgtggtgttcctgagcagcgcccagggcgccgagctgaccaagcccttccaggccgtgatcgccatcaacgacaccttccaggacgtgcccagcatgcagttcgccaaggacctgctgctggtgaaggagaaggagggcgtgctgcacgtgcccatcaccagaagcggcgacctgagctacgagagcagcgtgagatgctacacccagagccacagcgcccaggtgatggaggacttcgaggagagacagaacgccgacagcagcagaatcaccttcctgaagggcgacaaggtgaagaactgcaccgtgtacatccacgacgacagcatgttcgagcccgaggagcagttcagagtgtacctgggcctgcccctgggcaaccactggagcggcgccagaatcggcaagaacaacatggccaccatcaccatcagcaacgacgaggacgcccccaccatcgagttcgaggaggccgcctaccaggtgagagagcccgccggccccgacgccatcgccatcctgaacatcaaggtgatcagaagaggcgaccagaacagaaccagcaaggtgagatgcagcaccagagacggcagcgcccagagcggcgtggactactaccccaagagcagagtgctgaagttcagccccggcgtggaccacatcttcttcaaggtggagatcctgagcaacgaggacagagagtggcacgagagcttcagcctggtgctgggccccgacgaccccgtggaggccgtgctgggcgacgtgaccaccgccaccgtgaccatcctggaccaggaggccgccggcagcctgatcctgcccgccccccccatcgtggtgaccctggccgactacgaccacgtggaggaggtgaccaaggagggcgtgaagaagagccccagccccggctaccccctggtgtgcgtgaccccctgcgacccccacttccccagatacgccgtgatgaaggagagatgcagcgaggccggcatcaaccagaccagcgtgcagttcagctgggaggtggccgcccccaccgacggcaacggcgccagaagccccttcgagaccatcaccgacaacacccccttcaccagcgtgaaccacatggtgctggacagcatctacttcagcagaagattccacgtgagatgcgtggccaaggccgtggacaaggtgggccacgtgggcacccccctgagaagcaacatcgtgaccatcggcaccgacagcgccatctgccacacccccgtggtggccggcaccagcagaggcttccaggcccagagcttcatcgccaccctgaagtacctggacgtgaagcacaaggagcaccccaacagaatccacatcagcgtgcagatcccccaccaggacggcatgctgcccctgatcagcaccatgcccctgcacaacctgcacttcctgctgagcgagagcatctacagacaccagcacgtgtgcagcaacctggtgaccacctacgacctgagaggcatcagcgaggccggcttcctggacgacgtggtgtacgacagcaccgccctgggccccggctacgacagacccttccagttcgaccccagcgtgagagagcccaagaccatccagctgtacaagcacctgaacctgaagagctgcgtgtggaccttcgacgcctactacgacatgaccgagctgatcgacgtgtgcggcggcagcgtgaccgccgacttccaggtgagagacagcgcccagagcttcctgaccgtgcacgtgcccctgtacgtgagctacatctacgtgaccgcccccagaggctgggccagcctggagcaccacaccgagatggagttcagcttcttctacgacaccgtgctgtggagaaccggcatccagaccgacagcgtgctgagcgccagactgcagatcatcagaatctacatcagagaggacggcagactggtgatcgagttcaagacccacgccaagttcagaggccagttcgtgatggagcaccacaccctgcccgaggtgaagagcttcgtgctgacccccgaccacctgggcggcatcgagttcgacctgcagctgctgtggagcgcccagaccttcgacagcccccaccagctgtggagagccaccagcagctacaacagaaaggactacagcggcgagtacaccatctacctgatcccctgcaccgtgcagcccacccagccctgggtggaccccggcgagaagcccctggcctgcaccgcccacgcccccgagagattcctgatccccatcgccttccagcagaccaacagacccgtgcccgtggtgtacagcctgaacaccgagttccagctgtgcaacaacgagaaggtgttcctgatggaccccaacaccagcgacatgagcctggccgagatggactacaagggcgccttcagcaagggccagatcctgtacggcagagtgctgtggaaccccgagcagaacctgaacagcgcctacaagctgcagctggagaaggtgtacctgtgcaccggcaaggacggctacgtgcccttcttcgaccccaccggcaccatctacaacgagggcccccagtacggctgcatccagcccaacaagcacctgaagcacagattcctgctgctggacagaaaccagcccgaggtgaccgacaagtacttccacgacgtgcccttcgaggcccacttcgccagcgagctgcccgacttccacgtggtgagcaacatgcccggcgtggacggcttcaccctgaaggtggacgccctgtacaaggtggaggccggccaccagtggtacctgcaggtgatctacatcatcggccccgacaccatcagcggccccagagtgcagagaagcctgaccgcccccctgagaagaaacagaagagacctggtggagcccgacggccagctgatcctggacgacagcctgatctacgacaacgagggcgaccaggtgaagaacggcaccaacatgaagagcctgaacctggagatgcaggagctggccgtggccgccagcctgagccagaccggcgccagcatcggcagcgccctggccgccatcatgctgctgctgctggtgttcctggtggcctgcttcatcaacagaaagtgccagaagcagagaaagaagaagcccgccgaggacatcctggaggagtaccccctgaacaccaaggtggaggtgcccaagagacaccccgacagagtggagaagaacgtgaacagacactactgcaccgtgagaaacgtgaacatcctgagcgagcccgaggccgcctacaccttcaagggcgccaaggtgaagagactgaacctggaggtgagagtgcacaacaacctgcaggacggcaccgaggtgtag

SEQ ID NO: 82085 - DNA, 2214 bp, Artificial Sequence
  Description of Artificial Sequence: Synthetic coding sequence
atgggcgtgctgaaggtgtggctgggcctggccctggccctggccgagttcgccgtgctgccccaccacagcgagggcgcctgcgtgtaccaggacagcctgctggccgacgccaccatctggaagcccgacagctgccagagctgcagatgccacggcgacatcgtgatctgcaagcccgccgtgtgcagaaacccccagtgcgccttcgagaagggcgaggtgctgcagatcgccgccaaccagtgctgccccgagtgcgtgctgagaacccccggcagctgccaccacgagaagaagatccacgagcacggcaccgagtgggccagcagcccctgcagcgtgtgcagctgcaaccacggcgaggtgagatgcaccccccagccctgcccccccctgagctgcggccaccaggagctggccttcatccccgagggcagctgctgccccgtgtgcgtgggcctgggcaagccctgcagctacgagggccacgtgttccaggacggcgaggactggagactgagcagatgcgccaagtgcctgtgcagaaacggcgtggcccagtgcttcaccgcccagtgccagcccctgttctgcaaccaggacgagaccgtggtgagagtgcccggcaagtgctgcccccagtgcagcgccagaagctgcagcgccgccggccaggtgtacgagcacggcgagcagtggagcgagaacgcctgcaccacctgcatctgcgacagaggcgaggtgagatgccacaagcaggcctgcctgcccctgagatgcggcaagggccagagcagagccagaagacacggccagtgctgcgaggagtgcgtgagccccgccggcagctgcagctacgacggcgtggtgagataccaggacgagatgtggaagggcagcgcctgcgagttctgcatgtgcgaccacggccaggtgacctgccagaccggcgagtgcgccaaggtggagtgcgccagagacgaggagctgatccacctggacggcaagtgctgccccgagtgcatcagcagaaacggctactgcgtgtacgaggagaccggcgagttcatgagcagcaacgccagcgaggtgaagagaatccccgagggcgagaagtgggaggacggcccctgcaaggtgtgcgagtgcagaggcgcccaggtgacctgctacgagcccagctgccccccctgccccgtgggcaccctggccctggaggtgaagggccagtgctgccccgactgcaccagcgtgcactgccaccccgactgcctgacctgcagccagagccccgaccactgcgacctgtgccaggaccccaccaagctgctgcagaacggctggtgcgtgcacagctgcggcctgggcttctaccaggccggcagcctgtgcctggcctgccagccccagtgcagcacctgcaccagcggcctggagtgcagcagctgccagccccccctgctgatgagacacggccagtgcgtgcccacctgcggcgacggcttctaccaggacagacacagctgcgccgtgtgccacgagagctgcgccggctgctggggccccaccgagaagcactgcctggcctgcagagaccccctgcacgtgctgagagacggcggctgcgagagcagctgcggcaagggcttctacaacagacagggcacctgcagcgcctgcgaccagagctgcgacagctgcggccccagcagccccagatgcctgacctgcaccgagaagaccgtgctgcacgacggcaagtgcatgagcgagtgccccggcggctactacgccgacgccaccggcagatgcaaggtgtgccacaacagctgcgccagctgcagcggccccacccccagccactgcaccgcctgcagcccccccaaggccctgagacagggccactgcctgcccagatgcggcgagggcttctacagcgaccacggcgtgtgcaaggcctgccacagcagctgcctggcctgcatgggccccgcccccagccactgcaccggctgcaagaagcccgaggagggcctgcaggtggagcagctgagcgacgtgggcatccccagcggcgagtgcctggcccagtgcagagcccacttctacctggagagcaccggcatctgcgagggccagaacctggacttctgccagaacctggaggtgatcagcgccgtgtgcctgggcatcagcagcaccgagaactag

SEQ ID NO: 82086 - DNA, 954 bp, Artificial Sequence
  Description of Artificial Sequence: Synthetic coding sequence
atgggcgtgctgaaggtgtggctgggcctggccctggccctggccgagttcgccgtgctgccccaccacagcgagggcgcctgcgtgtaccaggacagcctgctggccgacgccaccatctggaagcccgacagctgccagagctgcagatgccacggcgacatcgtgatctgcaagcccgccgtgtgcagaaacccccagtgcgccttcgagaagggcgaggtgctgcagatcgccgccaaccagtgctgccccgagtgcgtgctgagaacccccggcagctgccaccacgagaagaagatccacgagcacggcaccgagtgggccagcagcccctgcagcgtgtgcagctgcaaccacggcgaggtgagatgcaccccccagccctgcccccccctgagctgcggccaccaggagctggccttcatccccgagggcagctgctgccccgtgtgcgtgggcctgggcaagccctgcagctacgagggccacgtgttccaggacggcgaggactggagactgagcagatgcgccaagtgcctgtgcagaaacggcgtggcccagtgcttcaccgcccagtgccagcccctgttctgcaaccaggacgagaccgtggtgagagtgcccggcaagtgctgcccccagtgcagcgccagaagctgcagcgccgccggccaggtgtacgagcacggcgagcagtggagcgagaacgcctgcaccacctgcatctgcgacagaggcgaggtgagatgccacaagcaggcctgcctgcccctgagatgcggcaagggccagagcagagccagaagacacggccagtgctgcgaggagtgcgtgagccccgccctggccagccagagcgtgggcatcaccggcatgagccaccacgcccagagcctgctgggccccttcctgacccagatcaagaagccccacttcagctgcctggagtag

SEQ ID NO: 82087 - DNA, 6726 bp, Artificial Sequence
  Description of Artificial Sequence: Synthetic coding sequence
tgaagcgaggtgagcaacttcaccatggaggacatcaacaacaagaagatcagatacagcgccgtgttcgagaccgacggccacctggtgaccgacagcttctacttcagcgtgagcgacatggaccacaaccacctggacaaccagatcttcaccatcatgatcacccccgccgagaaccccccccccgtgatcgccttcgccgacctgatcaccgtggacgagggcggcagagcccccctgagcttccaccacttcttcgccaccgacgacgacgacaacctgcagagagacgccatcatcaagctgagcgccctgcccaagtacggctgcatcgagaacaccggcaccggcgacagattcggccccgagaccgccagcgacctggaggccagcttccccatccaggacgtgctggagaactacatctactacttccagagcgtgcacgagagcatcgagcccacccacgacatcttcagcttctacgtgagcgacggcaccagcagaagcgagatccacagcatcaacatcaccatcgagagaaagaacgacgagccccccagaatgaccctgcagcccctgagagtgcagctgagcagcggcgtggtgatcagcaacagcagcctgagcctgcaggacctggacacccccgacaacgagctgatcttcgtgctgaccaagaagcccgaccacggccacgtgctgtggagacagaccgccagcgagcccctggagaacggcagagtgctggtgcagggcagcaccttcacctaccaggacatcctggccggcctggtgggctacgtgcccagcgtgcccggcatggtggtggacgagttccagttcagcctgaccgacggcctgcacgtggacaccggcagaatgaagatctacaccgagctgcccgccagcgacaccccccacctggccatcaaccagggcctgcagctgagcgccggcagcgtggccagaatcaccgagcagcacctgaaggtgaccgacatcgacagcgacgaccaccaggtgatgtacatcatgaaggaggaccccggcgccggcagactgcagatgatgaagcacggcaacctggagcagatcagcatcaagggccccatcagaagcttcacccaggccgacatcagccagggccacgtggagtacagccacggcaccggcgagcccggcggcagcttcgccttcaagttcgacgtggtggacggcgagggcaacagactgatcgacaagagcttcagcatcagcatcctggaggacaagagcccccccgtgatcaccaccaacaagggcctggtgctggacgagaacagcgtgaagaagatcaccaccctgcagctgagcgccaccgaccaggacagcggccccaccgagctgatctacagaatcaccagacagccccagctgggccacctggagcacgccgccagccccggcatccagatcagcagcttcacccaggccgacctgaccagcagaaacgtgcagtacgtgcacagcagcgaggccgagaagcacagcgacgccttcagcttcaccctgagcgacggcgtgagcgaggtgacccagaccttccacatcaccctgcaccccgtggacgacagcctgcccgtggtgcagaacctgggcatgagagtgcaggagggcatgagaaagaccatcaccgagttcgagctgaaggccgtggacgccgacaccgaggccgagagcgtgaccttcaccatcgtgcagccccccagacacggcaccatcgagagaaccagcaacggccagcacttccacctgaccagcaccttcaccatgaaggacatctaccagaacagagtgagctacagccacgacggcagcaacagcctgaaggacagattcaccttcaccgtgagcgacggcaccaaccccttcttcatcatcgaggagggcggcaaggagatcatgaccgccgccccccagcccttcagagtggacatcctgcccgtggacgacggcacccccagaatcgtgaccaacctgggcctgcagtggctggagtacatggacggcaaggccaccaacctgatcaccaagaaggagctgctgaccatggaccccgacaccgaggacgcccagctggtgtacgagatcaccaccggccccaagcacggcttcgtggagaacaagctgcagcccggcagagccgccgccaccttcacccaggaggacgtgaacctgggcctgatcagatacgtgctgcacaaggagaagatcagagagatgatggacagcttccagttcctggtgaaggacagcaagcccaacgtggtgagcgacaacgtgttccacatccagtggagcctgatcagcttcaagtacaccagctacaacgtgagcgagaaggccggcagcgtgagcgtgaccgtgcagagaaccggcaacctgaaccagtacgccatcgtgctgtgcagaaccgagcagggcaccgccagcagcagcagcagagtgagcagccagcccggccagcaggactacgtggagtacgccggccaggtgcagttcgacgagagagaggacaccaagagctgcaccatcgtgatcaacgacgacgacgtgttcgagaacgtggagagcttcaccgtggagctgagcatgcccgcctacgccctgctgggcgagttcacccaggccaaggtgatcatcaacgacaccgaggacgagcccaccctggagttcgacaagaagatctactgggtgaacgagagcgccggcttcctgttcgcccccatcgagagaaagggcgacgccagcagcatcgtgagcgccatctgctacaccgtgcccaagagcgccatgggcagcagcctgtacgccctggagagcggcagcgacttcaagagcagaggcatgagcgccgccagcagagtgatcttcggccccggcgtgaccatgagcacctgcgacgtgatgctgatcgacgacagcgagtacgaggaggaggaggagttcgagatcgccctggccgacgccagcgacaacgccagaatcggcagagtggccaccgccaaggtgctgatcagcggccccaacgacgccagcaccgtgagcctgggcaacaccgccttcaccgtgagcgaggacgccggcaccgtgaagatccccgtgatcagacacggcaccgacctgagcaccttcgccagcgtgtggtgcgccaccagacccagcgaccccgccagcgccacccccggcgtggactacgtgcccagcagcagaaaggtggagttcggccccggcgtgatcgagcagtactgcaccctgaccatcctggacgacacccagtaccccgtgatcgagggcctggagaccttcgtggtgttcctgagcagcgcccagggcgccgagctgaccaagcccttccaggccgtgatcgccatcaacgacaccttccaggacgtgcccagcatgcagttcgccaaggacctgctgctggtgaaggagaaggagggcgtgctgcacgtgcccatcaccagaagcggcgacctgagctacgagagcagcgtgagatgctacacccagagccacagcgcccaggtgatggaggacttcgaggagagacagaacgccgacagcagcagaatcaccttcctgaagggcgacaaggtgaagaactgcaccgtgtacatccacgacgacagcatgttcgagcccgaggagcagttcagagtgtacctgggcctgcccctgggcaaccactggagcggcgccagaatcggcaagaacaacatggccaccatcaccatcagcaacgacgaggacgcccccaccatcgagttcgaggaggccgcctaccaggtgagagagcccgccggccccgacgccatcgccatcctgaacatcaaggtgatcagaagaggcgaccagaacagaaccagcaaggtgagatgcagcaccagagacggcagcgcccagagcggcgtggactactaccccaagagcagagtgctgaagttcagccccggcgtggaccacatcttcttcaaggtggagatcctgagcaacgaggacagagagtggcacgagagcttcagcctggtgctgggccccgacgaccccgtggaggccgtgctgggcgacgtgaccaccgccaccgtgaccatcctggaccaggaggccgccggcagcctgatcctgcccgccccccccatcgtggtgaccctggccgactacgaccacgtggaggaggtgaccaaggagggcgtgaagaagagccccagccccggctaccccctggtgtgcgtgaccccctgcgacccccacttccccagatacgccgtgatgaaggagagatgcagcgaggccggcatcaaccagaccagcgtgcagttcagctgggaggtggccgcccccaccgacggcaacggcgccagaagccccttcgagaccatcaccgacaacacccccttcaccagcgtgaaccacatggtgctggacagcatctacttcagcagaagattccacgtgagatgcgtggccaaggccgtggacaaggtgggccacgtgggcacccccctgagaagcaacatcgtgaccatcggcaccgacagcgccatctgccacacccccgtggtggccggcaccagcagaggcttccaggcccagagcttcatcgccaccctgaagtacctggacgtgaagcacaaggagcaccccaacagaatccacatcagcgtgcagatcccccaccaggacggcatgctgcccctgatcagcaccatgcccctgcacaacctgcacttcctgctgagcgagagcatctacagacaccagcacgtgtgcagcaacctggtgaccacctacgacctgagaggcatcagcgaggccggcttcctggacgacgtggtgtacgacagcaccgccctgggccccggctacgacagacccttccagttcgaccccagcgtgagagagcccaagaccatccagctgtacaagcacctgaacctgaagagctgcgtgtggaccttcgacgcctactacgacatgaccgagctgatcgacgtgtgcggcggcagcgtgaccgccgacttccaggtgagagacagcgcccagagcttcctgaccgtgcacgtgcccctgtacgtgagctacatctacgtgaccgcccccagaggctgggccagcctggagcaccacaccgagatggagttcagcttcttctacgacaccgtgctgtggagaaccggcatccagaccgacagcgtgctgagcgccagactgcagatcatcagaatctacatcagagaggacggcagactggtgatcgagttcaagacccacgccaagttcagaggccagttcgtgatggagcaccacaccctgcccgaggtgaagagcttcgtgctgacccccgaccacctgggcggcatcgagttcgacctgcagctgctgtggagcgcccagaccttcgacagcccccaccagctgtggagagccaccagcagctacaacagaaaggactacagcggcgagtacaccatctacctgatcccctgcaccgtgcagcccacccagccctgggtggaccccggcgagaagcccctggcctgcaccgcccacgcccccgagagattcctgatccccatcgccttccagcagaccaacagacccgtgcccgtggtgtacagcctgaacaccgagttccagctgtgcaacaacgagaaggtgttcctgatggaccccaacaccagcgacatgagcctggccgagatggactacaagggcgccttcagcaagggccagatcctgtacggcagagtgctgtggaaccccgagcagaacctgaacagcgcctacaagctgcagctggagaaggtgtacctgtgcaccggcaaggacggctacgtgcccttcttcgaccccaccggcaccatctacaacgagggcccccagtacggctgcatccagcccaacaagcacctgaagcacagattcctgctgctggacagaaaccagcccgaggtgaccgacaagtacttccacgacgtgcccttcgaggcccacttcgccagcgagctgcccgacttccacgtggtgagcaacatgcccggcgtggacggcttcaccctgaaggtggacgccctgtacaaggtggaggccggccaccagtggtacctgcaggtgatctacatcatcggccccgacaccatcagcggccccagagtgcagagaagcctgaccgcccccctgagaagaaacagaagagacctggtggagcccgacggccagctgatcctggacgacagcctgatctacgacaacgagggcgaccaggtgaagaacggcaccaacatgaagagcctgaacctggagatgcaggagctggccgtggccgccagcctgagccagaccggcgccagcatcggcagcgccctggccgccatcatgctgctgctgctggtgttcctggtggcctgcttcatcaacagaaagtgccagaagcagagaaagaagaagcccgccgaggacatcctggaggagtaccccctgaacaccaaggtggaggtgcccaagagacaccccgacagagtggagaagaacgtgaacagacactactgcaccgtgagaaacgtgaacatcctgagcgagcccgaggccgcctacaccttcaagggcgccaaggtgaagagactgaacctggaggtgagagtgcacaacaacctgcaggacggcaccgaggtgtag

SEQ ID NO: 82088 - DNA, 768 bp, Artificial Sequence
  Description of Artificial Sequence: Synthetic coding sequence
gagagacagggccagagcagagccagaagacacggccagtgctgcgaggagtgcgtgagccccgccggcagctgcagctacgacggcgtggtgagataccaggacgagatgtggaagggcagcgcctgcgagttctgcatgtgcgaccacggccaggtgacctgccagaccggcgagtgcgccaaggtggagtgcgccagagacgaggagctgatccacctggacggcaagtgctgccccgagtgcatcagcagaaacggctactgcgtgtacgaggagaccggcgagttcatgagcagcaacgccagcgaggtgaagagaatccccgagggcgagaagtgggaggacggcccctgcaaggtgtgcgagtgcagaggcgcccaggtgacctgctacgagcccagctgccccccctgccccgtgggcaccctggccctggaggtgaagggccagtgctgccccgactgcaccagcgtgcactgccaccccgactgcctgacctgcagccagagccccgaccactgcgacctgtgccaggaccccaccaagctgctgcagaacggctggtgcgtgcacagctgcggcctgggcttctaccaggccggcagcctgtgcctggacgacggcttcagcctgcccgcccccgtgctgcacgtgtaccagtgggccggcgtgctgatcctgcccgccagccccgccgacgccgccagagccgtgtgcgcctacctgtggggcagactgctgcccagaagccccttcctgtgctag

SEQ ID NO: 82089 - DNA, 840 bp, Artificial Sequence
  Description of Artificial Sequence: Synthetic coding sequence
atggtgctgaccatccacctgctgcccagcgaccagcagctgcccgtgttccaggtgaccgcccccagactggccgtgagccccggcggcagcaccagcgtgggcctgcaggtggtggtgagagacgccgagaccgcccccaaggagctgttcttcgagctgagaagacccccccagcacggcgtgctgctgaagcacaccgccgagttcagaagacccatggccaccggcgacaccttcacctacgaggacgtggagaagaacgccctgcagtacatccacgacggcagcagcaccagagaggacagcatggagatcagcgtgaccgacggcctgaccgtgaccatgctggaggtgagagtggaggtgagcctgagcgaggacagaggccccagactggccgccggcagcagcctgagcatcaccgtggccagcaagagcaccgccatcatcaccagaagccacctggcctacgtggacgacagcagccccgaccccgagatctggatccagctgaactacctgcccagctacggcaccctgctgagaatcagcggcagcgaggtggaggagctgagcgaggtgagcaacttcaccatggaggacatcaacaacaagaagatcagatacagcgccgtgttcgagaccgacggccacctggtgaccgacagcttctacttcagcgtgagcgacatggaccacaaccacctggacaaccagatcttcaccatcatgatcacccccgccgagaaccccccccccgtgatcgccttcgccgacctgatcaccgtggacgagggcggcagagcccccctgagcttccaccacttctgctactag

SEQ ID NO: 82090 - DNA, 5931 bp, Artificial Sequence
  Description of Artificial Sequence: Synthetic coding sequence
atgggcgtgctgaaggtgtggctgggcctggccctggccctggccgagttcgccgtgctgccccaccacagcgagggcgcctgcgtgtaccaggacagcctgctggccgacgccaccatctggaagcccgacagctgccagagctgcagatgccacggcgacatcgtgatctgcaagcccgccgtgtgcagaaacccccagtgcgccttcgagaagggcgaggtgctgcagatcgccgccaaccagtgctgccccgagtgcgtgctgagaacccccggcagctgccaccacgagaagaagatccacgagcacggcaccgagtgggccagcagcccctgcagcgtgtgcagctgcaaccacggcgaggtgagatgcaccccccagccctgcccccccctgagctgcggccaccaggagctggccttcatccccgagggcagctgctgccccgtgtgcgtgggcctgggcaagccctgcagctacgagggccacgtgttccaggacggcgaggactggagactgagcagatgcgccaagtgcctgtgcagaaacggcgtggcccagtgcttcaccgcccagtgccagcccctgttctgcaaccaggacgagaccgtggtgagagtgcccggcaagtgctgcccccagtgcagcgccagaagctgcagcgccgccggccaggtgtacgagcacggcgagcagtggagcgagaacgcctgcaccacctgcatctgcgacagaggcgaggtgagatgccacaagcaggcctgcctgcccctgagatgcggcaagggccagagcagagccagaagacacggccagtgctgcgaggagtgcgtgagccccgccggcagctgcagctacgacggcgtggtgagataccaggacgagatgtggaagggcagcgcctgcgagttctgcatgtgcgaccacggccaggtgacctgccagaccggcgagtgcgccaaggtggagtgcgccagagacgaggagctgatccacctggacggcaagtgctgccccgagtgcatcagcagaaacggctactgcgtgtacgaggagaccggcgagttcatgagcagcaacgccagcgaggtgaagagaatccccgagggcgagaagtgggaggacggcccctgcaaggtgtgcgagtgcagaggcgcccaggtgacctgctacgagcccagctgccccccctgccccgtgggcaccctggccctggaggtgaagggccagtgctgccccgactgcaccagcgtgcactgccaccccgactgcctgacctgcagccagagccccgaccactgcgacctgtgccaggaccccaccaagctgctgcagaacggctggtgcgtgcacagctgcggcctgggcttctaccaggccggcagcctgtgcctggcctgccagccccagtgcagcacctgcaccagcggcctggagtgcagcagctgccagccccccctgctgatgagacacggccagtgcgtgcccacctgcggcgacggcttctaccaggacagacacagctgcgccgtgtgccacgagagctgcgccggctgctggggccccaccgagaagcactgcctggcctgcagagaccccctgcacgtgctgagagacggcggctgcgagagcagctgcggcaagggcttctacaacagacagggcacctgcagcgcctgcgaccagagctgcgacagctgcggccccagcagccccagatgcctgacctgcaccgagaagaccgtgctgcacgacggcaagtgcatgagcgagtgccccggcggctactacgccgacgccaccggcagatgcaaggtgtgccacaacagctgcgccagctgcagcggccccacccccagccactgcaccgcctgcagcccccccaaggccctgagacagggccactgcctgcccagatgcggcgagggcttctacagcgaccacggcgtgtgcaaggcctgccacagcagctgcctggcctgcatgggccccgcccccagccactgcaccggctgcaagaagcccgaggagggcctgcaggtggagcagctgagcgacgtgggcatccccagcggcgagtgcctggcccagtgcagagcccacttctacctggagagcaccggcatctgcgaggcctgccaccagagctgcttcagatgcgccggcaagagcccccacaactgcaccgactgcggccccagccacgtgctgctggacggccagtgcctgagccagtgccccgacggctacttccaccaggagggcagctgcaccgagtgccaccccacctgcagacagtgccacggccccctggagagcgactgcatcagctgctacccccacatcagcctgaccaacggcaactgcagaaccagctgcagagaggagcagttcctgaacctggtgggctactgcgccgactgccaccacctgtgccagcactgcgccgccgacctgcacaacaccggcagcatctgcctgagatgccagaacgcccactacctgctgctgggcgaccactgcgtgcccgactgccccagcggctactacgccgagagaggcgcctgcaagaagtgccacagcagctgcagaacctgccagggcagaggccccttcagctgcagcagctgcgacaccaacctggtgctgagccacaccggcacctgcagcaccacctgcttccccggccactacctggacgacaaccacgtgtgccagccctgcaacacccactgcggcagctgcgacagccaggccagctgcaccagctgcagagaccccaacaaggtgctgctgttcggcgagtgccagtacgagagctgcgccccccagtactacctggacttcagcaccaacacctgcaaggagtgcgactggagctgcagcgcctgcagcggccccctgaagaccgactgcctgcagtgcatggacggctacgtgctgcaggacggcgcctgcgtggagcagtgcctgagcagcttctaccaggacagcggcctgtgcaagaactgcgacagctactgcctgcagtgccagggcccccacgagtgcaccagatgcaagggccccttcctgctgctggaggcccagtgcgtgcaggagtgcggcaagggctacttcgccgaccacgccaagcacaagtgcaccgcctgcccccagggctgcctgcagtgcagccacagagacagatgccacctgtgcgaccacggcttcttcctgaagagcggcctgtgcgtgtacaactgcgtgcccggcttcagcgtgcacaccagcaacgagacctgcagcggcaagatccacacccccagcctgcacgtgaacggcagcctgatcctgcccatcggcagcatcaagcccctggacttcagcctgctgaacgtgcaggaccaggagggcagagtggaggacctgctgttccacgtggtgagcacccccaccaacggccagctggtgctgagcagaaacggcaaggaggtgcagctggacaaggccggcagattcagctggaaggacgtgaacgagaagaaggtgagattcgtgcacagcaaggagaagctgagaaagggctacctgttcctgaagatcagcgaccagcagttcttcagcgagccccagctgatcaacatccaggccttcagcacccaggccccctacgtgctgagaaacgaggtgctgcacatcagcagaggcgagagagccaccatcaccacccagatgctggacatcagagacgacgacaacccccaggacgtggtgatcgagatcatcgacccccccctgcacggccagctgctgcagaccctgcagagccccgccacccccatctaccagttccagctggacgagctgagcagaggcctgctgcactacgcccacgacggcagcgacagcaccagcgacgtggccgtgctgcaggccaacgacggccacagcttccacaacatcctgttccaggtgaagaccgtgccccagaacgacagaggcctgcagctggtggccaacagcatggtgtgggtgcccgagggcggcatgctgcagatcaccaacagaatcctgcaggccgaggcccccggcgccagcgccgaggagatcatctacaagatcacccaggactacccccagttcggcgaggtggtgctgctggtgaacatgcccgccgacagccccgccgacgagggccagcacctgcccgacggcagaaccgccacccccaccagcaccttcacccagcaggacatcaacgagggcatcgtgtggtacagacacagcggcgcccccgcccagagcgacagcttcagattcgaggtgagcagcgccagcaacgcccagaccagactggagagccacatgttcaacatcgccatcctgccccagacccccgaggcccccaaggtgagcctggaggccagcctgcacatgaccgccagagaggacggcctgaccgtgatccagccccacagcctgagcttcatcaacagcgagaagcccagcggcaagatcgtgtacaacatcaccctgcccctgcaccccaaccagggcatcatcgagcacagagaccacccccacagccccatcagatacttcacccaggaggacatcaaccagggcaaggtgatgtacagacccccccccgccgccccccacctgcaggagctgatggccttcagcttcgccggcctgcccgagagcgtgaagttccacttcaccgtgagcgacggcgagcacaccagccccgagatggtgctgaccatccacctgctgcccagcgaccagcagctgcccgtgttccaggtgaccgcccccagactggccgtgagccccggcggcagcaccagcgtgggcctgcaggtggtggtgagagacgccgagaccgcccccaaggagctgttcttcgagctgagaagacccccccagcacggcgtgctgctgaagcacaccgccgagttcagaagacccatggccaccggcgacaccttcacctacgaggacgtggagaagaacgccctgcagtacatccacgacggcagcagcaccagagaggacagcatggagatcagcgtgaccgacggcctgaccgtgaccatgctggaggtgagagtggaggtgagcctgagcgaggacagaggccccagactggccgccggcagcagcctgagcatcaccgtggccagcaagagcaccgccatcatcaccagaagccacctggcctacgtggacgacagcagccccgaccccgagatctggatccagctgaactacctgcccagctacggcaccctgctgagaatcagcggcagcgaggtggaggagctgagcgaggtgagcaacttcaccatggaggacatcaacaacaagaagatcagatacagcgccgtgttcgagaccgacggccacctggtgaccgacagcttctacttcagcgtgagcgacatggaccacaaccacctggacaaccagatcttcaccatcatgatcacccccgccgagaaccccccccccgtgatcgccttcgccgacctgatcaccgtggacgagggcggcagagcccccctgagcttccaccacttcttcgccaccgacgacgacgacaacctgcagagagacgccatcatcaagctgagcgccctgcccaagtacggctgcatcgagaacaccggcaccggcgacagattcggccccgagaccgccagcgacctggaggccagcttccccatccaggacgtgctggagaactacatctactacttccagagcgtgcacgagagcatcgagcccacccacgacatcttcagcttctacgtgagcgacggcaccagcagaagcgagatccacagcatcaacatcaccatcgaggtgaagaccctggaggtgggcaaggtggagcccctgaccaccatcttccacaccatcagagagctgagcctgtag

SEQ ID NO: 82091 - DNA, 633 bp, Artificial Sequence
  Description of Artificial Sequence: Synthetic coding sequence
atgtggaccctgggcagaagagccgtggccggcctgctggccagccccagccccgcccaggcccagaccctgaccagagtgcccagacccgccgagctggcccccctgtgcggcagaagaggcctgagaaccgacatcgacgccacctgcacccccagaagagccagcagcaaccagagaggcctgaaccagatctggaacgtgaagaagcagagcgtgtacctgatgaacctgagaaagagcggcaccctgggccaccccggcagcctggacgagaccacctacgagagactggccgaggagaccctggacagcctggccgagttcttcgaggacctggccgacaagccctacaccttcgaggactacgacgtgagcttcggcagcggcgtgctgaccgtgaagctgggcggcgacctgggcacctacgtgatcaacaagcagacccccaacaagcagatctggctgagcagccccagcagcggccccaagagatacgactggaccggcaagaactgggtgtacagccacgacggcgtgagcctgcacgagctgctggccgccgagctgaccaaggccctgaagaccaagctggacctgagcagcctggcctacagcggcaaggacgcctag

SEQ ID NO: 82092 - DNA, 516 bp, Artificial Sequence
  Description of Artificial Sequence: Synthetic coding sequence
atgtggaccctgggcagaagagccgtggccggcctgctggccagccccagccccgcccaggcccagaccctgaccagagtgcccagacccgccgagctggcccccctgtgcggcagaagaggcctgagaaccgacatcgacgccacctgcacccccagaagagccagcagcaaccagagaggcctgaaccagatctggaacgtgaagaagcagagcgtgtacctgatgaacctgagaaagagcggcaccctgggccaccccggcagcctggacgagaccacctacgagagactggccgaggagaccctggacagcctggccgagttcttcgaggacctggccgacaagccctacaccttcgaggactacgacgtgagcttcggcagcggcgtgctgaccgtgaagctgggcggcgacctgggcacctacgtgatcaacaagcagacccccaacaagcagatctggctgagcagccccagcagactgacctggctgctgtggctgttccacccctag

SEQ ID NO: 82093 - DNA, 591 bp, Artificial Sequence
  Description of Artificial Sequence: Synthetic coding sequence
atgtggaccctgggcagaagagccgtggccggcctgctggccagccccagccccgcccaggcccagaccctgaccagagtgcccagacccgccgagctggcccccctgtgcggcagaagaggcctgagaaccgacatcgacgccacctgcacccccagaagagccagcagcaaccagagaggcctgaaccagatctggaacgtgaagaagcagagcgtgtacctgatgaacctgagaaagagcggcaccctgggccaccccggcagcctggacgagaccacctacgagagactggccgaggagaccctggacagcctggccgagttcttcgaggacctggccgacaagccctacaccttcgaggactacgacgtgagcttcggcagcggcgtgctgaccgtgaagctgggcggcgacctgggcacctacgtgatcaacaagcagacccccaacaagcagatctggctgagcagccccagcagatacgtggtggacctgagcgtgatgaccggcctgggcaagaccggctgcacccccaccaccgcctgccccagcatgagctgctggccccagagcagcctgaagccctag

SEQ ID NO: 82094 - DNA, 702 bp, Artificial Sequence
  Description of Artificial Sequence: Synthetic coding sequence
atgccctgcagaagagaggaggaggaggaggccggcgaggaggccgagggcgaggaggaggaggacgacagcttcctgctgctgcagcagagcgtgaccctgggcagcagcggcgaggtggacagactggtggcccagatcggcgagaccctgcagctggacgccgcccaggacagccccgccagcccctgcgccccccccggcgtgcccctgagagcccccggccccctggccgccgccgtgcccgccgacaaggccagaccccccgccgtgcccctgctgctgccccccgccagcgccgagaccgtgggccccgcccccagcggcgccctgagatgcgccctgggcgacagaggcagagtgagaggcagagccgccccctactgcgtggccgaggtggccgccggccccagcgccctgcccggcccctgcagaagaggctggctgagagacgccgtgaccagcagaagactgcagcagagaagatggacccaggccggcgccagagccggcgacgacgacccccacagactgctgcagcagctggtgctgagcggcaacctgatcaaggaggccgtgagaagactgcagagagccgtggccgccgtggccgccaccggccccgccagcgcccccggccccggcggcggcagaagcggccccgacagaatcgccctgcagcccagcggcagcctgctgtag

SEQ ID NO: 82095 - DNA, 1161 bp, Artificial Sequence
  Description of Artificial Sequence: Synthetic coding sequence
atggagggcggcctggccggcgagagagccagagagagccccgtggactgcagcgtgagcaagtgcagcaagctggtgggcggcggcgagagcaaccccatgaactacaacagctacatggacgagaagaacggcccccccccccccaacatgaccaccaacgagagaagagtgatcgtgcccgccgaccccaccctgtggacccaggagcacgtgagacagtggctggagtgggccatcaaggagtacagcctgatggagatcgacaccagcttcttccagaacatggacggcaaggagctgtgcaagatgaacaaggaggacttcctgagagccaccaccctgtacaacaccgaggtgctgctgagccacctgagctacctgagagagagcagcctgctggcctacaacaccaccagccacaccgaccagagcagcagactgagcgtgaaggaggaccccagctacgacagcgtgagaagaggcgcctggggcaacaacatgaacagcggcctgaacaagagcccccccctgggcggcgcccagaccatcagcaagaacaccgagcagagaccccagcccgacccctaccagatcctgggccccaccagcagcagactggccaaccccggcagcggccagatccagctgtggcagttcctgctggagctgctgagcgacagcgccaacgccagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccaccccaccgagagcagcatgtacaagtaccccagcgacatcagctacatgcccagctaccacgcccaccagcagaaggtgaacttcgtgcccccccaccccagcagcatgcccgtgaccagcagcagcttcttcggcgccgccagccagtactggaccagccccaccggcggcatctaccccaaccccaacgtgcccagacaccccaacacccacgtgcccagccacctgggcagctactactag

SEQ ID NO: 82096 - DNA, 1260 bp, Artificial Sequence
  Description of Artificial Sequence: Synthetic coding sequence
atgaccgccagcggcagccccgactacggccagccccacaagatcaaccccctgcccccccagcaggagtggatcaaccagcccgtgagagtgaacgtgaagagagagtacgaccacatgaacggcagcagagagagccccgtggactgcagcgtgagcaagtgcagcaagctggtgggcggcggcgagagcaaccccatgaactacaacagctacatggacgagaagaacggcccccccccccccaacatgaccaccaacgagagaagagtgatcgtgcccgccgaccccaccctgtggacccaggagcacgtgagacagtggctggagtgggccatcaaggagtacagcctgatggagatcgacaccagcttcttccagaacatggacggcaaggagctgtgcaagatgaacaaggaggacttcctgagagccaccaccctgtacaacaccgaggtgctgctgagccacctgagctacctgagagagagcagcctgctggcctacaacaccaccagccacaccgaccagagcagcagactgagcgtgaaggaggaccccagctacgacagcgtgagaagaggcgcctggggcaacaacatgaacagcggcctgaacaagagcccccccctgggcggcgcccagaccatcagcaagaacaccgagcagagaccccagcccgacccctaccagatcctgggccccaccagcagcagactggccaaccccggcagcggccagatccagctgtggcagttcctgctggagctgctgagcgacagcgccaacgccagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccaccccaccgagagcagcatgtacaagtaccccagcgacatcagctacatgcccagctaccacgcccaccagcagaaggtgaacttcgtgcccccccaccccagcagcatgcccgtgaccagcagcagcttcttcggcgccgccagccagtactggaccagccccaccggcggcatctaccccaaccccaacgtgcccagacaccccaacacccacgtgcccagccacctgggcagctactactag

SEQ ID NO: 82097 - DNA, 1359 bp, Artificial Sequence
  Description of Artificial Sequence: Synthetic coding sequence
atggacggcaccatcaaggaggccctgagcgtggtgagcgacgaccagagcctgttcgacagcgcctacggcgccgccgcccacctgcccaaggccgacatgaccgccagcggcagccccgactacggccagccccacaagatcaaccccctgcccccccagcaggagtggatcaaccagcccgtgagagtgaacgtgaagagagagtacgaccacatgaacggcagcagagagagccccgtggactgcagcgtgagcaagtgcagcaagctggtgggcggcggcgagagcaaccccatgaactacaacagctacatggacgagaagaacggcccccccccccccaacatgaccaccaacgagagaagagtgatcgtgcccgccgaccccaccctgtggacccaggagcacgtgagacagtggctggagtgggccatcaaggagtacagcctgatggagatcgacaccagcttcttccagaacatggacggcaaggagctgtgcaagatgaacaaggaggacttcctgagagccaccaccctgtacaacaccgaggtgctgctgagccacctgagctacctgagagagagcagcctgctggcctacaacaccaccagccacaccgaccagagcagcagactgagcgtgaaggaggaccccagctacgacagcgtgagaagaggcgcctggggcaacaacatgaacagcggcctgaacaagagcccccccctgggcggcgcccagaccatcagcaagaacaccgagcagagaccccagcccgacccctaccagatcctgggccccaccagcagcagactggccaaccccggcagcggccagatccagctgtggcagttcctgctggagctgctgagcgacagcgccaacgccagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccaccccaccgagagcagcatgtacaagtaccccagcgacatcagctacatgcccagctaccacgcccaccagcagaaggtgaacttcgtgcccccccaccccagcagcatgcccgtgaccagcagcagcttcttcggcgccgccagccagtactggaccagccccaccggcggcatctaccccaaccccaacgtgcccagacaccccaacacccacgtgcccagccacctgggcagctactactag

SEQ ID NO: 82098 - DNA, 780 bp, Artificial Sequence
  Description of Artificial Sequence: Synthetic coding sequence
atggaccccggcagcctgctggcctacaacaccaccagccacaccgaccagagcagcagactgagcgtgaaggaggaccccagctacgacagcgtgagaagaggcgcctggggcaacaacatgaacagcggcctgaacaagagcccccccctgggcggcgcccagaccatcagcaagaacaccgagcagagaccccagcccgacccctaccagatcctgggccccaccagcagcagactggccaaccccggcagcggccagatccagctgtggcagttcctgctggagctgctgagcgacagcgccaacgccagctgcatcacctgggagggcaccaacggcgagttcaagatgaccgaccccgacgaggtggccagaagatggggcgagagaaagagcaagcccaacatgaactacgacaagctgagcagagccctgagatactactacgacaagaacatcatgaccaaggtgcacggcaagagatacgcctacaagttcgacttccacggcatcgcccaggccctgcagccccaccccaccgagagcagcatgtacaagtaccccagcgacatcagctacatgcccagctaccacgcccaccagcagaaggtgaacttcgtgcccccccaccccagcagcatgcccgtgaccagcagcagcttcttcggcgccgccagccagtactggaccagccccaccggcggcatctaccccaaccccaacgtgcccagacaccccaacacccacgtgcccagccacctgggcagctactactag

SEQ ID NO: 82099 - DNA, 1944 bp, Artificial Sequence
  Description of Artificial Sequence: Synthetic coding sequence
atggccgaggaggaggcccccaagaagagcagagccgccggcggcggcgccagctgggagctgtgcgccggcgccctgagcgccagactggccgaggagggcagcggcgacgccggcggcagaagaagaccccccgtggaccccagaagactggccagacagctgctgctgctgctgtggctgctggaggcccccctgctgctgggcgtgagagcccaggccgccggccagggccccggccagggccccggccccggccagcagccccccccccccccccagcagcagcagagcggccagcagtacaacggcgagagaggcatcagcgtgcccgaccacggctactgccagcccatcagcatccccctgtgcaccgacatcgcctacaaccagaccatcatgcccaacctgctgggccacaccaaccaggaggacgccggcctggaggtgcaccagttctaccccctggtgaaggtgcagtgcagcgccgagctgaagttcttcctgtgcagcatgtacgcccccgtgtgcaccgtgctggagcaggccctgcccccctgcagaagcctgtgcgagagagccagacagggctgcgaggccctgatgaacaagttcggcttccagtggcccgacaccctgaagtgcgagaagttccccgtgcacggcgccggcgagctgtgcgtgggccagaacaccagcgacaagggcacccccacccccagcctgctgcccgagttctggaccagcaacccccagcacggcggcggcggccacagaggcggcttccccggcggcgccggcgccagcgagagaggcaagttcagctgccccagagccctgaaggtgcccagctacctgaactaccacttcctgggcgagaaggactgcggcgccccctgcgagcccaccaaggtgtacggcctgatgtacttcggccccgaggagctgagattcagcagaacctggatcggcatctggagcgtgctgtgctgcgccagcaccctgttcaccgtgctgacctacctggtggacatgagaagattcagctaccccgagagacccatcatcttcctgagcggctgctacaccgccgtggccgtggcctacatcgccggcttcctgctggaggacagagtggtgtgcaacgacaagttcgccgaggacggcgccagaaccgtggcccagggcaccaagaaggagggctgcaccatcctgttcatgatgctgtacttcttcagcatggccagcagcatctggtgggtgatcctgagcctgacctggttcctggccgccggcatgaagtggggccacgaggccatcgaggccaacagccagtacttccacctggccgcctgggccgtgcccgccatcaagaccatcaccatcctggccctgggccaggtggacggcgacgtgctgagcggcgtgtgcttcgtgggcctgaacaacgtggacgccctgagaggcttcgtgctggcccccctgttcgtgtacctgttcatcggcaccagcttcctgctggccggcttcgtgagcctgttcagaatcagaaccatcatgaagcacgacggcaccaagaccgagaagctggagaagctgatggtgagaatcggcgtgttcagcgtgctgtacaccgtgcccgccaccatcgtgatcgcctgctacttctacgagcaggccttcagagaccagtgggagagaagctgggtggcccagagctgcaagagctacgccatcccctgcccccacctgcaggccggcggcggcgcccccccccacccccccatgagccccgacttcaccgtgttcatgatcaagtacctgatgaccctgatcgtgggcatcaccagcggcttctggatctggagcggcaagaccctgaacagctggagaaagttctacaccagactgaccaacagcaagcagggcgagaccaccgtgtag

SEQ ID NO: 82100 - DNA, 1284 bp, Artificial Sequence
  Description of Artificial Sequence: Synthetic coding sequence
atggaggccatggccgccagcaccagcctgcccgaccccggcgacttcgacagaaacgtgcccagaatctgcggcgtgtgcggcgacagagccaccggcttccacttcaacgccatgacctgcgagggctgcaagggcttcttcagaagaagcatgaagagaaaggccctgttcacctgccccttcaacggcgactgcagaatcaccaaggacaacagaagacactgccaggcctgcagactgaagagatgcgtggacatcggcatgatgaaggagttcatcctgaccgacgaggaggtgcagagaaagagagagatgatcctgaagagaaaggaggaggaggccctgaaggacagcctgagacccaagctgagcgaggagcagcagagaatcatcgccatcctgctggacgcccaccacaagacctacgaccccacctacagcgacttctgccagttcagaccccccgtgagagtgaacgacggcggcggcagccaccccagcagacccaacagcagacacacccccagcttcagcggcgacagcagcagcagctgcagcgaccactgcatcaccagcagcgacatgatggacagcagcagcttcagcaacctggacctgagcgaggaggacagcgacgaccccagcgtgaccctggagctgagccagctgagcatgctgccccacctggccgacctggtgagctacagcatccagaaggtgatcggcttcgccaagatgatccccggcttcagagacctgaccagcgaggaccagatcgtgctgctgaagagcagcgccatcgaggtgatcatgctgagaagcaacgagagcttcaccatggacgacatgagctggacctgcggcaaccaggactacaagtacagagtgagcgacgtgaccaaggccggccacagcctggagctgatcgagcccctgatcaagttccaggtgggcctgaagaagctgaacctgcacgaggaggagcacgtgctgctgatggccatctgcatcgtgagccccgacagacccggcgtgcaggacgccgccctgatcgaggccatccaggacagactgagcaacaccctgcagacctacatcagatgcagacaccccccccccggcagccacctgctgtacgccaagatgatccagaagctggccgacctgagaagcctgaacgaggagcacagcaagcagtacagatgcctgagcttccagcccgagtgcagcatgaagctgacccccctggtgctggaggtgttcggcaacgagatcagctag

SEQ ID NO: 82101 - DNA, 1365 bp, Artificial Sequence
  Description of Artificial Sequence: Synthetic coding sequence
atgcccgcccacagagaccccgacgtgcagggccacagactgcagcacgacagctacgcccagcccgacggccccagagagcccgccagaggcagccaccccgtggccagagtgagagccgccggcggcgtgagactgcccagacccccccccctgctgcccgtgctggccgtgagagccgacgtgcacagagccggcctgtacccccaccccagactgcccggccacgtgagagccggccccgcccaggtgctgcccgactacggcgccgtgcagctgcaggtggccagactgcccggcctgcccgagaccccccagcaggagagaccccagctgcccgtgcacggcggcgcccagcagagactgggcagagcccaccccggcctgggccccgtgcccgccgccgtgcccgccgccgccgccccccagagagccggcgcccccgccgagggcagaggccccagagccagaagactgagacagcccggccaggtgccccccagaggcgaggagagagtggtgagagccgccctgcacgccagaagaggcagagtgctggagcccagaggccaggccctgagaagcggcctggccggccacctgggcggcgccgtgctgctgctgcagagactgcacagagcccacctgccccacagacccggccccctgcccctgcccagagccccccaccacctgcccctgcacgtgctgctgagactgctgagaggcctgccccacccccccctgagaagaagaagagagcacagactgagacccggccagagacccgccctgtgccaccccggcggcaccggcgagcacagactgcacgccggcctgcccggccccctgctgctgagacacggccagctggccgtggtgggcggcccccacgcccacctggtgcccggcagaagacaggaggtgggccccagaggccacagaagccagcagcagctgctgccccccggcagcctgggccaccccggcggcgaggaccaccccgaccccggccacgcccagggcggcggcggcagagcccacagaggcctgctgagaggccagcacggcagacagagagcccacagactgagagcccacagccccggcctgctgcccggccacagacacgtgctgcaccccctgggcctgagaggccccgtgccccaccccgagggcgacgaggacggcagaagagagcacggccaggccggcgaggcccacggcgcctacagagccctgctgtgcgccgtgcacagagccggccacctgtgcgacagactgctgctgctgagaaccccccagcacggcctgctggaggaccccggcggcgccgcccaggtgcagaacgagcagcccgactag

SEQ ID NO: 82102 - DNA, 1698 bp, Artificial Sequence
  Description of Artificial Sequence: Synthetic coding sequence
atgagacccagaagcgccctgcccagactgctgctgcccctgctgctgctgcccgccgccggccccgcccagttccacggcgagaagggcatcagcatccccgaccacggcttctgccagcccatcagcatccccctgtgcaccgacatcgcctacaaccagaccatcatgcccaacctgctgggccacaccaaccaggaggacgccggcctggaggtgcaccagttctaccccctggtgaaggtgcagtgcagccccgagctgagattcttcctgtgcagcatgtacgcccccgtgtgcaccgtgctggagcaggccatccccccctgcagaagcatctgcgagagagccagacagggctgcgaggccctgatgaacaagttcggcttccagtggcccgagagactgagatgcgagcacttccccagacacggcgccgagcagatctgcgtgggccagaaccacagcgaggacggcgcccccgccctgctgaccaccgcccccccccccggcctgcagcccggcgccggcggcacccccggcggccccggcggcggcggcgccccccccagatacgccaccctggagcaccccttccactgccccagagtgctgaaggtgcccagctacctgagctacaagttcctgggcgagagagactgcgccgccccctgcgagcccgccagacccgacggcagcatgttcttcagccaggaggagaccagattcgccagactgtggatcctgacctggagcgtgctgtgctgcgccagcaccttcttcaccgtgaccacctacctggtggacatgcagagattcagataccccgagagacccatcatcttcctgagcggctgctacaccatggtgagcgtggcctacatcgccggcttcgtgctgcaggagagagtggtgtgcaacgagagattcagcgaggacggctacagaaccgtggtgcagggcaccaagaaggagggctgcaccatcctgttcatgatgctgtacttcttcagcatggccagcagcatctggtgggtgatcctgagcctgacctggttcctggccgccggcatgaagtggggccacgaggccatcgaggccaacagccagtacttccacctggccgcctgggccgtgcccgccgtgaagaccatcaccatcctggccatgggccagatcgacggcgacctgctgagcggcgtgtgcttcgtgggcctgaacagcctggaccccctgagaggcttcgtgctggcccccctgttcgtgtacctgttcatcggcaccagcttcctgctggccggcttcgtgagcctgttcagaatcagaaccatcatgaagcacgacggcaccaagaccgagaagctggagagactgatggtgagaatcggcgtgttcagcgtgctgtacaccgtgcccgccaccatcgtgatcgcctgctacttctacgagcaggccttcagagagcactgggagagaagctgggtgagccagcactgcaagagcctggccatcccctgccccgcccactacacccccagaatgagccccgacttcaccgtgtacatgatcaagtacctgatgaccctgatcgtgggcatcaccagcggcttctggatctggagcggcaagaccctgcacagctggagaaagttctacaccagactgaccaacagcagacacggcgagaccaccgtgtag

SEQ ID NO: 82103 - DNA, 1926 bp, Artificial Sequence
  Description of Artificial Sequence: Synthetic coding sequence
gccagaggcgtgagcggctgcagcgtgagacccagacaggccagcggccaggcccacagacccctgcccagacccgccagccccaccctgagacccagagtgaagttcgccaagagaagaggcagaagacagccccagagaggcggcggcggcgaggaggcccagagccccggctggggcagaggcagaggcggcagacagggcgccggctggggcgccgccgccagcatgagacccagaagcgccctgcccagactgctgctgcccctgctgctgctgcccgccgccggccccgcccagttccacggcgagaagggcatcagcatccccgaccacggcttctgccagcccatcagcatccccctgtgcaccgacatcgcctacaaccagaccatcatgcccaacctgctgggccacaccaaccaggaggacgccggcctggaggtgcaccagttctaccccctggtgaaggtgcagtgcagccccgagctgagattcttcctgtgcagcatgtacgcccccgtgtgcaccgtgctggagcaggccatccccccctgcagaagcatctgcgagagagccagacagggctgcgaggccctgatgaacaagttcggcttccagtggcccgagagactgagatgcgagcacttccccagacacggcgccgagcagatctgcgtgggccagaaccacagcgaggacggcgcccccgccctgctgaccaccgcccccccccccggcctgcagcccggcgccggcggcacccccggcggccccggcggcggcggcgccccccccagatacgccaccctggagcaccccttccactgccccagagtgctgaaggtgcccagctacctgagctacaagttcctgggcgagagagactgcgccgccccctgcgagcccgccagacccgacggcagcatgttcttcagccaggaggagaccagattcgccagactgtggatcctgacctggagcgtgctgtgctgcgccagcaccttcttcaccgtgaccacctacctggtggacatgcagagattcagataccccgagagacccatcatcttcctgagcggctgctacaccatggtgagcgtggcctacatcgccggcttcgtgctgcaggagagagtggtgtgcaacgagagattcagcgaggacggctacagaaccgtggtgcagggcaccaagaaggagggctgcaccatcctgttcatgatgctgtacttcttcagcatggccagcagcatctggtgggtgatcctgagcctgacctggttcctggccgccggcatgaagtggggccacgaggccatcgaggccaacagccagtacttccacctggccgcctgggccgtgcccgccgtgaagaccatcaccatcctggccatgggccagatcgacggcgacctgctgagcggcgtgtgcttcgtgggcctgaacagcctggaccccctgagaggcttcgtgctggcccccctgttcgtgtacctgttcatcggcaccagcttcctgctggccggcttcgtgagcctgttcagaatcagaaccatcatgaagcacgacggcaccaagaccgagaagctggagagactgatggtgagaatcggcgtgttcagcgtgctgtacaccgtgcccgccaccatcgtgatcgcctgctacttctacgagcaggccttcagagagcactgggagagaagctgggtgagccagcactgcaagagcctggccatcccctgccccgcccactacacccccagaatgagccccgacttcaccgtgtacatgatcaagtacctgatgaccctgatcgtgggcatcaccagcggcttctggatctggagcggcaagaccctgcacagctggagaaagttctacaccagactgaccaacagcagacacggcgagaccaccgtgtag

SEQ ID NO: 82104 - DNA, 2001 bp, Artificial Sequence
  Description of Artificial Sequence: Synthetic coding sequence
atggccatgacctggatcgtgttcagcctgtggcccctgaccgtgttcatgggccacatcggcggccacagcctgttcagctgcgagcccatcaccctgagaatgtgccaggacctgccctacaacaccaccttcatgcccaacctgctgaaccactacgaccagcagaccgccgccctggccatggagcccttccaccccatggtgaacctggactgcagcagagacttcagacccttcctgtgcgccctgtacgcccccatctgcatggagtacggcagagtgaccctgccctgcagaagactgtgccagagagcctacagcgagtgcagcaagctgatggagatgttcggcgtgccctggcccgaggacatggagtgcagcagattccccgactgcgacgagccctaccccagactggtggacctgaacctggccggcgagcccaccgagggcgcccccgtggccgtgcagagagactacggcttctggtgccccagagagctgaagatcgaccccgacctgggctacagcttcctgcacgtgagagactgcagccccccctgccccaacatgtacttcagaagagaggagctgagcttcgccagatacttcatcggcctgatcagcatcatctgcctgagcgccaccctgttcaccttcctgaccttcctgatcgacgtgaccagattcagataccccgagagacccatcatcttctacgccgtgtgctacatgatggtgagcctgatcttcttcatcggcttcctgctggaggacagagtggcctgcaacgccagcatccccgcccagtacaaggccagcaccgtgacccagggcagccacaacaaggcctgcaccatgctgttcatgatcctgtacttcttcaccatggccggcagcgtgtggtgggtgatcctgaccatcacctggttcctggccgccgtgcccaagtggggcagcgaggccatcgagaagaaggccctgctgttccacgccagcgcctggggcatccccggcaccctgaccatcatcctgctggccatgaacaagatcgagggcgacaacatcagcggcgtgtgcttcgtgggcctgtacgacgtggacgccctgagatacttcgtgctggcccccctgtgcctgtacgtggtggtgggcgtgagcctgctgctggccggcatcatcagcctgaacagagtgagaatcgagatccccctggagaaggagaaccaggacaagctggtgaagttcatgatcagaatcggcgtgttcagcatcctgtacctggtgcccctgctggtggtgatcggctgctacttctacgagcaggcctacagaggcatctgggagaccacctggatccaggagagatgcagagagtaccacatcccctgcccctaccaggtgacccagatgagcagacccgacctgatcctgttcctgatgaagtacctgatggccctgatcgtgggcatccccagcgtgttctgggtgggcagcaagaagacctgcttcgagtgggccagcttcttccacggcagaagaaagaaggagatcgtgaacgagagcagacaggtgctgcaggagcccgacttcgcccagagcctgctgagagaccccaacacccccatcatcagaaagagcagaggcaccagcacccagggcaccagcacccacgccagcagcacccagctggccatggtggacgaccagagaagcaaggccggcagcatccacagcaaggtgagcagctaccacggcagcctgcacagaagcagagacggcagatacaccccctgcagctacagaggcatggaggagagactgccccacggcagcatgagcagactgaccgaccacagcagacacagcagcagccacagactgaacgagcagagcagacacagcagcatcagagacctgagcaacaaccccatgacccacatcacccacggcaccagcatgaacagagtgatcgaggaggacggcaccagcgcctag

SEQ ID NO: 82105 - DNA, 108 bp, Artificial Sequence
  Description of Artificial Sequence: Synthetic coding sequence
atggccatgacctggatcgtgttcagcctgtggcccctgaccgtgttcatgggccacatcggcggccacagcctgttcagctgcgagcccatcaccctgagaatgtag

SEQ ID NO: 82106 - DNA, 2001 bp, Artificial Sequence; identical to SEQ ID NO: 82104
  Description of Artificial Sequence: Synthetic coding sequence

SEQ ID NO: 82107 - DNA, 1614 bp, Artificial Sequence
  Description of Artificial Sequence: Synthetic coding sequence
atggcctggagaggcgccggccccagcgtgcccggcgcccccggcggcgtgggcctgagcctgggcctgctgctgcagctgctgctgctgctgggccccgccagaggcttcggcgacgaggaggagagaagatgcgaccccatcagaatcagcatgtgccagaacctgggctacaacgtgaccaagatgcccaacctggtgggccacgagctgcagaccgacgccgagctgcagctgaccaccttcacccccctgatccagtacggctgcagcagccagctgcagttcttcctgtgcagcgtgtacgtgcccatgtgcaccgagaagatcaacatccccatcggcccctgcggcggcatgtgcctgagcgtgaagagaagatgcgagcccgtgctgaaggagttcggcttcgcctggcccgagagcctgaactgcagcaagttccccccccagaacgaccacaaccacatgtgcatggagggccccggcgacgaggaggtgcccctgccccacaagacccccatccagcccggcgaggagtgccacagcgtgggcaccaacagcgaccagtacatctgggtgaagagaagcctgaactgcgtgctgaagtgcggctacgacgccggcctgtacagcagaagcgccaaggagttcaccgacatctggatggccgtgtgggccagcctgtgcttcatcagcaccgccttcaccgtgctgaccttcctgatcgacagcagcagattcagctaccccgagagacccatcatcttcctgagcatgtgctacaacatctacagcatcgcctacatcgtgagactgaccgtgggcagagagagaatcagctgcgacttcgaggaggccgccgagcccgtgctgatccaggagggcctgaagaacaccggctgcgccatcatcttcctgctgatgtacttcttcggcatggccagcagcatctggtgggtgatcctgaccctgacctggttcctggccgccggcctgaagtggggccacgaggccatcgagatgcacagcagctacttccacatcgccgcctgggccatccccgccgtgaagaccatcgtgatcctgatcatgagactggtggacgccgacgagctgaccggcctgtgctacgtgggcaaccagaacctggacgccctgaccggcttcgtggtggcccccctgttcacctacctggtgatcggcaccctgttcatcgccgccggcctggtggccctgttcaagatcagaagcaacctgcagaaggacggcaccaagaccgacaagctggagagactgatggtgaagatcggcgtgttcagcgtgctgtacaccgtgcccgccacctgcgtgatcgcctgctacttctacgagatcagcaactgggccctgttcagatacagcgccgacgacagcaacatggccgtggagatgctgaagatcttcatgagcctgctggtgggcatcaccagcggcatgtggatctggagcgccaagaccctgcacacctggcagaagtgcagcaacagactggtgaacagcggcaaggtgaagagagagaagagaggcaacggctgggtgaagcccggcaagggcagcgagaccgtggtgtag

SEQ ID NO: 82108 - DNA, 2121 bp, Artificial Sequence
  Description of Artificial Sequence: Synthetic coding sequence
atggagatgttcaccttcctgctgacctgcatcttcctgcccctgctgagaggccacagcctgttcacctgcgagcccatcaccgtgcccagatgcatgaagatggcctacaacatgaccttcttccccaacctgatgggccactacgaccagagcatcgccgccgtggagatggagcacttcctgcccctggccaacctggagtgcagccccaacatcgagaccttcctgtgcaaggccttcgtgcccacctgcatcgagcagatccacgtggtgcccccctgcagaaagctgtgcgagaaggtgtacagcgactgcaagaagctgatcgacaccttcggcatcagatggcccgaggagctggagtgcgacagactgcagtactgcgacgagaccgtgcccgtgaccttcgacccccacaccgagttcctgggcccccagaagaagaccgagcaggtgcagagagacatcggcttctggtgccccagacacctgaagaccagcggcggccagggctacaagttcctgggcatcgaccagtgcgcccccccctgccccaacatgtacttcaagagcgacgagctggagttcgccaagagcttcatcggcaccgtgagcatcttctgcctgtgcgccaccctgttcaccttcctgaccttcctgatcgacgtgagaagattcagataccccgagagacccatcatctactacagcgtgtgctacagcatcgtgagcctgatgtacttcatcggcttcctgctgggcgacagcaccgcctgcaacaaggccgacgagaagctggagctgggcgacaccgtggtgctgggcagccagaacaaggcctgcaccgtgctgttcatgctgctgtacttcttcaccatggccggcaccgtgtggtgggtgatcctgaccatcacctggttcctggccgccggcagaaagtggagctgcgaggccatcgagcagaaggccgtgtggttccacgccgtggcctggggcacccccggcttcctgaccgtgatgctgctggccatgaacaaggtggagggcgacaacatcagcggcgtgtgcttcgtgggcctgtacgacctggacgccagcagatacttcgtgctgctgcccctgtgcctgtgcgtgttcgtgggcctgagcctgctgctggccggcatcatcagcctgaaccacgtgagacaggtgatccagcacgacggcagaaaccaggagaagctgaagaagttcatgatcagaatcggcgtgttcagcggcctgtacctggtgcccctggtgaccctgctgggctgctacgtgtacgagcaggtgaacagaatcacctgggagatcacctgggtgagcgaccactgcagacagtaccacatcccctgcccctaccaggccaaggccaaggccagacccgagctggccctgttcatgatcaagtacctgatgaccctgatcgtgggcatcagcgccgtgttctgggtgggcagcaagaagacctgcaccgagtgggccggcttcttcaagagaaacagaaagagagaccccatcagcgagagcagaagagtgctgcaggagagctgcgagttcttcctgaagcacaacagcaaggtgaagcacaagaagaagcactacaagcccagcagccacaagctgaaggtgatcagcaagagcatgggcaccagcaccggcgccaccgccaaccacggcaccagcgccgtggccatcaccagccacgactacctgggccaggagaccctgaccgagatccagaccagccccgagaccagcatgagagaggtgaaggccgacggcgccagcacccccagactgagagagcaggactgcggcgagcccgccagccccgccgccagcatcagcagactgagcggcgagcaggtggacggcaagggccaggccggcagcgtgagcgagagcgccagaagcgagggcagaatcagccccaagagcgacatcaccgacaccggcctggcccagagcaacaacctgcaggtgcccagcagcagcgagcccagcagcctgaagggcagcaccagcctgctggtgcaccccgtgagcggcgtgagaaaggagcagggcggcggctgccacagcgacacctag

SEQ ID NO: 82109 - DNA, 2121 bp, Artificial Sequence; identical to SEQ ID NO: 82108
  Description of Artificial Sequence: Synthetic coding sequence

SEQ ID NO: 82110 - DNA, 2025 bp, Artificial Sequence
  Description of Artificial Sequence: Synthetic coding sequence
atgaagatggcctacaacatgaccttcttccccaacctgatgggccactacgaccagagcatcgccgccgtggagatggagcacttcctgcccctggccaacctggagtgcagccccaacatcgagaccttcctgtgcaaggccttcgtgcccacctgcatcgagcagatccacgtggtgcccccctgcagaaagctgtgcgagaaggtgtacagcgactgcaagaagctgatcgacaccttcggcatcagatggcccgaggagctggagtgcgacagactgcagtactgcgacgagaccgtgcccgtgaccttcgacccccacaccgagttcctgggcccccagaagaagaccgagcaggtgcagagagacatcggcttctggtgccccagacacctgaagaccagcggcggccagggctacaagttcctgggcatcgaccagtgcgcccccccctgccccaacatgtacttcaagagcgacgagctggagttcgccaagagcttcatcggcaccgtgagcatcttctgcctgtgcgccaccctgttcaccttcctgaccttcctgatcgacgtgagaagattcagataccccgagagacccatcatctactacagcgtgtgctacagcatcgtgagcctgatgtacttcatcggcttcctgctgggcgacagcaccgcctgcaacaaggccgacgagaagctggagctgggcgacaccgtggtgctgggcagccagaacaaggcctgcaccgtgctgttcatgctgctgtacttcttcaccatggccggcaccgtgtggtgggtgatcctgaccatcacctggttcctggccgccggcagaaagtggagctgcgaggccatcgagcagaaggccgtgtggttccacgccgtggcctggggcacccccggcttcctgaccgtgatgctgctggccatgaacaaggtggagggcgacaacatcagcggcgtgtgcttcgtgggcctgtacgacctggacgccagcagatacttcgtgctgctgcccctgtgcctgtgcgtgttcgtgggcctgagcctgctgctggccggcatcatcagcctgaaccacgtgagacaggtgatccagcacgacggcagaaaccaggagaagctgaagaagttcatgatcagaatcggcgtgttcagcggcctgtacctggtgcccctggtgaccctgctgggctgctacgtgtacgagcaggtgaacagaatcacctgggagatcacctgggtgagcgaccactgcagacagtaccacatcccctgcccctaccaggccaaggccaaggccagacccgagctggccctgttcatgatcaagtacctgatgaccctgatcgtgggcatcagcgccgtgttctgggtgggcagcaagaagacctgcaccgagtgggccggcttcttcaagagaaacagaaagagagaccccatcagcgagagcagaagagtgctgcaggagagctgcgagttcttcctgaagcacaacagcaaggtgaagcacaagaagaagcactacaagcccagcagccacaagctgaaggtgatcagcaagagcatgggcaccagcaccggcgccaccgccaaccacggcaccagcgccgtggccatcaccagccacgactacctgggccaggagaccctgaccgagatccagaccagccccgagaccagcatgagagaggtgaaggccgacggcgccagcacccccagactgagagagcaggactgcggcgagcccgccagccccgccgccagcatcagcagactgagcggcgagcaggtggacggcaagggccaggccggcagcgtgagcgagagcgccagaagcgagggcagaatcagccccaagagcgacatcaccgacaccggcctggcccagagcaacaacctgcaggtgcccagcagcagcgagcccagcagcctgaagggcagcaccagcctgctggtgcaccccgtgagcggcgtgagaaaggagcagggcggcggctgccacagcgacacctag

SEQ ID NO: 82111 - DNA, 1956 bp, Artificial Sequence
  Description of Artificial Sequence: Synthetic coding sequence
atgctggcccagcacttcctgcccctggccaacctggagtgcagccccaacatcgagaccttcctgtgcaaggccttcgtgcccacctgcatcgagcagatccacgtggtgcccccctgcagaaagctgtgcgagaaggtgtacagcgactgcaagaagctgatcgacaccttcggcatcagatggcccgaggagctggagtgcgacagactgcagtactgcgacgagaccgtgcccgtgaccttcgacccccacaccgagttcctgggcccccagaagaagaccgagcaggtgcagagagacatcggcttctggtgccccagacacctgaagaccagcggcggccagggctacaagttcctgggcatcgaccagtgcgcccccccctgccccaacatgtacttcaagagcgacgagctggagttcgccaagagcttcatcggcaccgtgagcatcttctgcctgtgcgccaccctgttcaccttcctgaccttcctgatcgacgtgagaagattcagataccccgagagacccatcatctactacagcgtgtgctacagcatcgtgagcctgatgtacttcatcggcttcctgctgggcgacagcaccgcctgcaacaaggccgacgagaagctggagctgggcgacaccgtggtgctgggcagccagaacaaggcctgcaccgtgctgttcatgctgctgtacttcttcaccatggccggcaccgtgtggtgggtgatcctgaccatcacctggttcctggccgccggcagaaagtggagctgcgaggccatcgagcagaaggccgtgtggttccacgccgtggcctggggcacccccggcttcctgaccgtgatgctgctggccatgaacaaggtggagggcgacaacatcagcggcgtgtgcttcgtgggcctgtacgacctggacgccagcagatacttcgtgctgctgcccctgtgcctgtgcgtgttcgtgggcctgagcctgctgctggccggcatcatcagcctgaaccacgtgagacaggtgatccagcacgacggcagaaaccaggagaagctgaagaagttcatgatcagaatcggcgtgttcagcggcctgtacctggtgcccctggtgaccctgctgggctgctacgtgtacgagcaggtgaacagaatcacctgggagatcacctgggtgagcgaccactgcagacagtaccacatcccctgcccctaccaggccaaggccaaggccagacccgagctggccctgttcatgatcaagtacctgatgaccctgatcgtgggcatcagcgccgtgttctgggtgggcagcaagaagacctgcaccgagtgggccggcttcttcaagagaaacagaaagagagaccccatcagcgagagcagaagagtgctgcaggagagctgcgagttcttcctgaagcacaacagcaaggtgaagcacaagaagaagcactacaagcccagcagccacaagctgaaggtgatcagcaagagcatgggcaccagcaccggcgccaccgccaaccacggcaccagcgccgtggccatcaccagccacgactacctgggccaggagaccctgaccgagatccagaccagccccgagaccagcatgagagaggtgaaggccgacggcgccagcacccccagactgagagagcaggactgcggcgagcccgccagccccgccgccagcatcagcagactgagcggcgagcaggtggacggcaagggccaggccggcagcgtgagcgagagcgccagaagcgagggcagaatcagccccaagagcgacatcaccgacaccggcctggcccagagcaacaacctgcaggtgcccagcagcagcgagcccagcagcctgaagggcagcaccagcctgctggtgcaccccgtgagcggcgtgagaaaggagcagggcggcggctgccacagcgacacctag

SEQ ID NO: 82112 - DNA, 1206 bp, Artificial Sequence
  Description of Artificial Sequence: Synthetic coding sequence
atgaccagagtgctgcccagatggaagtggagctgcgaggccatcgagcagaaggccgtgtggttccacgccgtggcctggggcacccccggcttcctgaccgtgatgctgctggccatgaacaaggtggagggcgacaacatcagcggcgtgtgcttcgtgggcctgtacgacctggacgccagcagatacttcgtgctgctgcccctgtgcctgtgcgtgttcgtgggcctgagcctgctgctggccggcatcatcagcctgaaccacgtgagacaggtgatccagcacgacggcagaaaccaggagaagctgaagaagttcatgatcagaatcggcgtgttcagcggcctgtacctggtgcccctggtgaccctgctgggctgctacgtgtacgagcaggtgaacagaatcacctgggagatcacctgggtgagcgaccactgcagacagtaccacatcccctgcccctaccaggccaaggccaaggccagacccgagctggccctgttcatgatcaagtacctgatgaccctgatcgtgggcatcagcgccgtgttctgggtgggcagcaagaagacctgcaccgagtgggccggcttcttcaagagaaacagaaagagagaccccatcagcgagagcagaagagtgctgcaggagagctgcgagttcttcctgaagcacaacagcaaggtgaagcacaagaagaagcactacaagcccagcagccacaagctgaaggtgatcagcaagagcatgggcaccagcaccggcgccaccgccaaccacggcaccagcgccgtggccatcaccagccacgactacctgggccaggagaccctgaccgagatccagaccagccccgagaccagcatgagagaggtgaaggccgacggcgccagcacccccagactgagagagcaggactgcggcgagcccgccagccccgccgccagcatcagcagactgagcggcgagcaggtggacggcaagggccaggccggcagcgtgagcgagagcgccagaagcgagggcagaatcagccccaagagcgacatcaccgacaccggcctggcccagagcaacaacctgcaggtgcccagcagcagcgagcccagcagcctgaagggcagcaccagcctgctggtgcaccccgtgagcggcgtgagaaaggagcagggcggcggctgccacagcgacacctag

SEQ ID NO: 82113 - DNA, 2085 bp, Artificial Sequence
  Description of Artificial Sequence: Synthetic coding sequence
atggagtggggctacctgctggaggtgaccagcctgctggccgccctggccctgctgcagagaagcagcggcgccgccgccgccagcgccaaggagctggcctgccaggagatcaccgtgcccctgtgcaagggcatcggctacaactacacctacatgcccaaccagttcaaccacgacacccaggacgaggccggcctggaggtgcaccagttctggcccctggtggagatccagtgcagccccgacctgaagttcttcctgtgcagcatgtacacccccatctgcctggaggactacaagaagcccctgcccccctgcagaagcgtgtgcgagagagccaaggccggctgcgcccccctgatgagacagtacggcttcgcctggcccgacagaatgagatgcgacagactgcccgagcagggcaaccccgacaccctgtgcatggactacaacagaaccgacctgaccaccgccgcccccagcccccccagaagactgcccccccccccccccggcgagcagccccccagcggcagcggccacggcagaccccccggcgccagacccccccacagaggcggcggcagaggcggcggcggcggcgacgccgccgccccccccgccagaggcggcggcggcggcggcaaggccagaccccccggcggcggcgccgccccctgcgagcccggctgccagtgcagagcccccatggtgagcgtgagcagcgagagacaccccctgtacaacagagtgaagaccggccagatcgccaactgcgccctgccctgccacaaccccttcttcagccaggacgagagagccttcaccgtgttctggatcggcctgtggagcgtgctgtgcttcgtgagcaccttcgccaccgtgagcaccttcctgatcgacatggagagattcaagtaccccgagagacccatcatcttcctgagcgcctgctacctgttcgtgagcgtgggctacctggtgagactggtggccggccacgagaaggtggcctgcagcggcggcgcccccggcgccggcggcgccggcggcgccggcggcgccgccgccggcgccggcgccgccggcgccggcgccggcggccccggcggcagaggcgagtacgaggagctgggcgccgtggagcagcacgtgagatacgagaccaccggccccgccctgtgcaccgtggtgttcctgctggtgtacttcttcggcatggccagcagcatctggtgggtgatcctgagcctgacctggttcctggccgccggcatgaagtggggcaacgaggccatcgccggctacagccagtacttccacctggccgcctggctggtgcccagcgtgaagagcatcgccgtgctggccctgagcagcgtggacggcgaccccgtggccggcatctgctacgtgggcaaccagagcctggacaacctgagaggcttcgtgctggcccccctggtgatctacctgttcatcggcaccatgttcctgctggccggcttcgtgagcctgttcagaatcagaagcgtgatcaagcagcaggacggccccaccaagacccacaagctggagaagctgatgatcagactgggcctgttcaccgtgctgtacaccgtgcccgccgccgtggtggtggcctgcctgttctacgagcagcacaacagacccagatgggaggccacccacaactgcccctgcctgagagacctgcagcccgaccaggccagaagacccgactacgccgtgttcatgctgaagtacttcatgtgcctggtggtgggcatcaccagcggcgtgtgggtgtggagcggcaagaccctggagagctggagaagcctgtgcaccagatgctgctgggccagcaagggcgccgccgtgggcggcggcgccggcgccaccgccgccggcggcggcggcggccccggcggcggcggcggcggcggccccggcggcggcggcggccccggcggcggcggcggcagcctgtacagcgacgtgagcaccggcctgacctggagaagcggcaccgccagcagcgtgagctaccccaagcagatgcccctgagccaggtgtag

SEQ ID NO: 82114 - DNA, 1776 bp, Artificial Sequence
  Description of Artificial Sequence: Synthetic coding sequence
atggccgtggcccccctgagaggcgccctgctgctgtggcagctgctggccgccggcggcgccgccctggagatcggcagattcgaccccgagagaggcagaggcgccgccccctgccaggccgtggagatccccatgtgcagaggcatcggctacaacctgaccagaatgcccaacctgctgggccacaccagccagggcgaggccgccgccgagctggccgagttcgcccccctggtgcagtacggctgccacagccacctgagattcttcctgtgcagcctgtacgcccccatgtgcaccgaccaggtgagcacccccatccccgcctgcagacccatgtgcgagcaggccagactgagatgcgcccccatcatggagcagttcaacttcggctggcccgacagcctggactgcgccagactgcccaccagaaacgacccccacgccctgtgcatggaggcccccgagaacgccaccgccggccccgccgagccccacaagggcctgggcatgctgcccgtggcccccagacccgccagaccccccggcgacctgggccccggcgccggcggcagcggcacctgcgagaaccccgagaagttccagtacgtggagaagagcagaagctgcgcccccagatgcggccccggcgtggaggtgttctggagcagaagagacaaggacttcgccctggtgtggatggccgtgtggagcgccctgtgcttcttcagcaccgccttcaccgtgctgaccttcctgctggagccccacagattccagtaccccgagagacccatcatcttcctgagcatgtgctacaacgtgtacagcctggccttcctgatcagagccgtggccggcgcccagagcgtggcctgcgaccaggaggccggcgccctgtacgtgatccaggagggcctggagaacaccggctgcaccctggtgttcctgctgctgtactacttcggcatggccagcagcctgtggtgggtggtgctgaccctgacctggttcctggccgccggcaagaagtggggccacgaggccatcgaggcccacggcagctacttccacatggccgcctggggcctgcccgccctgaagaccatcgtgatcctgaccctgagaaaggtggccggcgacgagctgaccggcctgtgctacgtggccagcaccgacgccgccgccctgaccggcttcgtgctggtgcccctgagcggctacctggtgctgggcagcagcttcctgctgaccggcttcgtggccctgttccacatcagaaagatcatgaagaccggcggcaccaacaccgagaagctggagaagctgatggtgaagatcggcgtgttcagcatcctgtacaccgtgcccgccacctgcgtgatcgtgtgctacgtgtacgagagactgaacatggacttctggagactgagagccaccgagcagccctgcgccgccgccgccggccccggcggcagaagagactgcagcctgcccggcggcagcgtgcccaccgtggccgtgttcatgctgaagatcttcatgagcctggtggtgggcatcaccagcggcgtgtgggtgtggagcagcaagaccttccagacctggcagagcctgtgctacagaaagatcgccgccggcagagccagagccaaggcctgcagagcccccggcagctacggcagaggcacccactgccactacaaggcccccaccgtggtgctgcacatgaccaagaccgaccccagcctggagaaccccacccacctgtag

SEQ ID NO: 82115 - DNA, 978 bp, Artificial Sequence
  Description of Artificial Sequence: Synthetic coding sequence
atggtgtgcggcagccccggcggcatgctgctgctgagagccggcctgctggccctggccgccctgtgcctgctgagagtgcccggcgccagagccgccgcctgcgagcccgtgagaatccccctgtgcaagagcctgccctggaacatgaccaagatgcccaaccacctgcaccacagcacccaggccaacgccatcctggccatcgagcagttcgagggcctgctgggcacccactgcagccccgacctgctgttcttcctgtgcgccatgtacgcccccatctgcaccatcgacttccagcacgagcccatcaagccctgcaagagcgtgtgcgagagagccagacagggctgcgagcccatcctgatcaagtacagacacagctggcccgagaacctggcctgcgaggagctgcccgtgtacgacagaggcgtgtgcatcagccccgaggccatcgtgaccgccgacggcgccgacttccccatggacagcagcaacggcaactgcagaggcgccagcagcgagagatgcaagtgcaagcccatcagagccacccagaagacctacttcagaaacaactacaactacgtgatcagagccaaggtgaaggagatcaagaccaagtgccacgacgtgaccgccgtggtggaggtgaaggagatcctgaagagcagcctggtgaacatccccagagacaccgtgaacctgtacaccagcagcggctgcctgtgcccccccctgaacgtgaacgaggagtacatcatcatgggctacgaggacgaggagagaagcagactgctgctggtggagggcagcatcgccgagaagtggaaggacagactgggcaagaaggtgaagagatgggacatgaagctgagacacctgggcctgagcaagagcgacagcagcaacagcgacagcacccagagccagaagagcggcagaaacagcaaccccagacaggccagaaactag

SEQ ID NO: 82116 - DNA, 930 bp, Artificial Sequence
  Description of Artificial Sequence: Synthetic coding sequence
atggaggagctgctgagaagagagctgggctgcagcagcgtgagagccaccggccacagcggcggcggctgcatcagccagggcagaagctacgacaccgaccagggcagagtgttcgtgaaggtgaaccccaaggccgaggccagaagaatgttcgagggcgagatggccagcctgaccgccatcctgaagaccaacaccgtgaaggtgcccaagcccatcaaggtgctggacgcccccggcggcggcagcgtgctggtgatggagcacatggacatgagacacctgagcagccacgccgccaagctgggcgcccagctggccgacctgcacctggacaacaagaagctgggcgagatgagactgaaggaggccggcaccgtgggcagaggcggcggccaggaggagagacccttcgtggccagattcggcttcgacgtggtgacctgctgcggctacctgccccaggtgaacgactggcaggaggactgggtggtgttctacgccagacagagaatccagccccagatggacatggtggagaaggagagcggcgacagagaggccctgcagctgtggagcgccctgcagctgaagatccccgacctgttcagagacctggagatcatccccgccctgctgcacggcgacctgtggggcggcaacgtggccgaggacagcagcggccccgtgatcttcgaccccgccagcttctacggccacagcgagtacgagctggccatcgccggcatgttcggcggcttcagcagcagcttctacagcgcctaccacggcaagatccccaaggcccccggcttcgagaagagactgcagctgtaccagctgttccactacctgaaccactggaaccacttcggcagcggctacagaggcagcagcctgaacatcatgagaaacctggtgaagtag

SEQ ID NO: 82117 - DNA, 780 bp, Artificial Sequence
  Description of Artificial Sequence: Synthetic coding sequence
atgttcgagggcgagatggccagcctgaccgccatcctgaagaccaacaccgtgaaggtgcccaagcccatcaaggtgctggacgcccccggcggcggcagcgtgctggtgatggagcacatggacatgagacacctgagcagccacgccgccaagctgggcgcccagctggccgacctgcacctggacaacaagaagctgggcgagatgagactgaaggaggccggcaccgtgggcagaggcggcggccaggaggagagacccttcgtggccagattcggcttcgacgtggtgacctgctgcggctacctgccccaggtgaacgactggcaggaggactgggtggtgttctacgccagacagagaatccagccccagatggacatggtggagaaggagagcggcgacagagaggccctgcagctgtggagcgccctgcagctgaagatccccgacctgttcagagacctggagatcatccccgccctgctgcacggcgacctgtggggcggcaacgtggccgaggacagcagcggccccgtgatcttcgaccccgccagcttctacggccacagcgagtacgagctggccatcgccggcatgttcggcggcttcagcagcagcttctacagcgcctaccacggcaagatccccaaggcccccggcttcgagaagagactgcagctgtaccagctgttccactacctgaaccactggaaccacttcggcagcggctacagaggcagcagcctgaacatcatgagaaacctggtgaagtag

SEQ ID NO: 82118 - DNA, 1017 bp, Artificial Sequence
  Description of Artificial Sequence: Synthetic coding sequence
atggccgaccaggcccccttcgacaccgacgtgaacaccctgaccagattcgtgatggaggagggcagaaaggccagaggcaccggcgagctgacccagctgctgaacagcctgtgcaccgccgtgaaggccatcagcagcgccgtgagaaaggccggcatcgcccacctgtacggcatcgccggcagcaccaacgtgaccggcgaccaggtgaagaagctggacgtgctgagcaacgacctggtgatgaacatgctgaagagcagcttcgccacctgcgtgctggtgagcgaggaggacaagcacgccatcatcgtggagcccgagaagagaggcaagtacgtggtgtgcttcgaccccctggacggcagcagcaacatcgactgcctggtgagcgtgggcaccatcttcggcatctacagaaagaagagcaccgacgagcccagcgagaaggacgccctgcagcccggcagaaacctggtggccgccggctacgccctgtacggcagcgccaccatgctggtgctggccatggactgcggcgtgaactgcttcatgctggaccccgccatcggcgagttcatcctggtggacaaggacgtgaagatcaagaagaagggcaagatctacagcctgaacgagggctacgccagagacttcgaccccgccgtgaccgagtacatccagagaaagaagttcccccccgacaacagcgccccctacggcgccagatacgtgggcagcatggtggccgacgtgcacagaaccctggtgtacggcggcatcttcctgtaccccgccaacaagaagagccccaacggcaagctgagactgctgtacgagtgcaaccccatggcctacgtgatggagaaggccggcggcatggccaccaccggcaaggaggccgtgctggacgtgatccccaccgacatccaccagagagcccccgtgatcctgggcagccccgacgacgtgctggagttcctgaaggtgtacgagaagcacagcgcccagtag

SEQ ID NO: 82119 - DNA, 456 bp, Artificial Sequence
  Description of Artificial Sequence: Synthetic coding sequence
atgctgaagagcagcttcgccacctgcgtgctggtgagcgaggaggacaagcacgccatcatcgtggagcccgagaagagaggcaagtacgtggtgtgcttcgaccccctggacggcagcagcaacatcgactgcctggtgagcgtgggcaccatcttcggcatctacagaaagaagagcaccgacgagcccagcgagaaggacgccctgcagcccggcagaaacctggtggccgccggctacgccctgtacggcagcgccaccatgctggtgctggccatggactgcggcgtgaactgcttcatgctggaccccgccatcggcgagttcatcctggtggacaaggacgtgaagatcaagaagaagggcaagatctacagcctgaacgagggctacgccagagacttcgaccccgccgtgaccgagtacatccagagaaagaagttccccccctag

SEQ ID NO: 82120 - DNA, 1017 bp, Artificial Sequence; identical to SEQ ID NO: 82118
  Description of Artificial Sequence: Synthetic coding sequence

SEQ ID NO: 82121 - DNA, 1020 bp, Artificial Sequence
  Description of Artificial Sequence: Synthetic coding sequence
atgaccgacagaagccccttcgagaccgacatgctgaccctgaccagatacgtgatggagaagggcagacaggccaagggcaccggcgagctgacccagctgctgaacagcatgctgaccgccatcaaggccatcagcagcgccgtgagaaaggccggcctggcccacctgtacggcatcgccggcagcgtgaacgtgaccggcgacgaggtgaagaagctggacgtgctgagcaacagcctggtgatcaacatggtgcagagcagctacagcacctgcgtgctggtgagcgaggagaacaaggacgccatcatcaccgccaaggagaagagaggcaagtacgtggtgtgcttcgaccccctggacggcagcagcaacatcgactgcctggccagcatcggcaccatcttcgccatctacagaaagaccagcgaggacgagcccagcgagaaggacgccctgcagtgcggcagaaacatcgtggccgccggctacgccctgtacggcagcgccaccctggtggccctgagcaccggccagggcgtggacctgttcatgctggaccccgccctgggcgagttcgtgctggtggagaaggacgtgaagatcaagaagaagggcaagatctacagcctgaacgagggctacgccaagtacttcgacgccgccaccaccgagtacgtgcagaagaagaagttccccgaggacggcagcgccccctacggcgccagatacgtgggcagcatggtggccgacgtgcacagaaccctggtgtacggcggcatcttcctgtaccccgccaaccagaagagccccaagggcaagctgagactgctgtacgagtgcaaccccgtggcctacatcatcgagcaggccggcggcctggccaccaccggcacccagcccgtgctggacgtgaagcccgaggccatccaccagagagtgcccctgatcctgggcagccccgaggacgtgcaggagtacctgacctgcgtgcagaagaaccaggccggcagctag

SEQ ID NO: 82122 - DNA, 837 bp, Artificial Sequence
  Description of Artificial Sequence: Synthetic coding sequence
atgggcaagggcaacgaggacagcgacctgcactgcagcagcatccagtgcagcaccgaccagccccccttccagcagatcagcttcaccgagaagggcagcgacgagaagaagcccttcaaggagaagggcaagaccgccttcagccacagcagcgagaagcacatccagagacagggcagcgagcccaaccccaacaaggagaacagcgaggagaccaagctgaaggccggcaacagcaccgccggcagcgagcccgagagcagcagctacagagagaactgcagaaagagaaagatgagcagcaaggacagctgccaggacaccgccggcaactgccccgagaaggagtgcagcctgagcctgaacaagaagagcagaagcagcaccgccgtgcacaacagcgagatccaggagacctgcgacgcccaccacagaggccacagcagagcctgcaccggccacagcaagagacacagaagcagagccctgggcgtgcagacccccagcatcagaaagagcctggtgaccagcgtgagagccatgagcgaggccgtgtaccaggacctggcccaggtgtgggcccagcagatccacagccccctgacctgcgagcagctgaccctgctgaccagactgagaggccccctgtgcgcccaggtgcagaccctgtacagcatggccacccaggccgcctacgtgttccccgccgagagctggctggtgcccgccaccctgcccggccccggcgagagcgccctggacagagaggcccaccccttccccggccaggagatcaccgagaccgtgagcggcagcgacgaggccaagctgtag

SEQ ID NO: 82123 - DNA, 984 bp, Artificial Sequence
  Description of Artificial Sequence: Synthetic coding sequence
atgggcagaaccagcaaggacaagagagacgtgtactacagactggccaaggagaacggctggagagccagaagcgccttcaagctgctgcagctggacaaggagttccagctgttccagggcgtgaccagagccgtggacctgtgcgccgcccccggcagctggagccaggtgctgagccagaagatcggcggccagggcagcggccacgtggtggccgtggacctgcaggccatggcccccctgcccggcgtggtgcagatccagggcgacatcacccagctgagcaccgccaaggagatcatccagcacttcaagggctgccccgccgacctggtggtgtgcgacggcgcccccgacgtgaccggcctgcacgacgtggacgagtacatgcaggcccagctgctgctggccgccctgaacatcgccacccacgtgctgaagcccggcggctgcttcgtggccaagatcttcagaggcagagacgtgaccctgctgtacagccagctgcaggtgttcttcagcagcgtgctgtgcgccaagcccagaagcagcagaaacagcagcatcgaggccttcgccgtgtgccagggctacgacccccccgagggcttcatccccgacctgagcaagcccctgctggaccacagctacgacttcaaccagctggacggccccaccagaatcatcgtgcccttcgtgacctgcggcgacctgagcagctacgacagcgacagaagctaccccctggacctggagggcggcagcgagtacaagtacaccccccccacccagccccccatcagccccccctaccaggaggcctgcaccctgaagagaaagggccagctggccaaggagatcagaccccaggactgccccatcagcagagtggacaccttcccccagcccctggccgccccccagtgccacaccctgctggcccccgagatggaggacaacgagatgagctgcagcccctag

SEQ ID NO: 82124 - DNA, 990 bp, Artificial Sequence
  Description of Artificial Sequence: Synthetic coding sequence
atgggcagaaccagcaaggacaagagagacgtgtactacagactggccaaggagaacggctggagagccagaagcgccttcaagctgctgcagctggacaaggagttccagctgttccagggcgtgaccagagccgtggacctgtgcgccgcccccggcagctggagccaggtgctgagccagaagatcggcggccagggcagcggccacgtggtggccgtggacctgcaggccatggcccccctgcccggcgtggtgcagatccagggcgacatcacccagctgagcaccgccaaggagatcatccagcacttcaagggctgccccgccgacctggtggtgtgcgacggcgcccccgacgtgaccggcctgcacgacgtggacgagtacatgcaggcccagctgctgctggccgccctgaacatcgccacccacgtgctgaagcccggcggctgcttcgtggccaagatcttcagaggcagagacgtgaccctgctgtacagccagctgcaggtgttcttcagcagcgtgctgtgcgccaagcccagaagcagcagaaacagcagcatcgaggccttcgccgtgtgccagggctacgacccccccgagggcttcatccccgacctgagcaagcccctgctggaccacagctacgaccccgacttcaaccagctggacggccccaccagaatcatcgtgcccttcgtgacctgcggcgacctgagcagctacgacagcgacagaagctaccccctggacctggagggcggcagcgagtacaagtacaccccccccacccagccccccatcagccccccctaccaggaggcctgcaccctgaagagaaagggccagctggccaaggagatcagaccccaggactgccccatcagcagagtggacaccttcccccagcccctggccgccccccagtgccacaccctgctggcccccgagatggaggacaacgagatgagctgcagcccctag

SEQ ID NO: 82125 - DNA, 579 bp, Artificial Sequence
  Description of Artificial Sequence: Synthetic coding sequence
atggccctgaacatcgccacccacgtgctgaagcccggcggctgcttcgtggccaagatcttcagaggcagagacgtgaccctgctgtacagccagctgcaggtgttcttcagcagcgtgctgtgcgccaagcccagaagcagcagaaacagcagcatcgaggccttcgccgtgtgccagggctacgacccccccgagggcttcatccccgacctgagcaagcccctgctggaccacagctacgaccccgacttcaaccagctggacggccccaccagaatcatcgtgcccttcgtgacctgcggcgacctgagcagctacgacagcgacagaagctaccccctggacctggagggcggcagcgagtacaagtacaccccccccacccagccccccatcagccccccctaccaggaggcctgcaccctgaagagaaagggccagctggccaaggagatcagaccccaggactgccccatcagcagagtggacaccttcccccagcccctggccgccccccagtgccacaccctgctggcccccgagatggaggacaacgagatgagctgcagcccctag

SEQ ID NO: 82126 - DNA, 984 bp, Artificial Sequence; identical to SEQ ID NO: 82123
  Description of Artificial Sequence: Synthetic coding sequence

SEQ ID NO: 82127 - DNA, 741 bp, Artificial Sequence
  Description of Artificial Sequence: Synthetic coding sequence
atggccggctacctgaagctggtgtgcgtgagcttccagagacagggcttccacaccgtgggcagcagatgcaagaacagaaccggcgccgagcacctgtggctgaccagacacctgagagaccccttcgtgaaggccgccaaggtggagagctacagatgcagaagcgccttcaagctgctggaggtgaacgagagacaccagatcctgagacccggcctgagagtgctggactgcggcgccgcccccggcgcctggagccaggtggccgtgcagaaggtgaacgccgccggcaccgaccccagcagccccgtgggcttcgtgctgggcgtggacctgctgcacatcttccccctggagggcgccaccttcctgtgccccgccgacgtgaccgaccccagaaccagccagagaatcctggaggtgctgcccggcagaagagccgacgtgatcctgagcgacatggcccccaacgccaccggcttcagagacctggaccacgacagactgatcagcctgtgcctgaccctgctgagcgtgacccccgacatcctgcagcccggcggcaccttcctgtgcaagacctgggccggcagccagagcagaagactgcagagaagactgaccgaggagttccagaacgtgagaatcatcaagcccgaggccagcagaaaggagagcagcgaggtgtacttcctggccacccagtaccacggcagaaagggcaccgtgaagcagtag

SEQ ID NO: 82128 - DNA, 438 bp, Artificial Sequence
  Description of Artificial Sequence: Synthetic coding sequence
atggccggctacctgaagctggtgtgcgtgagcttccagagacagggcttccacaccgtgggcagcagatgcaagaacagaaccggcgccgagcacctgtggctgaccagacacctgagagaccccttcgtgaaggccgccaaggtggagagctacagatgcagaagcgccttcaagctgctggaggtgaacgagagacaccagatcctgagacccggcctgagagtgctggactgcggcgccgcccccggcgcctggagccaggtggccgtgcagaaggtgaacgccgccggcaccgacggcgtgagcctgctgcccagactgcagtgcaacggcgtgatcagcgcccactgcaacctgtgcctgcccggcagcagcgacagccccgccagcgccagccagatccccgccctgctgctggccagctgcctgggctag

SEQ ID NO: 82129 - DNA, 768 bp, Artificial Sequence
  Description of Artificial Sequence: Synthetic coding sequence
atgcccgagctgtacgacctggtgaacagctacaagcccgacctgatctggagcgacggcgagtgggagtgccccgacacctactggaacagcaccaacttcctgagctggctgtacaacgacagccccgtgaaggacgaggtggtggtgaacgacagatggggccagaactgcagctgccaccacggcggctactacaactgcgaggacaagttcaagccccagagcctgcccgaccacaagtgggagatgtgcaccagcatcgacaagttcagctggggctacagaagagacatggccctgagcgacgtgaccgaggagagcgagatcatcagcgagctggtgcagaccgtgagcctgggcggcaactacctgctgaacatcggccccaccaaggacggcctgatcgtgcccatcttccaggagagactgctggccgtgggcaagtggctgagcatcaacggcgaggccatctacgccagcaagccctggagagtgcagtgggagaagaacaccaccagcgtgtggtacaccagcaagggcagcgccgtgtacgccatcttcctgcactggcccgagaacggcgtgctgaacctggagagccccatcaccaccagcaccaccaagatcaccatgctgggcatccagggcgacctgaagtggagcaccgaccccgacaagggcctgttcatcagcctgccccagctgccccccagcgccgtgcccgccgagttcgcctggaccatcaagctgaccggcgtgaagtag

SEQ ID NO: 82130 - DNA, 1401 bp, Artificial Sequence
  Description of Artificial Sequence: Synthetic coding sequence
atgagagcccccggcatgagaagcagacccgccggccccgccctgctgctgctgctgctgttcctgggcgccgccgagagcgtgagaagagcccagccccccagaagatacacccccgactggcccagcctggacagcagacccctgcccgcctggttcgacgaggccaagttcggcgtgttcatccactggggcgtgttcagcgtgcccgcctggggcagcgagtggttctggtggcactggcagggcgagggcagaccccagtaccagagattcatgagagacaactacccccccggcttcagctacgccgacttcggcccccagttcaccgccagattcttccaccccgaggagtgggccgacctgttccaggccgccggcgccaagtacgtggtgctgaccaccaagcaccacgagggcttcaccaactggcccagccccgtgagctggaactggaacagcaaggacgtgggcccccacagagacctggtgggcgagctgggcaccgccctgagaaagagaaacatcagatacggcctgtaccacagcctgctggagtggttccaccccctgtacctgctggacaagaagaacggcttcaagacccagcacttcgtgagcgccaagaccatgcccgagctgtacgacctggtgaacagctacaagcccgacctgatctggagcgacggcgagtgggagtgccccgacacctactggaacagcaccaacttcctgagctggctgtacaacgacagccccgtgaaggacgaggtggtggtgaacgacagatggggccagaactgcagctgccaccacggcggctactacaactgcgaggacaagttcaagccccagagcctgcccgaccacaagtgggagatgtgcaccagcatcgacaagttcagctggggctacagaagagacatggccctgagcgacgtgaccgaggagagcgagatcatcagcgagctggtgcagaccgtgagcctgggcggcaactacctgctgaacatcggccccaccaaggacggcctgatcgtgcccatcttccaggagagactgctggccgtgggcaagtggctgagcatcaacggcgaggccatctacgccagcaagccctggagagtgcagtgggagaagaacaccaccagcgtgtggtacaccagcaagggcagcgccgtgtacgccatcttcctgcactggcccgagaacggcgtgctgaacctggagagccccatcaccaccagcaccaccaagatcaccatgctgggcatccagggcgacctgaagtggagcaccgaccccgacaagggcctgttcatcagcctgccccagctgccccccagcgccgtgcccgccgagttcgcctggaccatcaagctgaccggcgtgaagtag

SEQ ID NO: 82131 - DNA, 1404 bp, Artificial Sequence
  Description of Artificial Sequence: Synthetic coding sequence
atgagaccccaggagctgcccagactggccttccccctgctgctgctgctgctgctgctgctgcccccccccccctgccccgcccacagcgccaccagattcgaccccacctgggagagcctggacgccagacagctgcccgcctggttcgaccaggccaagttcggcatcttcatccactggggcgtgttcagcgtgcccagcttcggcagcgagtggttctggtggtactggcagaaggagaagatccccaagtacgtggagttcatgaaggacaactacccccccagcttcaagtacgaggacttcggccccctgttcaccgccaagttcttcaacgccaaccagtgggccgacatcttccaggccagcggcgccaagtacatcgtgctgaccagcaagcaccacgagggcttcaccctgtggggcagcgagtacagctggaactggaacgccatcgacgagggccccaagagagacatcgtgaaggagctggaggtggccatcagaaacagaaccgacctgagattcggcctgtactacagcctgttcgagtggttccaccccctgttcctggaggacgagagcagcagcttccacaagagacagttccccgtgagcaagaccctgcccgagctgtacgagctggtgaacaactaccagcccgaggtgctgtggagcgacggcgacggcggcgcccccgaccagtactggaacagcaccggcttcctggcctggctgtacaacgagagccccgtgagaggcaccgtggtgaccaacgacagatggggcgccggcagcatctgcaagcacggcggcttctacacctgcagcgacagatacaaccccggccacctgctgccccacaagtgggagaactgcatgaccatcgacaagctgagctggggctacagaagagaggccggcatcagcgactacctgaccatcgaggagctggtgaagcagctggtggagaccgtgagctgcggcggcaacctgctgatgaacatcggccccaccctggacggcaccatcagcgtggtgttcgaggagagactgagacagatgggcagctggctgaaggtgaacggcgaggccatctacgagacccacacctggagaagccagaacgacaccgtgacccccgacgtgtggtacaccagcaagcccaaggagaagctggtgtacgccatcttcctgaagtggcccaccagcggccagctgttcctgggccaccccaaggccatcctgggcgccaccgaggtgaagctgctgggccacggccagcccctgaactggatcagcctggagcagaacggcatcatggtggagctgccccagctgaccatccaccagatgccctgcaagtggggctgggccctggccctgaccaacgtgatctag

SEQ ID NO: 82132 - DNA, 498 bp, Artificial Sequence
  Description of Artificial Sequence: Synthetic coding sequence
atgagaccccaggagctgcccagactggccttccccctgctgctgctgctgctgctgctgctgcccccccccccctgccccgcccacagcgccaccagattcgaccccacctgggagagcctggacgccagacagctgcccgcctggttcgaccaggccaagttcggcatcttcatccactggggcgtgttcagcgtgcccagcttcggcagcgagtggttctggtggtactggcagaaggagaagatccccaagtacgtggagttcatgaaggacaactacccccccagcttcaagtacgaggacttcggccccctgttcaccgccaagttcttcaacgccaaccagtgggccgacatcttccaggccagcggcgccaagtacatcgtgctgaccagcaagcaccacgaggccacctgcagagacagcttcatgtggagaaagagcttcgacgagtactgggcccacaccagatggcaccacttctgcagcttctag

SEQ ID NO: 82133 - DNA, 498 bp, Artificial Sequence; identical to SEQ ID NO: 82132
  Description of Artificial Sequence: Synthetic coding sequence

SEQ ID NO: 82134 - DNA, 330 bp, Artificial Sequence
  Description of Artificial Sequence: Synthetic coding sequence
cagctggtggagaccgtgagctgcggcggcaacctgctgatgaacatcggccccaccctggacggcaccatcagcgtggtgttcgaggagagactgagacagatgggcagctggctgaaggtgaacggcgaggccatctacgagacccacacctggagaagccagaacgacaccgtgacccccgacgtgtggtacaccagcaagcccaaggagaagctggtgtacgccatcttcctgaagtggcccaccagcggccagctgttcctgggccaccccaaggccatcctgggcgccaccgaggtgagaggcaacttcaccctgttcctgtag

SEQ ID NO: 82135 - DNA, 1098 bp, Artificial Sequence
  Description of Artificial Sequence: Synthetic coding sequence
atgtggctgagaagccacagacagctgtgcctggccttcctgctggtgtgcgtgctgagcgtgatcttcttcctgcacatccaccaggacagcttcccccacggcctgggcctgagcatcctgtgccccgacagaagactggtgaccccccccgtggccatcttctgcctgcccggcaccgccatgggccccaacgccagcagcagctgcccccagcaccccgccagcctgagcggcacctggaccgtgtaccccaacggcagattcggcaaccagatgggccagtacgccaccctgctggccctggcccagctgaacggcagaagagccttcatcctgcccgccatgcacgccgccctggcccccgtgttcagaatcaccctgcccgtgctggcccccgaggtggacagcagaaccccctggagagagctgcagctgcacgactggatgagcgaggagtacgccgacctgagagaccccttcctgaagctgagcggcttcccctgcagctggaccttcttccaccacctgagagagcagatcagaagagagttcaccctgcacgaccacctgagagaggaggcccagagcgtgctgggccagctgagactgggcagaaccggcgacagacccagaaccttcgtgggcgtgcacgtgagaagaggcgactacctgcaggtgatgccccagagatggaagggcgtggtgggcgacagcgcctacctgagacaggccatggactggttcagagccagacacgaggcccccgtgttcgtggtgaccagcaacggcatggagtggtgcaaggagaacatcgacaccagccagggcgacgtgaccttcgccggcgacggccaggaggccaccccctggaaggacttcgccctgctgacccagtgcaaccacaccatcatgaccatcggcaccttcggcttctgggccgcctacctggccggcggcgacaccgtgtacctggccaacttcaccctgcccgacagcgagttcctgaagatcttcaagcccgaggccgccttcctgcccgagtgggtgggcatcaacgccgacctgagccccctgtggaccctggccaagccctag

SEQ ID NO: 82136 - DNA, 1068 bp, Artificial Sequence
  Description of Artificial Sequence: Synthetic coding sequence
atgtggctgagaagccacagacagctgtgcctggccttcctgctggtgtgcgtgctgagcgtgatcttcttcctgcacatccaccaggacagcttcccccacggcctgggcctgagcatcctgtgccccgacagaagactggtgaccccccccgtggccatcttctgcctgcccggcaccgccatgggccccaacgccagcagcagctgcccccagcaccccgccagcctgagcggcacctggaccgtgtaccccaacggcagattcggcaaccagatgggccagtacgccaccctgctggccctggcccagctgaacggcagaagagccttcatcctgcccgccatgcacgccgccctggccccccccgaggtggacagcagaaccccctggagagagctgcagctgcacgactggatgagcgaggagtacgccgacctgagagaccccttcctgaagctgagcggcttcccctgcagctggaccttcttccaccacctgagagagcagatcagaagagagttcaccctgcacgaccacctgagagaggaggcccagagcgtgctgggccagctgagactgggcagaaccggcgacagacccagaaccttcgtgggcgtgcacgtgagaagaggcgactacctgcaggtgatgccccagagatggaagggcgtggtgggcgacagcgcctacctgagacaggccatggactggttcagagccagacacgaggcccccgtgttcgtggtgaccagcaacggcatggagtggtgcaaggagaacatcgacaccagccagggcgacgtgaccttcgccggcgacggccaggaggccaccccctggaaggacttcgccctgctgacccagtgcaaccacaccatcatgaccatcggcaccttcggcttctgggccgcctacctggccggcggcgacaccgtgtacctggccaacttcaccctgcccgacagcgagttcctgaagatcttcaagcccgaggccgccttcctgcccgagtgggtgggcatcaacgccgacctgagccccctgtggaccctggccaagccctag

SEQ ID NO: 82137 - DNA, 1032 bp, Artificial Sequence
  Description of Artificial Sequence: Synthetic coding sequence
atgctggtggtgcagatgcccttcagcttccccatggcccacttcatcctgttcgtgttcaccgtgagcaccatcttccacgtgcagcagagactggccaagatccaggccatgtgggagctgcccgtgcagatccccgtgctggccagcaccagcaaggccctgggccccagccagctgagaggcatgtggaccatcaacgccatcggcagactgggcaaccagatgggcgagtacgccaccctgtacgccctggccaagatgaacggcagacccgccttcatccccgcccagatgcacagcaccctggcccccatcttcagaatcaccctgcccgtgctgcacagcgccaccgccagcagaatcccctggcagaactaccacctgaacgactggatggaggaggagtacagacacatccccggcgagtacgtgagattcaccggctacccctgcagctggaccttctaccaccacctgagacaggagatcctgcaggagttcaccctgcacgaccacgtgagagaggaggcccagaagttcctgagaggcctgcaggtgaacggcagcagacccggcaccttcgtgggcgtgcacgtgagaagaggcgactacgtgcacgtgatgcccaaggtgtggaagggcgtggtggccgacagaagatacctgcagcaggccctggactggttcagagccagatacagcagcctgatcttcgtggtgaccagcaacggcatggcctggtgcagagagaacatcgacaccagccacggcgacgtggtgttcgccggcgacggcatcgagggcagccccgccaaggacttcgccctgctgacccagtgcaaccacaccatcatgaccatcggcaccttcggcatctgggccgcctacctgaccggcggcgacaccatctacctggccaactacaccctgcccgacagccccttcctgaagatcttcaagcccgaggccgccttcctgcccgagtggaccggcatcgccgccgacctgagccccctgctgaagcactag

SEQ ID NO: 82138 - DNA, 1032 bp, Artificial Sequence; identical to SEQ ID NO: 82137
  Description of Artificial Sequence: Synthetic coding sequence

SEQ ID NO: 82139 - DNA, 663 bp, Artificial Sequence
  Description of Artificial Sequence: Synthetic coding sequence
atgctggtggtgcagatgcccttcagcttccccatggcccacttcatcctgttcgtgttcaccgtgagcaccatcttccacgtgcagcagagactggccaagatccaggccatgtgggagctgcccgtgcagatccccgtgctggccagcaccagcaaggccctgggccccagccagctgagaggcatgtggaccatcaacgccatcggcagactgggcaaccagatgggcgagtacgccaccctgtacgccctggccaagatgaacggcagacccgccttcatccccgcccagatgcacagcaccctggcccccatcttcagaatcaccctgcccgtgctgcacagcgccaccgccagcagaatcccctggcagaactaccacctgaacgactggatggaggaggagtacagacacatccccggcgagtacgtgagattcaccggctacccctgcagctggaccttctaccaccacctgagacaggagatcctgcaggagttcaccctgcacgaccacgtgagagaggaggcccagaagttcctgagaggcctgcaggtgaacggcagcagacccggcaccttcgtgggcgtgcacgtgagaagaggcgactacgtgcacgtgatgcccaaggtgtggaagggcgtggtggccgacagatag

SEQ ID NO: 82140 - DNA, 1086 bp, Artificial Sequence
  Description of Artificial Sequence: Synthetic coding sequence
atggaccccctgggcgccgccaagccccagtggccctggagaagatgcctggccgccctgctgttccagctgctggtggccgtgtgcttcttcagctacctgagagtgagcagagacgacgccaccggcagccccagagcccccagcggcagcagcagacaggacaccacccccaccagacccaccctgctgatcctgctgagaacctggcccttccacatccccgtggccctgagcagatgcagcgagatggtgcccggcaccgccgactgccacatcaccgccgacagaaaggtgtacccccaggccgacatggtgatcgtgcaccactgggacatcatgagcaaccccaagagcagactgccccccagccccagaccccagggccagagatggatctggttcaacctggagcccccccccaactgccagcacctggaggccctggacagatacttcaacctgaccatgagctacagaagcgacagcgacatcttcaccccctacggctggctggagccctggagcggccagcccgcccacccccccctgaacctgagcgccaagaccgagctggtggcctgggccgtgagcaactggaagcccgacagcgccagagtgagatactaccagagcctgcaggcccacctgaaggtggacgtgtacggcagaagccacaagcccctgcccaagggcaccatgatggagaccctgagcagatacaagttctacctggccttcgagaacagcctgcaccccgactacatcaccgagaagctgtggagaaacgccctggaggcctgggccgtgcccgtggtgctgggccccagcagaagcaactacgagagattcctgccccccgacgccttcatccacgtggacgacttccagagccccaaggacctggccagatacctgcaggagctggacaaggaccacgccagatacctgagctacttcagatggagagagaccctgagacccagaagcttcagctgggccctggacttctgcaaggcctgctggaagctgcagcaggagagcagataccagaccgtgagaagcatcgccgcctggttcacctag

SEQ ID NO: 82141 - DNA, 1086 bp, Artificial Sequence; identical to SEQ ID NO: 82140
  Description of Artificial Sequence: Synthetic coding sequence

SEQ ID NO: 82142 - DNA, 1086 bp, Artificial Sequence; identical to SEQ ID NO: 82140
  Description of Artificial Sequence: Synthetic coding sequence

SEQ ID NO: 82143 - DNA, 1086 bp, Artificial Sequence; identical to SEQ ID NO: 82140
  Description of Artificial Sequence: Synthetic coding sequence

SEQ ID NO: 82144 - DNA, 1593 bp, Artificial Sequence
  Description of Artificial Sequence: Synthetic coding sequence
atgagaagactgtggggcgccgccagaaagcccagcggcgccggctgggagaaggagtgggccgaggccccccaggaggcccccggcgcctggagcggcagactgggccccggcagaagcggcagaaagggcagagccgtgcccggctgggccagctggcccgcccacctggccctggccgccagacccgccagacacctgggcggcgccggccagggccccagacccctgcacagcggcaccgcccccttccacagcagagccagcggcgagagacagagaagactggagccccagctgcagcacgagagcagatgcagaagcagcacccccgccgacgcctggagagccgaggccgccctgcccgtgagagccatgggcgccccctggggcagccccaccgccgccgccggcggcagaagaggctggagaagaggcagaggcctgccctggaccgtgtgcgtgctggccgccgccggcctgacctgcaccgccctgatcacctacgcctgctggggccagctgccccccctgccctgggccagccccacccccagcagacccgtgggcgtgctgctgtggtgggagcccttcggcggcagagacagcgcccccagacccccccccgactgcagactgagattcaacatcagcggctgcagactgctgaccgacagagccagctacggcgaggcccaggccgtgctgttccaccacagagacctggtgaagggcccccccgactggccccccccctggggcatccaggcccacaccgccgaggaggtggacctgagagtgctggactacgaggaggccgccgccgccgccgaggccctggccaccagcagccccagaccccccggccagagatgggtgtggatgaacttcgagagccccagccacagccccggcctgagaagcctggccagcaacctgttcaactggaccctgagctacagagccgacagcgacgtgttcgtgccctacggctacctgtaccccagaagccaccccggcgacccccccagcggcctggccccccccctgagcagaaagcagggcctggtggcctgggtggtgagccactgggacgagagacaggccagagtgagatactaccaccagctgagccagcacgtgaccgtggacgtgttcggcagaggcggccccggccagcccgtgcccgagatcggcctgctgcacaccgtggccagatacaagttctacctggccttcgagaacagccagcacctggactacatcaccgagaagctgtggagaaacgccctgctggccggcgccgtgcccgtggtgctgggccccgacagagccaactacgagagattcgtgcccagaggcgccttcatccacgtggacgacttccccagcgccagcagcctggccagctacctgctgttcctggacagaaaccccgccgtgtacagaagatacttccactggagaagaagctacgccgtgcacatcaccagcttctgggacgagccctggtgcagagtgtgccaggccgtgcagagagccggcgacagacccaagagcatcagaaacctggccagctggttcgagagatag

SEQ ID NO: 82145 - DNA, 1125 bp, Artificial Sequence
  Description of Artificial Sequence: Synthetic coding sequence
atggaccccctgggccccgccaagccccagtggctgtggagaagatgcctggccggcctgctgttccagctgctggtggccgtgtgcttcttcagctacctgagagtgagcagagacgacgccaccggcagccccagacccggcctgatggccgtggagcccgtgaccggcgcccccaacggcagcagatgccaggacagcatggccacccccgcccaccccaccctgctgatcctgctgtggacctggcccttcaacacccccgtggccctgcccagatgcagcgagatggtgcccggcgccgccgactgcaacatcaccgccgacagcagcgtgtacccccaggccgacgccgtgatcgtgcaccactgggacatcatgtacaaccccagcgccaacctgcccccccccaccagaccccagggccagagatggatctggttcagcatggagagccccagcaactgcagacacctggaggccctggacggctacttcaacctgaccatgagctacagaagcgacagcgacatcttcaccccctacggctggctggagccctggagcggccagcccgcccacccccccctgaacctgagcgccaagaccgagctggtggcctgggccgtgagcaactggaagcccgacagcgccagagtgagatactaccagagcctgcaggcccacctgaaggtggacgtgtacggcagaagccacaagcccctgcccaagggcaccatgatggagaccctgagcagatacaagttctacctggccttcgagaacagcctgcaccccgactacatcaccgagaagctgtggagaaacgccctggaggcctgggccgtgcccgtggtgctgggccccagcagaagcaactacgagagattcctgccccccgacgccttcatccacgtggacgacttccagagccccaaggacctggccagatacctgcaggagctggacaaggaccacgccagatacctgagctacttccactggagagagaccctgagacccagaagcttcagctgggccctggccttctgcaaggcctgctggaagctgcagcaggagagcagataccagaccgtgagaagcatcgccgcctggttcacctag

SEQ ID NO: 82146 - DNA, 1125 bp, Artificial Sequence; identical to SEQ ID NO: 82145
  Description of Artificial Sequence: Synthetic coding sequence

SEQ ID NO: 82147 - DNA, 1080 bp, Artificial Sequence
  Description of Artificial Sequence: Synthetic coding sequence
atggaccccctgggccccgccaagccccagtggagctggagatgctgcctgaccaccctgctgttccagctgctgatggccgtgtgcttcttcagctacctgagagtgagccaggacgaccccaccgtgtaccccaacggcagcagattccccgacagcaccggcacccccgcccacagcatccccctgatcctgctgtggacctggcccttcaacaagcccatcgccctgcccagatgcagcgagatggtgcccggcaccgccgactgcaacatcaccgccgacagaaaggtgtacccccaggccgacgccgtgatcgtgcaccacagagaggtgatgtacaaccccagcgcccagctgcccagaagccccagaagacagggccagagatggatctggttcagcatggagagccccagccactgctggcagctgaaggccatggacggctacttcaacctgaccatgagctacagaagcgacagcgacatcttcaccccctacggctggctggagccctggagcggccagcccgcccacccccccctgaacctgagcgccaagaccgagctggtggcctgggccgtgagcaactggggccccaacagcgccagagtgagatactaccagagcctgcaggcccacctgaaggtggacgtgtacggcagaagccacaagcccctgccccagggcaccatgatggagaccctgagcagatacaagttctacctggccttcgagaacagcctgcaccccgactacatcaccgagaagctgtggagaaacgccctggaggcctgggccgtgcccgtggtgctgggccccagcagaagcaactacgagagattcctgccccccgacgccttcatccacgtggacgacttccagagccccaaggacctggccagatacctgcaggagctggacaaggaccacgccagatacctgagctacttcagatggagagagaccctgagacccagaagcttcagctgggccctggccttctgcaaggcctgctggaagctgcaggaggagagcagataccagaccagaggcatcgccgcctggttcacctag

SEQ ID NO: 82148 - DNA, 1080 bp, Artificial Sequence; identical to SEQ ID NO: 82147
  Description of Artificial Sequence: Synthetic coding sequence

SEQ ID NO: 82149 - DNA, 1098 bp, Artificial Sequence
  Description of Artificial Sequence: Synthetic coding sequence
atggaccccctgggccccgccaagccccagtggagctggagatgctgcctgaccaccctgctgttccagctgctgatggccgtgtgcttcttcagctacctgagagtgagccaggacgaccccaccgtgtaccccaacggcagcagattccccgacagcaccggcacccccgcccacagcatccccctgatcctgctgtggacctggcccttcaacaagcccatcgccctgcccagatgcagcgagatggtgcccggcaccgccgactgcaacatcaccgccgacagaaaggtgtacccccaggccgacgccgtgatcgtgcaccacagagaggtgatgtacaaccccagcgcccagctgcccagaagccccagaagacagggccagagatggatctggttcagcatggagagccccagccactgctggcagctgaaggccatggacggctacttcaacctgaccatgagctacagaagcgacagcgacatcttcaccccctacggctggctggagccctggagcggccagcccgcccacccccccctgaacctgagcgccaagaccgagctggtggcctgggccgtgagcaactggggccccaacagcgccagagtgagatactaccagagcctgcaggcccacctgaaggtggacgtgtacggcagaagccacaagcccctgccccagggcaccatgatggagaccctgagcagatacaagttctacctggccttcgagaacagcctgcaccccgactacatcaccgagaagctgtggagaaacgccctggaggcctgggccgtgcccgtggtgctgggccccagcagaagcaactacgagagattcctgccccccgacgccttcatccacgtggacgacttccagagccccaaggacctggccagatacctgcaggagctggacaaggaccacgccagatacctgagctacttcagatggagagagaccctgagacccagaagcttcagctgggccctggccttctgcaaggcctgctggaagctgcaggaggagagcagaagcggcggcctgatctacctgagaaccagactgcccgaggccagccccgcctag

SEQ ID NO: 82150 - DNA, 1080 bp, Artificial Sequence; identical to SEQ ID NO: 82147
  Description of Artificial Sequence: Synthetic coding sequence

SEQ ID NO: 82151 - DNA, 1080 bp, Artificial Sequence; identical to SEQ ID NO: 82147
  Description of Artificial Sequence: Synthetic coding sequence

SEQ ID NO: 82152 - DNA, 93 bp, Artificial Sequence
  Description of Artificial Sequence: Synthetic coding sequence
atggaccccctgggccccgccaagccccagtggagctggagatgctgcctgaccaccctgctgttccagctgctgatggccgtgtgcttctag

SEQ ID NO: 82153 - DNA, 414 bp, Artificial Sequence
  Description of Artificial Sequence: Synthetic coding sequence
atggaccccctgggccccgccaagccccagtggagctggagatgctgcctgaccaccctgctgttccagctgctgatggccgtgtgcttcttcagctacctgagagtgagccaggacgaccccaccgtgtaccccaacggcagcagattccccgacagcaccggcacccccgcccacagcatccccctgatcctgctgtggacctggcccttcaacaagcccatcgccctgcccagatgcagcgagatggtgcccggcaccgccgactgcaacatcaccgccgacagaaaggtgtacccccaggccgacgccgtgatcgtgcaccacagagaggtgatgtacaaccccagcgcccagctgcccagaagccccagaagacagggccagagatggatctggttcagcatggagtag

SEQ ID NO: 82154 - DNA, 210 bp, Artificial Sequence
  Description of Artificial Sequence: Synthetic coding sequence
atggaccccctgggccccgccaagccccagtggagctggagatgctgcctgaccaccctgctgttccagctgctgatggccgtgtgcttcttcagctacctgagagtgagccaggacgaccccaccgtgtaccccaacggcagcagattccccgacagcaccggcacccccgcccacagcatccccctgatcctgctgtggacctggtag

SEQ ID NO: 82155 - DNA, 201 bp, Artificial Sequence
  Description of Artificial Sequence: Synthetic coding sequence
atggaccccctgggccccgccaagccccagtggagctggagatgctgcctgaccaccctgctgttccagctgctgatggccgtgtgcttcttcagctacctgagagtgagccaggacgaccccaccgtgtaccccaacggcagcagattccccgacagcaccggcacccccgcccacagcatccccctgatcctgctgtag

SEQ ID NO: 82156 - DNA, 138 bp, Artificial Sequence
  Description of Artificial Sequence: Synthetic coding sequence
atggaccccctgggccccgccaagccccagtggagctggagatgctgcctgaccaccctgctgttccagctgctgatggccgtgtgcttcttcagctacctgagagtgagccaggacgaccccaccgtgtacccctag

SEQ ID NO: 82157 - DNA, 1029 bp, Artificial Sequence
  Description of Artificial Sequence: Synthetic coding sequence
atgaacaacgccggccacggccccaccagaagactgagaggcctgggcgtgctggccggcgtggccctgctggccgccctgtggctgctgtggctgctgggcagcgcccccagaggcacccccgccccccagcccaccatcaccatcctggtgtggcactggcccttcaccgaccagccccccgagctgcccagcgacacctgcaccagatacggcatcgccagatgccacctgagcgccaacagaagcctgctggccagcgccgacgccgtggtgttccaccacagagagctgcagaccagaagaagccacctgcccctggcccagagacccagaggccagccctgggtgtgggccagcatggagagccccagccacacccacggcctgagccacctgagaggcatcttcaactgggtgctgagctacagaagagacagcgacatcttcgtgccctacggcagactggagccccactggggccccagcccccccctgcccgccaagagcagagtggccgcctgggtggtgagcaacttccaggagagacagctgagagccagactgtacagacagctggccccccacctgagagtggacgtgttcggcagagccaacggcagacccctgtgcgccagctgcctggtgcccaccgtggcccagtacagattctacctgagcttcgagaacagccagcacagagactacatcaccgagaagttctggagaaacgccctggtggccggcaccgtgcccgtggtgctgggcccccccagagccacctacgaggccttcgtgcccgccgacgccttcgtgcacgtggacgacttcggcagcgccagagagctggccgccttcctgaccggcatgaacgagagcagataccagagattcttcgcctggagagacagactgagagtgagactgttcaccgactggagagagagattctgcgccatctgcgacagatacccccacctgcccagaagccaggtgtacgaggacctggagggctggttccaggcctag

SEQ ID NO: 82158 - DNA, 1728 bp, Artificial Sequence
  Description of Artificial Sequence: Synthetic coding sequence
atgagaccctggaccggcagctggagatggatcatgctgatcctgttcgcctggggcaccctgctgttctacatcggcggccacctggtgagagacaacgaccaccccgaccacagcagcagagagctgagcaagatcctggccaagctggagagactgaagcagcagaacgaggacctgagaagaatggccgagagcctgagaatccccgagggccccatcgaccagggccccgccatcggcagagtgagagtgctggaggagcagctggtgaaggccaaggagcagatcgagaactacaagaagcagaccagaaacggcctgggcaaggaccacgagatcctgagaagaagaatcgagaacggcgccaaggagctgtggttcttcctgcagagcgagctgaagaagctgaagaacctggagggcaacgagctgcagagacacgccgacgagttcctgctggacctgggccaccacgagagaagcatcatgaccgacctgtactacctgagccagaccgacggcgccggcgactggagagagaaggaggccaaggacctgaccgagctggtgcagagaagaatcacctacctgcagaaccccaaggactgcagcaaggccaagaagctggtgtgcaacatcaacaagggctgcggctacggctgccagctgcaccacgtggtgtactgcttcatgatcgcctacggcacccagagaaccctgatcctggagagccagaactggagatacgccaccggcggctgggagaccgtgttcagacccgtgagcgagacctgcaccgacagaagcggcatcagcaccggccactggagcggcgaggtgaaggacaagaacgtgcaggtggtggagctgcccatcgtggacagcctgcaccccagacccccctacctgcccctggccgtgcccgaggacctggccgacagactggtgagagtgcacggcgaccccgccgtgtggtgggtgagccagttcgtgaagtacctgatcagaccccagccctggctggagaaggagatcgaggaggccaccaagaagctgggcttcaagcaccccgtgatcggcgtgcacgtgagaagaaccgacaaggtgggcaccgaggccgccttccaccccatcgaggagtacatggtgcacgtggaggagcacttccagctgctggccagaagaatgcaggtggacaagaagagagtgtacctggccaccgacgaccccagcctgctgaaggaggccaagaccaagtaccccaactacgagttcatcagcgacaacagcatcagctggagcgccggcctgcacaacagatacaccgagaacagcctgagaggcgtgatcctggacatccacttcctgagccaggccgacttcctggtgtgcaccttcagcagccaggtgtgcagagtggcctacgagatcatgcagaccctgcaccccgacgccagcgccaacttccacagcctggacgacatctactacttcggcggccagaacgcccacaaccagatcgccatctacgcccaccagcccagaaccgccgacgagatccccatggagcccggcgacatcatcggcgtggccggcaaccactgggacggctacagcaagggcgtgaacagaaagctgggcagaaccggcctgtaccccagctacaaggtgagagagaagatcgagaccgtgaagtaccccacctaccccgaggccgagaagtag

SEQ ID NO: 82159 - DNA, 1728 bp, Artificial Sequence; identical to SEQ ID NO: 82158
  Description of Artificial Sequence: Synthetic coding sequence

SEQ ID NO: 82160 - DNA, 1728 bp, Artificial Sequence; identical to SEQ ID NO: 82158
  Description of Artificial Sequence: Synthetic coding sequence

SEQ ID NO: 82161 - DNA, 510 bp, Artificial Sequence
  Description of Artificial Sequence: Synthetic coding sequence
atgcacagacagatctggcacctgcactggaccctggtgagataccccaactacgagttcatcagcgacaacagcatcagctggagcgccggcctgcacaacagatacaccgagaacagcctgagaggcgtgatcctggacatccacttcctgagccaggccgacttcctggtgtgcaccttcagcagccaggtgtgcagagtggcctacgagatcatgcagaccctgcaccccgacgccagcgccaacttccacagcctggacgacatctactacttcggcggccagaacgcccacaaccagatcgccatctacgcccaccagcccagaaccgccgacgagatccccatggagcccggcgacatcatcggcgtggccggcaaccactgggacggctacagcaagggcgtgaacagaaagctgggcagaaccggcctgtaccccagctacaaggtgagagagaagatcgagaccgtgaagtaccccacctaccccgaggccgagaagtag

SEQ ID NO: 82162 - DNA, 48 bp, Artificial Sequence
  Description of Artificial Sequence: Synthetic coding sequence
atgagaccctggaccggcagctggagatggatcatgctgatcctgtag

SEQ ID NO: 82163 - DNA, 135 bp, Artificial Sequence
  Description of Artificial Sequence: Synthetic coding sequence
atgagaccctggaccggcagctggagatggatcatgctgatcctgttcgcctggggcaccctgctgttctacatcggcggccacctggtgagagacaacgaccaccccgaccacagcagcagagagctgagctag

SEQ ID NO: 82164 - DNA, 141 bp, Artificial Sequence
  Description of Artificial Sequence: Synthetic coding sequence
atgagaccctggaccggcagctggagatggatcatgctgatcctgttcgcctggggcaccctgctgttctacatcggcggccacctggtgagagacaacgaccaccccgaccacagcagcagagagctgagcaagatctag

SEQ ID NO: 82165 - DNA, 126 bp, Artificial Sequence
  Description of Artificial Sequence: Synthetic coding sequence
atgagaccctggaccggcagctggagatggatcatgctgatcctgttcgcctggggcaccctgctgttctacatcggcggccacctggtgagagacaacgaccaccccgaccacagcagcagatag

SEQ ID NO: 82166 - DNA, 93 bp, Artificial Sequence
  Description of Artificial Sequence: Synthetic coding sequence
atgagaccctggaccggcagctggagatggatcatgctgatcctgttcgcctggggcaccctgctgttctacatcggcggccacctggtgtag

SEQ ID NO: 82167 - DNA, 1239 bp, Artificial Sequence
  Description of Artificial Sequence: Synthetic coding sequence
atgaccgacctgtactacctgagccagaccgacggcgccggcgactggagagagaaggaggccaaggacctgaccgagctggtgcagagaagaatcacctacctgcagaaccccaaggactgcagcaaggccaagaagctggtgtgcaacatcaacaagggctgcggctacggctgccagctgcaccacgtggtgtactgcttcatgatcgcctacggcacccagagaaccctgatcctggagagccagaactggagatacgccaccggcggctgggagaccgtgttcagacccgtgagcgagacctgcaccgacagaagcggcatcagcaccggccactggagcggcgaggtgaaggacaagaacgtgcaggtggtggagctgcccatcgtggacagcctgcaccccagacccccctacctgcccctggccgtgcccgaggacctggccgacagactggtgagagtgcacggcgaccccgccgtgtggtgggtgagccagttcgtgaagtacctgatcagaccccagccctggctggagaaggagatcgaggaggccaccaagaagctgggcttcaagcaccccgtgatcggcgtgcacgtgagaagaaccgacaaggtgggcaccgaggccgccttccaccccatcgaggagtacatggtgcacgtggaggagcacttccagctgctggccagaagaatgcaggtggacaagaagagagtgtacctggccaccgacgaccccagcctgctgaaggaggccaagaccaagtaccccaactacgagttcatcagcgacaacagcatcagctggagcgccggcctgcacaacagatacaccgagaacagcctgagaggcgtgatcctggacatccacttcctgagccaggccgacttcctggtgtgcaccttcagcagccaggtgtgcagagtggcctacgagatcatgcagaccctgcaccccgacgccagcgccaacttccacagcctggacgacatctactacttcggcggccagaacgcccacaaccagatcgccatctacgcccaccagcccagaaccgccgacgagatccccatggagcccggcgacatcatcggcgtggccggcaaccactgggacggctacagcaagggcgtgaacagaaagctgggcagaaccggcctgtaccccagctacaaggtgagagagaagatcgagaccgtgaagtaccccacctaccccgaggccgagaagtag

SEQ ID NO: 82168 - DNA, 153 bp, Artificial Sequence
  Description of Artificial Sequence: Synthetic coding sequence
atgagaccctggaccggcagctggagatggatcatgctgatcctgttcgcctggggcaccctgctgttctacatcggcggccacctggtgagagacaacgaccaccccgaccacagcagcagagagctgagcaagatcctggccaagctgtag

SEQ ID NO: 82169 - DNA, 1080 bp, Artificial Sequence
  Description of Artificial Sequence: Synthetic coding sequence
atgaccagcaccagcaagggcatcctgagacccttcctgatcgtgtgcatcatcctgggctgcttcatggcctgcctgctgatctacatcaagcccaccaacagctggatcttcagccccatggagagcgccagcagcgtgctgaagatgaagaacttcttcagcaccaagaccgactacttcaacgagaccaccatcctggtgtgggtgtggcccttcggccagaccttcgacctgaccagctgccaggccatgttcaacatccagggctgccacctgaccaccgacagaagcctgtacaacaagagccacgccgtgctgatccaccacagagacatcagctgggacctgaccaacctgccccagcaggccagaccccccttccagaagtggatctggatgaacctggagagccccacccacaccccccagaagagcggcatcgagcacctgttcaacctgaccctgacctacagaagagacagcgacatccaggtgccctacggcttcctgaccgtgagcaccaaccccttcgtgttcgaggtgcccagcaaggagaagctggtgtgctgggtggtgagcaactggaaccccgagcacgccagagtgaagtactacaacgagctgagcaagagcatcgagatccacacctacggccaggccttcggcgagtacgtgaacgacaagaacctgatccccaccatcagcacctgcaagttctacctgagcttcgagaacagcatccacaaggactacatcaccgagaagctgtacaacgccttcctggccggcagcgtgcccgtggtgctgggccccagcagagagaactacgagaactacatccccgccgacagcttcatccacgtggaggactacaacagccccagcgagctggccaagtacctgaaggaggtggacaagaacaacaagctgtacctgagctacttcaactggagaaaggacttcaccgtgaacctgcccagattctgggagagccacgcctgcctggcctgcgaccacgtgaagagacaccaggagtacaagagcgtgggcaacctggagaagtggttctggaactag

SEQ ID NO: 82170 - DNA, 660 bp, Artificial Sequence
  Description of Artificial Sequence: Synthetic coding sequence
atgaacagactgttcggcaaggccaagcccaaggcccccccccccagcctgaccgactgcatcggcaccgtggacagcagagccgagagcatcgacaagaagatcagcagactggacgccgagctggtgaagtacaaggaccagatcaagaagatgagagagggccccgccaagaacatggtgaagcagaaggccctgagagtgctgaagcagaagagaatgtacgagcagcagagagacaacctggcccagcagagcttcaacatggagcaggccaactacaccatccagagcctgaaggacaccaagaccaccgtggacgccatgaagctgggcgtgaaggagatgaagaaggcctacaagcaggtgaagatcgaccagatcgaggacctgcaggaccagctggaggacatgatggaggacgccaacgagatccaggaggccctgagcagaagctacggcacccccgagctggacgaggacgacctggaggccgagctggacgccctgggcgacgagctgctggccgacgaggacagcagctacctggacgaggccgccagcgcccccgccatccccgagggcgtgcccaccgacaccaagaacaaggacggcgtgctggtggacgagttcggcctgccccagatccccgccagctag

SEQ ID NO: 82171 - DNA, 1293 bp, Artificial Sequence
  Description of Artificial Sequence: Synthetic coding sequence
atgagcagaatcaacaagaacgtggtgctggccctgctgaccctgaccagcagcgccttcctgctgttccagctgtactactacaagcactacctgagcaccaagaacggcgccggcctgagcaagagcaagggcagcagaatcggcttcgacagcacccagtggagagccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgcccagagacttcaccgccttcgccctgcagtaccacctgtggaagaacgaggagggctggttcagaatcgccgagaacatgggcttccagtgcctgaagatcgagagcaaggaccccagactggacggcatcgacagcctgagcggcaccgagatccccctgcactacatctgcaagctggccacccacgccatccacctggtggtgttccacgagagaagcggcaactacctgtggcacggccacctgagactgaaggagcacatcgacagaaagttcgtgcccttcagaaagctgcagttcggcagataccccggcgccttcgacagacccgagctgcagcaggtgaccgtggacggcctggaggtgctgatccccaaggaccccatgcacttcgtggaggaggtgccccacagcagattcatcgagtgcagatacaaggaggccagagccttcttccagcagtacctggacgacaacaccgtggaggccgtggccttcagaaagagcgccaaggagctgctgcagctggccgccaagaccctgaacaagctgggcgtgcccttctggctgagcagcggcacctgcctgggctggtacagacagtgcaacatcatcccctacagcaaggacgtggacctgggcatcttcatccaggactacaagagcgacatcatcctggccttccaggacgccggcctgcccctgaagcacaagttcggcaaggtggaggacagcctggagctgagcttccagggcaaggacgacgtgaagctggacgtgttcttcttctacgaggagaccgaccacatgtggaacggcggcacccaggccaagaccggcaagaagttcaagtacctgttccccaagttcaccctgtgctggaccgagttcgtggacatgaaggtgcacgtgccctgcgagaccctggagtacatcgaggccaactacggcaagaaccagcagggcgcctag

SEQ ID NO: 82172 - DNA, 708 bp, Artificial Sequence
  Description of Artificial Sequence: Synthetic coding sequence
atgatcctggaggtgggcgagaacaacggcttcttcagcaagagcctgctgcccagatacgccagcaagaagctgaagagcagcctgccccacagcagagccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgcccagagacttcaccgccttcgccctgcagtaccacctgtggaagaacgaggagggctggttcagaatcgccgagaacatgggcttccagtgcctgaagatcgagagcaaggaccccagactggacggcatcgacagcctgagcggcaccgagatccccctgcactacatctgcaagctggccacccacgccatccacctggtggtgttccacgagagaagcggcaactacctgtggcacggccacctgagactgaaggagcacatcgacagaaagttcgtgcccttcagaaagctgcagttcggcagataccccggcgccttcgacagacccgagctgcagcaggtgaccgtggacggcctggaggtgctgatccccaaggaccccatgcacttcgtggaggaggtgccccacagcagattcatcgagtgcagatacaaggaggccagagccttctag

SEQ ID NO: 82173 - DNA, 552 bp, Artificial Sequence
  Description of Artificial Sequence: Synthetic coding sequence
atgagcagaatcaacaagaacgtggtgctggccctgctgaccctgaccagcagcgccttcctgctgttccagctgtactactacaagcactacctgagcaccaagaacggcgccggcctgagcaagagcaagggcagcagaatcggcttcgacagcacccagtggagagccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgcccagagacttcaccgccttcgccctgcagtaccacctgtggaagaacgaggagggctggttcagaatcgccgagaacatgggcttccagtgcctgaagatcgagagcaaggaccccagactggacggcatcgacagcctgagcggcaccgagatccccctgcactacatctgcaagctggccacccacgccatccacctggtggtgttccacgagagaagcggcaactactag

SEQ ID NO: 82174 - DNA, 483 bp, Artificial Sequence
  Description of Artificial Sequence: Synthetic coding sequence
tgatggtacagacagtgcaacatcatcccctacagcaaggacgtggacctgggcatcttcatccaggactacaagagcgacatcatcctggccttccaggacgccggcctgcccctgaagcacaagttcggcaaggtggaggacagcctggagctgagcttccagggcaaggacgacgtgaagctggacgtgttcttcttctacgaggagaccgaccacatgtggaacggcggcacccaggccaagaccggcaagaagttcaagtacctgttccccaagttcaccctgtgctggaccgagttcgtggacatgaaggtgcacgtgccctgcgagaccctggagtacatcgaggccaactacggcaaggaggccgagagctacatcctgagcatgctgttcagaaccaccttctggagcctggccgacttccccctgacccccgagaacaacagcagcctgaagaacggcaacctgaacgtgtag

SEQ ID NO: 82175 - DNA, 816 bp, Artificial Sequence
  Description of Artificial Sequence: Synthetic coding sequence
atgagcagaatcaacaagaacgtggtgctggccctgctgaccctgaccagcagcgccttcctgctgttccagctgtactactacaagcactacctgagcaccaagaacggcgccggcctgagcaagagcaagggcagcagaatcggcttcgacagcacccagtggagagccgtgaagaagttcatcatgctgaccagcaaccagaacgtgcccgtgttcctgatcgaccccctgatcctggagctgatcaacaagaacttcgagcaggtgaagaacaccagccacggcagcaccagccagtgcaagttcttctgcgtgcccagagacttcaccgccttcgccctgcagtaccacctgtggaagaacgaggagggctggttcagaatcgccgagaacatgggcttccagtgcctgaagatcgagagcaaggaccccagactggacggcatcgacagcctgagcggcaccgagatccccctgcactacatctgcaagctggccacccacgccatccacctggtggtgttccacgagagaagcggcaactacctgtggcacggccacctgagactgaaggagcacatcgacagaaagttcgtgcccttcagaaagctgcagttcggcagataccccggcgccttcgacagacccgagctgcagcaggtgaccgtggacggcctggaggtgctgatccccaaggaccccatgcacttcgtggaggaggtgccccacagcagattcatcgagtgcagatacaaggaggccagagccttcttccagatccccgtgagcgaggtgtacaccgtgctggactag

SEQ ID NO: 82176 - DNA, 1488 bp, Artificial Sequence
  Description of Artificial Sequence: Synthetic coding sequence
atgagactgaccagatgccaggccgccctggccgccgccatcaccctgaacctgctggtgctgttctacgtgagctggctgcagcaccagcccagaaacagcagagccagaggccccagaagagccagcgccgccggccccagagtgaccgtgctggtgagagagttcgaggccttcgacaacgccgtgcccgagctggtggacagcttcctgcagcaggaccccgcccagcccgtggtggtggccgccgacaccctgccctacccccccctggccctgcccagaatccccaacgtgagactggccctgctgcagcccgccctggacagacccgccgccgccagcagacccgagacctacgtggccaccgagttcgtggccctggtgcccgacggcgccagagccgaggcccccggcctgctggagagaatggtggaggccctgagagccggcagcgccagactggtggccgcccccgtggccaccgccaaccccgccagatgcctggccctgaacgtgagcctgagagagtggaccgccagatacggcgccgcccccgccgcccccagatgcgacgccctggacggcgacgccgtggtgctgctgagagccagagacctgttcaacctgagcgcccccctggccagacccgtgggcaccagcctgttcctgcagaccgccctgagaggctgggccgtgcagctgctggacctgaccttcgccgccgccagacagccccccctggccaccgcccacgccagatggaaggccgagagagagggcagagccagaagagccgccctgctgagagccctgggcatcagactggtgagctgggagggcggcagactggagtggttcggctgcaacaaggagaccaccagatgcttcggcaccgtggtgggcgacacccccgcctacctgtacgaggagagatggacccccccctgctgcctgagagccctgagagagaccgccagatacgtggtgggcgtgctggaggccgccggcgtgagatactggctggagggcggcagcctgctgggcgccgccagacacggcgacatcatcccctgggactacgacgtggacctgggcatctacctggaggacgtgggcaactgcgagcagctgagaggcgccgaggccggcagcgtggtggacgagagaggcttcgtgtgggagaaggccgtggagggcgacttcttcagagtgcagtacagcgagagcaaccacctgcacgtggacctgtggcccttctaccccagaaacggcgtgatgaccaaggacacctggctggaccacagacaggacgtggagttccccgagcacttcctgcagcccctggtgcccctgcccttcgccggcttcgtggcccaggcccccaacaactacagaagattcctggagctgaagttcggccccggcgtgatcgagaacccccagtaccccaaccccgccctgctgagcctgaccggcagcggctag

SEQ ID NO: 82177 - DNA, 1488 bp, Artificial Sequence; identical to SEQ ID NO: 82176
  Description of Artificial Sequence: Synthetic coding sequence

SEQ ID NO: 82178 - DNA, 2385 bp, Artificial Sequence
  Description of Artificial Sequence: Synthetic coding sequence
atggagctgagaccctggctgctgtgggtggtggccgccaccggcaccctggtgctgctggccgccgacgcccagggccagaaggtgttcaccaacacctgggccgtgagaatccccggcggccccgccgtggccaacagcgtggccagaaagcacggcttcctgaacctgggccagatcttcggcgactactaccacttctggcacagaggcgtgaccaagagaagcctgagcccccacagacccagacacagcagactgcagagagagccccaggtgcagtggctggagcagcaggtggccaagagaagaaccaagagagacgtgtaccaggagcccaccgaccccaagttcccccagcagtggtacctgagcggcgtgacccagagagacctgaacgtgaaggccgcctgggcccagggctacaccggccacggcatcgtggtgagcatcctggacgacggcatcgagaagaaccaccccgacctggccggcaactacgaccccggcgccagcttcgacgtgaacgaccaggaccccgacccccagcccagatacacccagatgaacgacaacagacacggcaccagatgcgccggcgaggtggccgccgtggccaacaacggcgtgtgcggcgtgggcgtggcctacaacgccagaatcggcggcgtgagaatgctggacggcgaggtgaccgacgccgtggaggccagaagcctgggcctgaaccccaaccacatccacatctacagcgccagctggggccccgaggacgacggcaagaccgtggacggccccgccagactggccgaggaggccttcttcagaggcgtgagccagggcagaggcggcctgggcagcatcttcgtgtgggccagcggcaacggcggcagagagcacgacagctgcaactgcgacggctacaccaacagcatctacaccctgagcatcagcagcgccacccagttcggcaacgtgccctggtacagcgaggcctgcagcagcaccctggccaccacctacagcagcggcaaccagaacgagaagcagatcgtgaccaccgacctgagacagaagtgcaccgagagccacaccggcaccagcgccagcgcccccctggccgccggcatcatcgccctgaccctggaggccaacaagaacctgacctggagagacatgcagcacctggtggtgcagaccagcaagcccgcccacctgaacgccaacgactgggccaccaacggcgtgggcagaaaggtgagccacagctacggctacggcctgctggacgccggcgccatggtggccctggcccagaactggaccaccgtggccccccagagaaagtgcatcatcgacatcctgaccgagcccaaggacatcggcaagagactggaggtgagaaagaccgtgaccgcctgcctgggcgagcccaaccacatcaccagactggagcacgcccaggccagactgaccctgagctacaacagaagaggcgacctggccatccacctggtgagccccatgggcaccagaagcaccctgctggccgccagaccccacgactacagcgccgacggcttcaacgactgggccttcatgaccacccacagctgggacgaggaccccagcggcgagtgggtgctggagatcgagaacaccagcgaggccaacaactacggcaccctgaccaagttcaccctggtgctgtacggcaccgcccccgagggcctgcccgtgccccccgagagcagcggctgcaagaccctgaccagcagccaggcctgcgtggtgtgcgaggagggcttcagcctgcaccagaagagctgcgtgcagcactgcccccccggcttcgccccccaggtgctggacacccactacagcaccgagaacgacgtggagaccatcagagccagcgtgtgcgccccctgccacgccagctgcgccacctgccagggccccgccctgaccgactgcctgagctgccccagccacgccagcctggaccccgtggagcagacctgcagcagacagagccagagcagcagagagagccccccccagcagcagccccccagactgccccccgaggtggaggccggccagagactgagagccggcctgctgcccagccacctgcccgaggtggtggccggcctgagctgcgccttcatcgtgctggtgttcgtgaccgtgttcctggtgctgcagctgagaagcggcttcagcttcagaggcgtgaaggtgtacaccatggacagaggcctgatcagctacaagggcctgccccccgaggcctggcaggaggagtgccccagcgacagcgaggaggacgagggcagaggcgagagaaccgccttcatcaaggaccagagcgccctgtag

SEQ ID NO: 82179 - DNA, 210 bp, Artificial Sequence
  Description of Artificial Sequence: Synthetic coding sequence
aagcccgcccacctgaacgccaacgactgggccaccaacggcgtgggcagaaaggtgagccacagctacggctacggcctgtggacccaggccccctggtggccctggcccagaatcggcccccagtggccccccagcggcagcgccagcagcaccagcagccccagccccaagaccagcggcaacggcagcagatgcggcagaccctag

SEQ ID NO: 82180 - DNA, 210 bp, Artificial Sequence
  Description of Artificial Sequence: Synthetic coding sequence
atggagctgagaccctggctgctgtgggtggtggccgccaccggcaccctggtgctgctggccgccgacgcccagggccagaaggtgttcaccaacacctgggccgtgagaatccccggcggccccgccgtggccaacagcgtggccagaaagcacggcttcctgaacctgggccagatcttcggcgactactaccacttctggcactag

SEQ ID NO: 82181 - DNA, 1581 bp, Artificial Sequence
  Description of Artificial Sequence: Synthetic coding sequence
atggccagcaacgactacacccagcaggccacccagagctacggcgcctaccccacccagcccggccagggctacagccagcagagcagccagccctacggccagcagagctacagcggctacagccagagcaccgacaccagcggctacggccagagcagctacagcagctacggccagagccagaacaccggctacggcacccagagcaccccccagggctacggcagcaccggcggctacggcagcagccagagcagccagagcagctacggccagcagagcagctaccccggctacggccagcagcccgcccccagcagcaccagcggcagctacggcagcagcagccagagcagcagctacggccagccccagagcggcagctacagccagcagcccagctacggcggccagcagcagagctacggccagcagcagagctacaaccccccccagggctacggccagcagaaccagtacaacagcagcagcggcggcggcggcggcggcggcggcggcggcaactacggccaggaccagagcagcatgagcagcggcggcggcagcggcggcggctacggcaaccaggaccagagcggcggcggcggcagcggcggctacggccagcaggacagaggcggcagaggcagaggcggcagcggcggcggcggcggcggcggcggcggcggctacaacagaagcagcggcggctacgagcccagaggcagaggcggcggcagaggcggcagaggcggcatgggcggcagcgacagaggcggcttcaacaagttcggcggccccagagaccagggcagcagacacgacagcgagcaggacaacagcgacaacaacaccatcttcgtgcagggcctgggcgagaacgtgaccatcgagagcgtggccgactacttcaagcagatcggcatcatcaagaccaacaagaagaccggccagcccatgatcaacctgtacaccgacagagagaccggcaagctgaagggcgaggccaccgtgagcttcgacgacccccccagcgccaaggccgccatcgactggttcgacggcaaggagttcagcggcaaccccatcaaggtgagcttcgccaccagaagagccgacttcaacagaggcggcggcaacggcagaggcggcagaggcagaggcggccccatgggcagaggcggctacggcggcggcggcagcggcggcggcggcagaggcggcttccccagcggcggcggcggcggcggcggccagcagagagccggcgactggaagtgccccaaccccacctgcgagaacatgaacttcagctggagaaacgagtgcaaccagtgcaaggcccccaagcccgacggccccggcggcggccccggcggcagccacatgggcggcaactacggcgacgacagaagaggcggcagaggcggctacgacagaggcggctacagaggcagaggcggcgacagaggcggcttcagaggcggcagaggcggcggcgacagaggcggcttcggccccggcaagatggacagcagaggcgagcacagacaggacagaagagagagaccctactag

SEQ ID NO: 82182 - DNA, 456 bp, Artificial Sequence
  Description of Artificial Sequence: Synthetic coding sequence
atgaaccccgaggtggtggaggtggccgtggaggccgaggtggcctgggccgaggtgaccgtggtggccagcatcaacctggtggccctgggcaccaaggaccacgtgatgacccccaccaacaagaagaccggccagcccatgatcaacctgtacaccgacagagagaccggcaagctgaagggcgaggccaccgtgagcttcgacgacccccccagcgccaaggccgccatcgactggttcgacggcaaggagttcagcggcaaccccatcaaggtgagcttcgccaccagaagagccgacttcaacagaggcggcggcaacggcagaggcggcagaggcagaggcggccccatgggcagaggcggctacggcggcggcggcagcggcggcggcggcagaggcggcttccccagcggcggcggcggcggcggcggccagcagagagccggctag

SEQ ID NO: 82183 - DNA, 1290 bp, Artificial Sequence
  Description of Artificial Sequence: Synthetic coding sequence
atggccagcaacgactacacccagcaggccacccagagctacggcgcctaccccacccagcccggccagggctacagccagcagagcagccagccctacggccagcagagctacagcggctacagccagagcaccgacaccagcggctacggccagagcagctacagcagctacggccagagccagaacaccggctacggcacccagagcaccccccagggctacggcagcaccggcggctacggcagcagccagagcagccagagcagctacggccagcagagcagctaccccggctacggccagcagcccgcccccagcagcaccagcggcagctacggcagcagcagccagagcagcagctacggccagccccagagcggcagctacagccagcagcccagctacggcggccagcagcagagctacggccagcagcagagctacaaccccccccagggctacggccagcagaaccagtacaacagcagcagcggcggctacgagcccagaggcagaggcggcggcagaggcggcagaggcggcatgggcggcagcgacagaggcggcttcaacaagttcggcggccccagagaccagggcagcagacacgacagcgagcaggacaacagcgacaacaacaccatcttcgtgcagggcctgggcgagaacgtgaccatcgagagcgtggccgactacttcaagcagatcggcatcatcaagaccaacaagaagaccggccagcccatgatcaacctgtacaccgacagagagaccggcaagctgaagggcgaggccaccgtgagcttcgacgacccccccagcgccaaggccgccatcgactggttcgacggcaaggagttcagcggcaaccccatcaaggtgagcttcgccaccagaagagccgacttcaacagaggcggcggcaacggcagaggcggcagaggcagaggcggccccatgggcagaggcggctacggcggcggcggcagcggcggcggcggcagaggcggcttccccagcggcggcggcggcggcggcggccagcagagagccggcgactggaagtgccccaaccccacctgcgagaacatgaacttcagctggagaaacgagtgcaaccagtgcaaggcccccaagcccgacggccccggcggcggccccggcggcagccacatgggcggcaactacggcgacgacagaagaggcggcgacagaggcggcttcggccccggcaagatggacagcagaggcgagcacagacaggacagaagagagagaccctactag

SEQ ID NO: 82184 - DNA, 1257 bp, Artificial Sequence
  Description of Artificial Sequence: Synthetic coding sequence
atgggcgaggagggcaccggcggcaccgtgcacctgctgtgcctggccgccagcagcggcgtgcccctgttctgcagaagcagcagaggcggcgcccccgccagacagcagctgcccttcagcgtgatcggcagcctgaacggcgtgcacatgttcggccagaacctggaggtgcagctgagcagcgccagaaccgagaacaccaccgtggtgtggaagagcttccacgacagcatcaccctgatcgtgctgagcagcgaggtgggcatcagcgagctgagactggagagactgctgcagatggtgttcggcgccatggtgctgctggtgggcctggaggagctgaccaacatcagaaacgtggagagactgaagaaggacctgagagccagctactgcctgatcgacagcttcctgggcgacagcgagctgatcggcgacctgacccagtgcgtggactgcgtgatcccccccgagggcagcctgctgcaggaggccctgagcggcttcgccgaggccgccggcaccaccttcgtgagcctggtggtgagcggcagagtggtggccgccaccgagggctggtggagactgggcacccccgaggccgtgctgctgccctggctggtgggcagcctgcccccccagaccgccagagactaccccgtgtacctgccccacggcagccccaccgtgccccacagactgctgaccctgaccctgctgcccagcctggagctgtgcctgctgtgcggccccagcccccccctgagccagctgtacccccagctgctggagagatggtggcagcccctgctggaccccctgagagcctgcctgcccctgggccccagagccctgcccagcggcttccccctgcacaccgacatcctgggcctgctgctgctgcacctggagctgaagagatgcctgttcaccgtggagcccctgggcgacaaggagcccagccccgagcagagaagaagactgctgagaaacttctacaccctggtgaccagcacccacttcccccccgagcccggcccccccgagaagaccgaggacgaggtgtaccaggcccagctgcccagagcctgctacctggtgctgggcaccgaggagcccggcaccggcgtgagactggtggccctgcagctgggcctgagaagactgctgctgctgctgagcccccagagccccacccacggcctgagaagcctggccacccacaccctgcacgccctgacccccctgctgtag

SEQ ID NO: 82185 - DNA, 711 bp, Artificial Sequence
  Description of Artificial Sequence: Synthetic coding sequence
atgggcgaggagggcaccggcggcaccgtgcacctgctgtgcctggccgccagcagcggcgtgcccctgttctgcagaagcagcagaggcggcgcccccgccagacagcagctgcccttcagcgtgatcggcagcctgaacggcgtgcacatgttcggccagaacctggaggtgcagctgagcagcgccagaaccgagaacaccaccgtggtgtggaagagcttccacgacagcatcaccctgatcgtgctgagcagcgaggtgggcatcagcgagctgagactggagagactgctgcagatggtgttcggcgccatggtgctgctggtgggcctggaggagctgaccaacatcagaaacgtggagagactgaagaaggacctgagagccagctactgcctgatcgacagcttcctgggcgacagcgagctgatcggcgacctgacccagtgcgtggactgcgtgatcccccccgagggcagcctgctgcaggtgctgggcatgctgtggaagctgctgcacctgttctgctggccctggctgagcccccaccccctgagcagcggccccctgagccagcccccccccatcctgagcgccagcagccccatccccacctggagccagaagaacctgttcagcttcttcttcagcttcctgagcctgagcttcctgttcagcttcctgagcctgttcctgttcgagacctag

SEQ ID NO: 82186 - DNA, 1164 bp, Artificial Sequence
  Description of Artificial Sequence: Synthetic coding sequence
atgggcgaggagggcaccggcggcaccgtgcacctgctgtgcctggccgccagcagcggcgtgcccctgttctgcagaagcagcagaggcggcgcccccgccagacagcagctgcccttcagcgtgatcggcagcctgaacggcgtgcacatgttcggccagaacctggaggtgcagctgagcagcgccagaaccgagaacaccaccgtggtgtggaagagcttccacgacagcatcaccctgatcgtgctgagcagcgaggtgggcatcagcgagctgagactggagagactgctgcagatggtgttcggcgccatggtgctgctggtgggcctggaggagctgaccaacatcagaaacgtggagagactgaagaaggacctgagagccagctactgcctgatcgacagcttcctgggcgacagcgagctgatcggcgacctgacccagtgcgtggactgcgtgatcccccccgagggcagcctgctgcaggaggccctgagcggcttcgccgaggccgccggcaccaccttcgtgagcctggtggtgagcggcagagtggtggccgccaccgagggctggtggagactgggcacccccgaggccgtgctgctgccctggctggtgggcagcctgcccccccagaccgccagagactaccccgtgtacctgccccacggcagccccaccgtgccccacagactgctgaccctgaccctgctgcccagcctggagctgtgcctgctgtgcggccccagcccccccctgagccagctgtacccccagctgctggagagatggtggcagcccctgctggaccccctgagagcctgcctgcccctgggccccagagccctgcccagcggcttccccctgcacaccgacatcctgggcctgctgctgctgcacctggagctgaagagatgcctgttcaccgtggagcccctgggcgacaaggagcccagccccgagcagagaagaagactgctgagaaacttctacaccctggtgaccagcacccacttcccccccgagcccggcccccccgagaagaccgaggacgaggtgtaccaggcccagctgcccagagcctgctacctggtgatgggcgacggccacagacacggcgccgtgagcgtgagcctgttcatcagaagccagtag

SEQ ID NO: 82187 - DNA, 1149 bp, Artificial Sequence
  Description of Artificial Sequence: Synthetic coding sequence
atgggcgaggagggcaccggcggcaccgtgcacctgctgtgcctggccgccagcagcggcgtgcccctgttctgcagaagcagcagaggcggcgcccccgccagacagcagctgcccttcagcgtgatcggcagcctgaacggcgtgcacatgttcggccagaacctggaggtgcagctgagcagcgccagaaccgagaacaccaccgtggtgctgctggtgggcctggaggagctgaccaacatcagaaacgtggagagactgaagaaggacctgagagccagctactgcctgatcgacagcttcctgggcgacagcgagctgatcggcgacctgacccagtgcgtggactgcgtgatcccccccgagggcagcctgctgcaggaggccctgagcggcttcgccgaggccgccggcaccaccttcgtgagcctggtggtgagcggcagagtggtggccgccaccgagggctggtggagactgggcacccccgaggccgtgctgctgccctggctggtgggcagcctgcccccccagaccgccagagactaccccgtgtacctgccccacggcagccccaccgtgccccacagactgctgaccctgaccctgctgcccagcctggagctgtgcctgctgtgcggccccagcccccccctgagccagctgtacccccagctgctggagagatggtggcagcccctgctggaccccctgagagcctgcctgcccctgggccccagagccctgcccagcggcttccccctgcacaccgacatcctgggcctgctgctgctgcacctggagctgaagagatgcctgttcaccgtggagcccctgggcgacaaggagcccagccccgagcagagaagaagactgctgagaaacttctacaccctggtgaccagcacccacttcccccccgagcccggcccccccgagaagaccgaggacgaggtgtaccaggcccagctgcccagagcctgctacctggtgctgggcaccgaggagcccggcaccggcgtgagactggtggccctgcagctgggcctgagaagactgctgctgctgctgagcccccagagccccacccacggcctgagaagcctggccacccacaccctgcacgccctgacccccctgctgtag

SEQ ID NO: 82188 - DNA, 279 bp, Artificial Sequence
  Description of Artificial Sequence: Synthetic coding sequence
atggccagcctgggccacatcctggtgttctgcgtgggcctgctgaccatggccaaggccgagagccccaaggagcacgaccccttcacctacgactaccagagcctgcagatcggcggcctggtgatcgccggcatcctgttcatcctgggcatcctgatcgtgctgagcagaagatgcagatgcaagttcaaccagcagcagagaaccggcgagcccgacgaggaggagggcaccttcagaagcagcatcagaagactgagcaccagaagaagatag

SEQ ID NO: 82189 - DNA, 279 bp, Artificial Sequence; identical to SEQ ID NO: 82188
  Description of Artificial Sequence: Synthetic coding sequence

SEQ ID NO: 82190 - DNA, 195 bp, Artificial Sequence
  Description of Artificial Sequence: Synthetic coding sequence
atggacagatggtacctgggcggcagccccaagggcgacgtggaccccttctactacgactacgagaccgtgagaaacggcggcctgatcttcgccggcctggccttcatcgtgggcctgctgatcctgctgagcagaagattcagatgcggcggcaacaagaagagaagacagatcaacgaggacgagccctag

SEQ ID NO: 82191 - DNA, 201 bp, Artificial Sequence
  Description of Artificial Sequence: Synthetic coding sequence
atgaccggcctgagcatggacggcggcggcagccccaagggcgacgtggaccccttctactacgactacgagaccgtgagaaacggcggcctgatcttcgccggcctggccttcatcgtgggcctgctgatcctgctgagcagaagattcagatgcggcggcaacaagaagagaagacagatcaacgaggacgagccctag

SEQ ID NO: 82192 - DNA, 195 bp, Artificial Sequence; identical to SEQ ID NO: 82190
  Description of Artificial Sequence: Synthetic coding sequence

SEQ ID NO: 82193 - DNA, 264 bp, Artificial Sequence
  Description of Artificial Sequence: Synthetic coding sequence
atgcagaaggtgaccctgggcctgctggtgttcctggccggcttccccgtgctggacgccaacgacctggaggacaagaacagccccttctactacgactggcacagcctgcaggtgggcggcctgatctgcgccggcgtgctgtgcgccatgggcatcatcatcgtgatgagcgccaagtgcaagtgcaagttcggccagaagagcggccaccaccccggcgagaccccccccctgatcacccccggcagcgcccagagctag

SEQ ID NO: 82194 - DNA, 342 bp, Artificial Sequence
  Description of Artificial Sequence: Synthetic coding sequence
atgcagaaggtgaccctgggcctgctggtgttcctggccggcttccccgtgctggacgccaacgacctggaggacaagaacagccccttctactacgactggcacagcctgcaggtgggcggcctgatctgcgccggcgtgctgtgcgccatgggcatcatcatcgtgatgagcgagtggagaagcagcggcgagcaggccggcagaggctggggcagcccccccctgaccacccagctgagccccaccggcgccaagtgcaagtgcaagttcggccagaagagcggccaccaccccggcgagaccccccccctgatcacccccggcagcgcccagagctag

SEQ ID NO: 82195 - DNA, 291 bp, Artificial Sequence
  Description of Artificial Sequence: Synthetic coding sequence
atgcagaaggtgaccctgggcctgctggtgttcctggccggcttccccgtgctggacgccaacgacctggaggacaagaacagccccttctactacgactggcacagcctgcaggtgggcggcctgatctgcgccggcgtgctgtgcgccatgggcatcatcatcgtgatgagcgagtggagaagcagcggcgagcaggccggcagaggctggggcagcccccccctgaccacccagctgagccccaccggcgccaagtgcaagtgcaagttcggccagaagagcggctag

SEQ ID NO: 82196 - DNA, 264 bp, Artificial Sequence; identical to SEQ ID NO: 82193
  Description of Artificial Sequence: Synthetic coding sequence

SEQ ID NO: 82197 - DNA, 435 bp, Artificial Sequence
  Description of Artificial Sequence: Synthetic coding sequence
atgggcagaggctacagcggcgccctgcaggccagaggcggcctggaggagcccctggagagaggcctgagaggccccagcttcacccagagccccctgcacggcgccgccgccgcctacctgagcgcccagagagacgccagcctgcccgtgcccggccagagaagcgacatgcagaaggtgaccctgggcctgctggtgttcctggccggcttccccgtgctggacgccaacgacctggaggacaagaacagccccttctactacgactggcacagcctgcaggtgggcggcctgatctgcgccggcgtgctgtgcgccatgggcatcatcatcgtgatgagcgccaagtgcaagtgcaagttcggccagaagagcggccaccaccccggcgagaccccccccctgatcacccccggcagcgcccagagctag

SEQ ID NO: 82198 - DNA, 186 bp, Artificial Sequence
  Description of Artificial Sequence: Synthetic coding sequence
atgcagaaggtgaccctgggcctgctggtgttcctggccggcttccccgtgctggacgccaacgacctggaggacaagaacagccccttctactacggcgagagcccctgccccctgagccccccccacaaccccacctactgcctggtgcccagagtgcccatccagggctggggcctgacctag

SEQ ID NO: 82199 - DNA, 435 bp, Artificial Sequence; identical to SEQ ID NO: 82197
  Description of Artificial Sequence: Synthetic coding sequence

SEQ ID NO: 82200 - DNA, 288 bp, Artificial Sequence
  Description of Artificial Sequence: Synthetic coding sequence
atggagctggtgctggtgttcctgtgcagcctgctggcccccatggtgctggccagcgccgccgagaaggagaaggagatggaccccttccactacgactaccagaccctgagaatcggcggcctggtgttcgccgtggtgctgttcagcgtgggcatcctgctgatcctgagcagaagatgcaagtgcagcttcaaccagaagcccagagcccccggcgacgaggaggcccaggtggagaacctgatcaccgccaacgccaccgagccccagaaggccgagaactag

SEQ ID NO: 82201 - DNA, 288 bp, Artificial Sequence; identical to SEQ ID NO: 82200
  Description of Artificial Sequence: Synthetic coding sequence

SEQ ID NO: 82202 - DNA, 288 bp, Artificial Sequence; identical to SEQ ID NO: 82200
  Description of Artificial Sequence: Synthetic coding sequence

SEQ ID NO: 82203 - DNA, 288 bp, Artificial Sequence; identical to SEQ ID NO: 82200
  Description of Artificial Sequence: Synthetic coding sequence

SEQ ID NO: 82204 - DNA, 288 bp, Artificial Sequence; identical to SEQ ID NO: 82200
  Description of Artificial Sequence: Synthetic coding sequence

SEQ ID NO: 82205 - DNA, 288 bp, Artificial Sequence; identical to SEQ ID NO: 82200
  Description of Artificial Sequence: Synthetic coding sequence

SEQ ID NO: 82206 - DNA, 243 bp, Artificial Sequence
  Description of Artificial Sequence: Synthetic coding sequence
atggccacccccacccagacccccaccaaggcccccgaggagcccgaccccttctactacgactacaacaccgtgcagaccgtgggcatgaccctggccaccatcctgttcctgctgggcatcctgatcgtgatcagcaagaaggtgaagtgcagaaaggccgacagcagaagcgagagccccacctgcaagagctgcaagagcgagctgcccagcagcgcccccggcggcggcggcgtgtag

SEQ ID NO: 82207 - DNA, 402 bp, Artificial Sequence
  Description of Artificial Sequence: Synthetic coding sequence
atggtgagcgtgggcttcggcgacagagccggcctgggcagcagctgcagatgcagccagatcacccccgacatggccagcgccgtggccaccagatacgtgctgggccactggcccagagaccacatctgcggctgcggcagccaccagctgagcagctggagagccgagcccgacggcggcgtgggcatgccccacaccctgagcgagccccccagcggcctgaccggcatctgggccggcgccctggtgagccccgagaagcagatgaaggagaacctgagaagcaacgacagcgagcccagactgcccggcttcgagagctgcctgatccacagcctggccgtgtggccctgggccagcaacttcgccagcctgggccccagcgtgaacaagggctag

SEQ ID NO: 82208 - DNA, 882 bp, Artificial Sequence
  Description of Artificial Sequence: Synthetic coding sequence
atgtacttcctgacccccatcctggtggccatcctgtgcatcctggtggtgtggatcttcaagaacgccgacagaagcatggagaagaagaagggcgagcccagaaccagagccgaggccagaccctgggtggacgaggacctgaaggacagcagcgacctgcaccaggccgaggaggacgccgacgagtggcaggagagcgaggagaacgtggagcacatccccttcagccacaaccactaccccgagaaggagatggtgaagagaagccaggagttctacgagctgctgaacaagagaagaagcgtgagattcatcagcaacgagcaggtgcccatggaggtgatcgacaacgtgatcagaaccgccggcaccgcccccagcggcgcccacaccgagccctggaccttcgtggtggtgaaggaccccgacgtgaagcacaagatcagaaagatcatcgaggaggaggaggagatcaactacatgaagagaatgggccacagatgggtgaccgacctgaagaagctgagaaccaactggatcaaggagtacctggacaccgcccccatcctgatcctgatcttcaagcaggtgcacggcttcgccgccaacggcaagaagaaggtgcactactacaacgagatcagcgtgagcatcgcctgcggcatcctgctggccgccctgcaggtgaacaacggcatcaccatgagacaccagaccgccagacacagacacctgatcgagggccccggcagaagcagcgaggcctgcagcaagctgagcagccagggctgccccgagtgcagaagcggcgactgccactaccacagcagccagctgtggcccagcaccgagggcgcccccggcccccccagaacctag

SEQ ID NO: 82209 - DNA, 1458 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggagtggtacttcggcaagctgggcagaaaggacgccgagagacagctgctgagcttcggcaaccccagaggcaccttcctgatcagagagagcgagaccaccaagggcgcctacagcctgagcatcagagactgggacgacatgaagggcgaccacgtgaagcactacaagatcagaaagctggacaacggcggctactacatcaccaccagagcccagttcgagaccctgcagcagctggtgcagcactacagcgagaaggccgacggcctgtgcttcaacctgaccgtgatcgccagcagctgcaccccccagaccagcggcctggccaaggacgcctgggaggtggccagaagaagcctgtgcctggagaagaagctgggccagggctgcttcgccgaggtgtggctgggcacctggaacggcaacaccaaggtggccatcaagaccctgaagcccggcaccatgagccccgagagcttcctggaggaggcccagatcatgaagaagctgaagcacgacaagctggtgcagctgtacgccgtggtgagcgaggagcccatctacatcgtgaccgagtacatgaacaagggcagcctgctggacttcctgaaggacggcgagggcagagccctgaagctgcccaacctggtggacatggccgcccaggtggccgccggcatggcctacatcgagagaatgaactacatccacagagacctgagaagcgccaacatcctggtgggcaacggcctgatctgcaagatcgccgacttcggcctggccagactgatcgaggacaacgagtacaccgccagacagggcgccaagttccccatcaagtggaccgcccccgaggccgccctgtacggcagattcaccatcaagagcgacgtgtggagcttcggcatcctgctgaccgagctggtgaccaagggcagagtgccctaccccggcatgaacaacagagaggtgctggagcaggtggagagaggctacagaatgccctgcccccaggactgccccatcagcctgcacgagctgatgatccactgctggaagaaggaccccgaggagagacccaccttcgagtacctgcagagcttcctggaggactacttcaccgccaccgagccccagtaccagcccggcgagaacctgtag

SEQ ID NO: 82210 - DNA, 1614 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccaggccgaggagtggtacttcggcaagctgggcagaaaggacgccgagagacagctgctgagcttcggcaaccccagaggcaccttcctgatcagagagagcgagaccaccaagggcgcctacagcctgagcatcagagactgggacgacatgaagggcgaccacgtgaagcactacaagatcagaaagctggacaacggcggctactacatcaccaccagagcccagttcgagaccctgcagcagctggtgcagcactacagcgagagagccgccggcctgtgctgcagactggtggtgccctgccacaagggcatgcccagactgaccgacctgagcgtgaagaccaaggacgtgtgggagatccccagagagagcctgcagctgatcaagagactgggcaacggccagttcggcgaggtgtggatgggcacctggaacggcaacaccaaggtggccatcaagaccctgaagcccggcaccatgagccccgagagcttcctggaggaggcccagatcatgaagaagctgaagcacgacaagctggtgcagctgtacgccgtggtgagcgaggagcccatctacatcgtgaccgagtacatgaacaagggcagcctgctggacttcctgaaggacggcgagggcagagccctgaagctgcccaacctggtggacatggccgcccaggtggccgccggcatggcctacatcgagagaatgaactacatccacagagacctgagaagcgccaacatcctggtgggcaacggcctgatctgcaagatcgccgacttcggcctggccagactgatcgaggacaacgagtacaccgccagacagggcgccaagttccccatcaagtggaccgcccccgaggccgccctgtacggcagattcaccatcaagagcgacgtgtggagcttcggcatcctgctgaccgagctggtgaccaagggcagagtgccctaccccggcatgaacaacagagaggtgctggagcaggtggagagaggctacagaatgccctgcccccaggactgccccatcagcctgcacgagctgatgatccactgctggaagaaggaccccgaggagagacccaccttcgagtacctgcagagcttcctggaggactacttcaccgccaccgagccccagtaccagcccggcgagaacctgtag

SEQ ID NO: 82211 - DNA, 1449 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccaggccgaggagtggtacttcggcaagctgggcagaaaggacgccgagagacagctgctgagcttcggcaaccccagaggcaccttcctgatcagagagagcgagaccaccaagggcgcctacagcctgagcatcagagactgggacgacatgaagggcgaccacgtgaagcactacaagatcagaaagctggacaacggcggctactacatcaccaccagagcccagttcgagaccctgcagcagctggtgcagcactacagcggcacctggaacggcaacaccaaggtggccatcaagaccctgaagcccggcaccatgagccccgagagcttcctggaggaggcccagatcatgaagaagctgaagcacgacaagctggtgcagctgtacgccgtggtgagcgaggagcccatctacatcgtgaccgagtacatgaacaagggcagcctgctggacttcctgaaggacggcgagggcagagccctgaagctgcccaacctggtggacatggccgcccaggtggccgccggcatggcctacatcgagagaatgaactacatccacagagacctgagaagcgccaacatcctggtgggcaacggcctgatctgcaagatcgccgacttcggcctggccagactgatcgaggacaacgagtacaccgccagacagggcgccaagttccccatcaagtggaccgcccccgaggccgccctgtacggcagattcaccatcaagagcgacgtgtggagcttcggcatcctgctgaccgagctggtgaccaagggcagagtgccctaccccggcatgaacaacagagaggtgctggagcaggtggagagaggctacagaatgccctgcccccaggactgccccatcagcctgcacgagctgatgatccactgctggaagaaggaccccgaggagagacccaccttcgagtacctgcagagcttcctggaggactacttcaccgccaccgagccccagtaccagcccggcgagaacctgtag

SEQ ID NO: 82212 - DNA, 1614 bp, Artificial Sequence; identical to SEQ ID NO: 82210
  Description of Artificial Sequence: Synthetic coding sequence

SEQ ID NO: 82213 - DNA, 1605 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccaggccgaggagtggtacttcggcaagctgggcagaaaggacgccgagagacagctgctgagcttcggcaaccccagaggcaccttcctgatcagagagagcgagaccaccaagggcgcctacagcctgagcatcagagactgggacgacatgaagggcgaccacgtgaagcactacaagatcagaaagctggacaacggcggctactacatcaccaccagagcccagttcgagaccctgcagcagctggtgcagcactacagcgagaaggccgacggcctgtgcttcaacctgaccgtgatcgccagcagctgcaccccccagaccagcggcctggccaaggacgcctgggaggtggccagaagaagcctgtgcctggagaagaagctgggccagggctgcttcgccgaggtgtggctgggcacctggaacggcaacaccaaggtggccatcaagaccctgaagcccggcaccatgagccccgagagcttcctggaggaggcccagatcatgaagaagctgaagcacgacaagctggtgcagctgtacgccgtggtgagcgaggagcccatctacatcgtgaccgagtacatgaacaagggcagcctgctggacttcctgaaggacggcgagggcagagccctgaagctgcccaacctggtggacatggccgcccaggtggccgccggcatggcctacatcgagagaatgaactacatccacagagacctgagaagcgccaacatcctggtgggcaacggcctgatctgcaagatcgccgacttcggcctggccagactgatcgaggacaacgagtacaccgccagacagggcgccaagttccccatcaagtggaccgcccccgaggccgccctgtacggcagattcaccatcaagagcgacgtgtggagcttcggcatcctgctgaccgagctggtgaccaagggcagagtgccctaccccggcatgaacaacagagaggtgctggagcaggtggagagaggctacagaatgccctgcccccaggactgccccatcagcctgcacgagctgatgatccactgctggaagaaggaccccgaggagagacccaccttcgagtacctgcagagcttcctggaggactacttcaccgccaccgagccccagtaccagcccggcgagaacctgtag

SEQ ID NO: 82214 - DNA, 1605 bp, Artificial Sequence; identical to SEQ ID NO: 82213
  Description of Artificial Sequence: Synthetic coding sequence

SEQ ID NO: 82215 - DNA, 363 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtggtag

SEQ ID NO: 82216 - DNA, 699 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccaggccgaggagtggtacttcggcaagctgggcagaaaggacgccgagagacagctgctgagcttcggcaaccccagaggcaccttcctgatcagagagagcgagaccaccaagggcgcctacagcctgagcatcagagactgggacgacatgaagggcgaccacgtgaagcactacaagatcagaaagctggacaacggcggctactacatcaccaccagagcccagttcgagaccctgcagcagctggtgcagcactacagctag

SEQ ID NO: 82217 - DNA, 321 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggctag

SEQ ID NO: 82218 - DNA, 198 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggctag

SEQ ID NO: 82219 - DNA, 528 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccaggccgaggagtggtacttcggcaagctgggcagaaaggacgccgagagacagctgctgagcttcggcaaccccagaggcaccttcctgatctag

SEQ ID NO: 82220 - DNA, 462 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccaggccgaggagtggtacttcggcaagtag

SEQ ID NO: 82221 - DNA, 357 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactag

SEQ ID NO: 82222 - DNA, 561 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccaggccgaggagtggtacttcggcaagctgggcagaaaggacgccgagagacagctgctgagcttcggcaaccccagaggcaccttcctgatcagagagagcgagaccaccaagggcgcctacagctag

SEQ ID NO: 82223 - DNA, 312 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttctag

SEQ ID NO: 82224 - DNA, 459 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccaggccgaggagtggtacttcggctag

SEQ ID NO: 82225 - DNA, 351 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagtag

SEQ ID NO: 82226 - DNA, 423 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggccccctag

SEQ ID NO: 82227 - DNA, 438 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggccagaaccgaggacgacctgagcttccacaagggcgagaagttccagatcctgaacagcagcgagggcgactggtgggaggccagaagcctgaccaccggcgagaccggctacatccccagcaactacgtggcccccgtggacagcatccagtag

SEQ ID NO: 82228 - DNA, 1605 bp, Artificial Sequence; identical to SEQ ID NO: 82213
  Description of Artificial Sequence: Synthetic coding sequence

SEQ ID NO: 82229 - DNA, 1458 bp, Artificial Sequence
  Description of Artificial Sequence: Synthetic coding sequence
atgggctgcgtgcagtgcaaggacaaggaggccaccaagctgaccgaggagagagacggcagcctgaaccagagcagcggctacagatacggcaccgaccccaccccccagcactaccccagcttcggcgtgaccagcatccccaactacaacaacttccacgccgccggcggccagggcctgaccgtgttcggcggcgtgaacagcagcagccacaccggcaccctgagaaccagaggcggcaccggcgtgaccctgttcgtggccctgtacgactacgaggcccaggccgaggagtggtacttcggcaagctgggcagaaaggacgccgagagacagctgctgagcttcggcaaccccagaggcaccttcctgatcagagagagcgagaccaccaagggcgcctacagcctgagcatcagagactgggacgacatgaagggcgaccacgtgaagcactacaagatcagaaagctggacaacggcggctactacatcaccaccagagcccagttcgagaccctgcagcagctggtgcagcactacagcgagaaggccgacggcctgtgcttcaacctgaccgtgatcgccagcagctgcaccccccagaccagcggcctggccaaggacgcctgggaggtggccagaagaagcctgtgcctggagaagaagctgggccagggctgcttcgccgaggtgtggctgggcacctggaacggcaacaccaaggtggccatcaagaccctgaagcccggcaccatgagccccgagagcttcctggaggaggcccagatcatgaagaagctgaagcacgacaagctggtgcagctgtacgccgtggtgagcgaggagcccatctacatcgtgaccgagtacatgaacaagggcagcctgctggacttcctgaaggacggcgagggcagagccctgaagctgcccaacctggtggacatggccgcccaggtggccgccggcatggcctacatcgagagaatgaactacatccacagagacctgagaagcgccaacatcctggtgggcaacggcctgatctgcaagatcgccgacttcggcctggccagactgatcgaggacaacgagtacaccgccagacagggcgccaagttccccatcaagtggaccgcccccgaggccgccctgtacggcagattcaccatcaagagcgacgtgtggagcttcggcatcctgctgaccgagctggtgaccaagggcagagtgccctaccccggcatgaacaacagagaggtgctggagcaggtggagagaggctacagaatgccctgcccccaggactgccccatcagcctgcacgagctgatgatccactgctggaagaaggaccccgaggagagacccaccttcgagtacctgcagagcttcctggaggactacttcaccgccaccgagccccagtaccagcccggcgagaacctgtag

SEQ ID NO: 82230 - DNA, 4437 bp, Artificial Sequence
  Description of Artificial Sequence: Synthetic coding sequence
atggccagcaccaacgccgagagccagctgcagagaatcatcagagacctgcaggacgccgtgaccgagctgagcaaggagttccaggaggccggcgagcccatcaccgacgacagcaccagcctgcacaagttcagctacaagctggagtacctgctgcagttcgaccagaaggagaaggccaccctgctgggcaacaagaaggactactgggactacttctgcgcctgcctggccaaggtgaagggcgccaacgacggcatcagattcgtgaagagcatcagcgagctgagaaccagcctgggcaagggcagagccttcatcagatacagcctggtgcaccagagactggccgacaccctgcagcagtgcttcatgaacaccaaggtgaccagcgactggtactacgccagaagccccttcctgcagcccaagctgagcagcgacatcgtgggccagctgtacgagctgaccgaggtgcagttcgacctggccagcagaggcttcgacctggacgccgcctggcccaccttcgccagaagaaccctgaccaccggcagcagcgcctacctgtggaagccccccagcagaagcagcagcatgagcagcctggtgagcagctacctgcagacccaggagatggtgagcaacttcgacctgaacagccccctgaacaacgaggccctggagggcttcgacgagatgagactggagctggaccagctggaggtgagagagaagcagctgagagagagaatgcagcagctggacagagagaaccaggagctgagagccgccgtgagccagcagggcgagcagctgcagaccgagagagagagaggcagaaccgccgccgaggacaacgtgagactgacctgcctggtggccgagctgcagaagcagtgggaggtgacccaggccacccagaacaccgtgaaggagctgcagacctgcctgcagggcctggagctgggcgccgccgagaaggaggaggactaccacaccgccctgagaagactggagagcatgctgcagcccctggcccaggagctggaggccaccagagacagcctggacaagaagaaccagcacctggccagcttccccggctggctggccatggcccagcagaaggccgacaccgccagcgacaccaagggcagacaggagcccatccccagcgacgccgcccaggagatgcaggagctgggcgagaagctgcaggccctggagagagagagaaccaaggtggaggaggtgaacagacagcagagcgcccagctggagcagctggtgaaggagctgcagctgaaggaggacgccagagccagcctggagagactggtgaaggagatggcccccctgcaggaggagctgagcggcaagggccaggaggccgaccagctgtggagaagactgcaggagctgctggcccacaccagcagctgggaggaggagctggccgagctgagaagagagaagaagcagcagcaggaggagaaggagctgctggagcaggaggtgagaagcctgaccagacagctgcagttcctggagacccagctggcccaggtgagccagcacgtgagcgacctggaggagcagaagaagcagctgatccaggacaaggaccacctgagccagcaggtgggcatgctggagagactggccggcccccccggccccgagctgcccgtggccggcgagaagaacgaggccctggtgcccgtgaacagcagcctgcaggaggcctggggcaagcccgaggaggagcagagaggcctgcaggaggcccagctggacgacaccaaggtgcaggagggcagccaggaggaggagctgagacaggccaacagagagctggagaaggagctgcagaacgtggtgggcagaaaccagctgctggagggcaagctgcaggccctgcaggccgactaccaggccctgcagcagagagagagcgccatccagggcagcctggccagcctggaggccgagcaggccagcatcagacacctgggcgaccagatggaggccagcctgctggccgtgagaaaggccaaggaggccatgaaggcccagatggccgagaaggaggccatcctgcagagcaaggagggcgagtgccagcagctgagagaggaggtggagcagtgccagcagctggccgaggccagacacagagagctgagagccctggagagccagtgccagcagcagacccagctgatcgaggtgctgaccgccgagaagggccagcagggcgtgggcccccccaccgacaacgaggccagagagctggccgcccagctggccctgagccaggcccagctggaggtgcaccagggcgaggtgcagagactgcaggcccaggtggtggacctgcaggccaagatgagagccgccctggacgaccaggacaaggtgcagagccagctgagcatggccgaggccgtgctgagagagcacaagaccctggtgcagcagctgaaggagcagaacgaggccctgaacagagcccacgtgcaggagctgctgcagtgcagcgagagagagggcgccctgcaggaggagagagccgacgaggcccagcagagagaggaggagctgagagccctgcaggaggagctgagccaggccaagtgcagcagcgaggaggcccagctggagcacgccgagctgcaggagcagctgcacagagccaacaccgacaccgccgagctgggcatccaggtgtgcgccctgaccgtggagaaggagagagtggaggaggccctggcctgcgccgtgcaggagctgcaggacgccaaggaggccgccagcagagagagagagggcctggagagacaggtggccggcctgcagcaggagaaggagagcctgcaggagaagctgaaggccgccaaggccgccgccggcagcctgcccggcctgcaggcccagctggcccaggccgagcagagagcccagagcctgcaggaggccgcccaccaggagctgaacaccctgaagttccagctgagcgccgagatcatggactaccagagcagactgaagaacgccggcgaggagtgcaagagcctgagaggccagctggaggagcagggcagacagctgcaggccgccgaggaggccgtggagaagctgaaggccacccaggccgacatgggcgagaagctgagctgcaccagcaaccacctggccgagtgccaggccgccatgctgagaaaggacaaggagggcgccgccctgagagaggacctggagagaacccagaaggagctggagaaggccaccaccaagatccaggagtactacaacaagctgtgccaggaggtgaccaacagagagagaaacgaccagaagatgctggccgacctggacgacctgaacagaaccaagaagtacctggaggagagactgatcgagctgctgagagacaaggacgccctgtggcagaagagcgacgccctggagttccagcagaagctgagcgccgaggagagatggctgggcgacaccgaggccaaccactgcctggactgcaagagagagttcagctggatggtgagaagacaccactgcagaatctgcggcagaatcttctgctactactgctgcaacaactacgtgctgagcaagcacggcggcaagaaggagagatgctgcagagcctgcttccagaagctgagcgagggccccggcagccccgacagcagcggcagcggcaccagccagggcgagcccagccccgccctgagccccgccagccccggcccccaggccaccggcggccagggcgccaacaccgactacagaccccccgacgacgccgtgttcgacatcatcaccgacgaggagctgtgccagatccaggagagcggcagcagcctgcccgagacccccaccgagaccgacagcctggaccccaacgccgccgagcaggacaccaccagcaccagcctgacccccgaggacaccgaggacatgcccgtgggccaggacagcgagatctgcctgctgaagagcggcgagctgatgatcaaggtgcccctgaccgtggacgagatcgccagcttcggcgagggcagcagagagctgttcgtgagaagcagcacctacagcctgatccccatcaccgtggccgaggccggcctgaccatcagctgggtgttcagcagcgaccccaagagcatcagcttcagcgtggtgttccaggaggccgaggacacccccctggaccagtgcaaggtgctgatccccaccaccagatgcaacagccacaaggagaacatccagggccagctgaaggtgagaacccccggcatctacatgctgatcttcgacaacaccttcagcagattcgtgagcaagaaggtgttctaccacctgaccgtggacagacccgtgatctacgacggcagcgacttcctgtag

SEQ ID NO: 82231 - DNA, 804 bp, Artificial Sequence
  Description of Artificial Sequence: Synthetic coding sequence
tgaagcaagcacggcggcaagaaggagagatgctgcagagcctgcttccagaagctgagcgagggccccggcagccccgacagcagcggcagcggcaccagccagggcgagcccagccccgccctgagccccgccagccccggcccccaggccaccggcggccagggcgccaacaccgactacagaccccccgacgacgccgtgttcgacatcatcaccgacgaggagctgtgccagatccaggagagcggcagcagcctgcccgagacccccaccgagaccgacagcctggaccccaacgccgccgagcaggacaccaccagcaccagcctgacccccgaggacaccgaggacatgcccgtgggccaggacagcgagatctgcctgctgaagagcggcgagctgatgatcaaggtgcccctgaccgtggacgagatcgccagcttcggcgagggcagcagagagctgttcgtgagaagcagcacctacagcctgatccccatcaccgtggccgaggccggcctgaccatcagctgggtgttcagcagcgaccccaagagcatcagcttcagcgtggtgttccaggaggccgaggacacccccctggaccagtgcaaggtgctgatccccaccaccagatgcaacagccacaaggagaacatccagggccagctgaaggtgagaacccccggcatctacatgctgatcttcgacaacaccttcagcagattcgtgagcaagaaggtgttctaccacctgaccgtggacagacccgtgatctacgacggcagcgacttcctgtag

SEQ ID NO: 82232 - DNA, 4497 bp, Artificial Sequence
  Description of Artificial Sequence: Synthetic coding sequence
atggccagcaccaacgccgagagccagctgcagagaatcatcagagacctgcaggacgccgtgaccgagctgagcaaggagttccaggaggccggcgagcccatcaccgacgacagcaccagcctgcacaagttcagctacaagctggagtacctgctgcagttcgaccagaaggagaaggccaccctgctgggcaacaagaaggactactgggactacttctgcgcctgcctggccaaggtgaagggcgccaacgacggcatcagattcgtgaagagcatcagcgagctgagaaccagcctgggcaagggcagagccttcatcagatacagcctggtgcaccagagactggccgacaccctgcagcagtgcttcatgaacaccaaggtgaccagcgactggtactacgccagaagccccttcctgcagcccaagctgagcagcgacatcgtgggccagctgtacgagctgaccgaggtgcagttcgacctggccagcagaggcttcgacctggacgccgcctggcccaccttcgccagaagaaccctgaccaccggcagcagcgcctacctgtggaagccccccagcagaagcagcagcatgagcagcctggtgagcagctacctgcagacccaggagatggtgagcaacttcgacctgaacagccccctgaacaacgaggccctggagggcttcgacgagatgagactggagctggaccagctggaggtgagagagaagcagctgagagagagaatgcagcagctggacagagagaaccaggagctgagagccgccgtgagccagcagggcgagcagctgcagaccgagagagagagaggcagaaccgccgccgaggacaacgtgagactgacctgcctggtggccgagctgcagaagcagtgggaggtgacccaggccacccagaacaccgtgaaggagctgcagacctgcctgcagggcctggagctgggcgccgccgagaaggaggaggactaccacaccgccctgagaagactggagagcatgctgcagcccctggcccaggagctggaggccaccagagacagcctggacaagaagaaccagcacctggccagcttccccggctggctggccatggcccagcagaaggccgacaccgccagcgacaccaagggcagacaggagcccatccccagcgacgccgcccaggagatgcaggagctgggcgagaagctgcaggccctggagagagagagaaccaaggtggaggaggtgaacagacagcagagcgcccagctggagcagctggtgaaggagctgcagctgaaggaggacgccagagccagcctggagagactggtgaaggagatggcccccctgcaggaggagctgagcggcaagggccaggaggccgaccagctgtggagaagactgcaggagctgctggcccacaccagcagctgggaggaggagctggccgagctgagaagagagaagaagcagcagcaggaggagaaggagctgctggagcaggaggtgagaagcctgaccagacagctgcagttcctggagacccagctggcccaggtgagccagcacgtgagcgacctggaggagcagaagaagcagctgatccaggacaaggaccacctgagccagcaggtgggcatgctggagagactggccggcccccccggccccgagctgcccgtggccggcgagaagaacgaggccctggtgcccgtgaacagcagcctgcaggaggcctggggcaagcccgaggaggagcagagaggcctgcaggaggcccagctggacgacaccaaggtgcaggagggcagccaggaggaggagctgagacaggccaacagagagctggagaaggagctgcagaacgtggtgggcagaaaccagctgctggagggcaagctgcaggccctgcaggccgactaccaggccctgcagcagagagagagcgccatccagggcagcctggccagcctggaggccgagcaggccagcatcagacacctgggcgaccagatggaggccagcctgctggccgtgagaaaggccaaggaggccatgaaggcccagatggccgagaaggaggccatcctgcagagcaaggagggcgagtgccagcagctgagagaggaggtggagcagtgccagcagctggccgaggccagacacagagagctgagagccctggagagccagtgccagcagcagacccagctgatcgaggtgctgaccgccgagaagggccagcagggcgtgggcccccccaccgacaacgaggccagagagctggccgcccagctggccctgagccaggcccagctggaggtgcaccagggcgaggtgcagagactgcaggcccaggtggtggacctgcaggccaagatgagagccgccctggacgaccaggacaaggtgcagagccagctgagcatggccgaggccgtgctgagagagcacaagaccctggtgcagcagctgaaggagcagaacgaggccctgaacagagcccacgtgcaggagctgctgcagtgcagcgagagagagggcgccctgcaggaggagagagccgacgaggcccagcagagagaggaggagctgagagccctgcaggaggagctgagccaggccaagtgcagcagcgaggaggcccagctggagcacgccgagctgcaggagcagctgcacagagccaacaccgacaccgccgagctgggcatccaggtgtgcgccctgaccgtggagaaggagagagtggaggaggccctggcctgcgccgtgcaggagctgcaggacgccaaggaggccgccagcagagagagagagggcctggagagacaggtggccggcctgcagcaggagaaggagagcctgcaggagaagctgaaggccgccaaggccgccgccggcagcctgcccggcctgcaggcccagctggcccaggccgagcagagagcccagagcctgcaggaggccgcccaccaggagctgaacaccctgaagttccagctgagcgccgagatcatggactaccagagcagactgaagaacgccggcgaggagtgcaagagcctgagaggccagctggaggagcagggcagacagctgcaggccgccgaggaggccgtggagaagctgaaggccacccaggccgacatgggcgagaagctgagctgcaccagcaaccacctggccgagtgccaggccgccatgctgagaaaggacaaggagggcgccgccctgagagaggacctggagagaacccagaaggagctggagaaggccaccaccaagatccaggagtactacaacaagctgtgccaggaggtgaccaacagagagagaaacgaccagaagatgctggccgacctggacgacctgaacagaaccaagaagtacctggaggagagactgatcgagctgctgagagacaaggacgccctgtggcagaagagcgacgccctggagttccagcagaagctgagcgccgaggagagatggctgggcgacaccgaggccaaccactgcctggactgcaagagagagttcagctggatggtgagaagacaccactgcagaatctgcggcagaatcttctgctactactgctgcaacaactacgtgctgagcaagcacggcggcaagaaggagagatgctgcagagcctgcttccagaagctgagcgagggccccggcagccccgacagcagcggcagcggcaccagccagggcgagcccagccccgccctgagccccgccagccccggcccccaggccaccggcggccagggcgccaacaccgactacagaccccccgacgacgccgtgttcgacatcatcaccgacgaggagctgtgccagatccaggagagcggcagcagcctgcccgagacccccaccgagaccgacagcctggaccccaacgccgccgagcaggccagcgtgggcgccagcaagggcctgggcaacctgctgtgcgagagcagcgcctgcagagacaccaccagcaccagcctgacccccgaggacaccgaggacatgcccgtgggccaggacagcgagatctgcctgctgaagagcggcgagctgatgatcaaggtgcccctgaccgtggacgagatcgccagcttcggcgagggcagcagagagctgttcgtgagaagcagcacctacagcctgatccccatcaccgtggccgaggccggcctgaccatcagctgggtgttcagcagcgaccccaagagcatcagcttcagcgtggtgttccaggaggccgaggacacccccctggaccagtgcaaggtgctgatccccaccaccagatgcaacagccacaaggagaacatccagggccagctgaaggtgagaacccccggcatctacatgctgatcttcgacaacaccttcagcagattcgtgagcaagaaggtgttctaccacctgaccgtggacagacccgtgatctacgacggcagcgacttcctgtag

SEQ ID NO: 82233 - DNA, 2886 bp, Artificial Sequence
  Description of Artificial Sequence: Synthetic coding sequence
atgcacggccacagagcccccggcggcgccggccccagcgagcccgagcaccccgccaccaacccccccggcgccgccccccccgcctgcgccgacagcgaccccggcgccagcgagcccggcctgctggccagaagaggcagcggcagcgccctgggcggccccctggacccccagttcgtgggccccagcgacaccagcctgggcgccgcccccggccacagagtgctgccctgcggccccagcccccagcaccacagagccctgagattcagctaccacctggagggcagccagcccagacccggcctgcaccagggcaacagaatcctggtgaagagcctgagcctggaccccggccagagcctggagccccaccccgagggcccccagagactgagaagcgaccccggcccccccaccgagacccccagccagagacccagccccctgaagagagcccccggccccaagccccaggtgccccccaagcccagctacctgcagatgcccagaatgcccccccccctggagcccatcccccccccccccagcagacccctgcccgccgaccccagagtggccaagggcctggcccccagagccgaggccagccccagcagcgccgccgtgagcagcctgatcgagaagttcgagagagagcccgtgatcgtggccagcgacagacccgtgcccggccccagccccggcccccccgagcccgtgatgctgccccagcccaccagccagccccccgtgccccagctgcccgagggcgaggccagcagatgcctgttcctgctggcccccggccccagagacggcgagaaggtgcccaacagagacagcggcatcgacagcatcagcagccccagcaacagcgaggagacctgcttcgtgagcgacgacggcccccccagccacagcctgtgccccggcccccccgccctggccagcgtgcccgtggccctggccgacccccacagacccggcagccaggaggtggacagcgacctggaggaggaggacgacgaggaggaggaggaggagaaggacagagagatccccgtgcccctgatggagagacaggagagcgtggagctgaccgtgcagcagaaggtgttccacatcgccaacgagctgctgcagaccgagaaggcctacgtgagcagactgcacctgctggaccaggtgttctgcgccagactgctggaggaggccagaaacagaagcagcttccccgccgacgtggtgcacggcatcttcagcaacatctgcagcatctactgcttccaccagcagttcctgctgcccgagctggagaagagaatggaggagtgggacagataccccagaatcggcgacatcctgcagaagctggcccccttcctgaagatgtacggcgagtacgtgaagaacttcgacagagccgtggagctggtgaacacctggaccgagagaagcacccagttcaaggtgatcatccacgaggtgcagaaggaggaggcctgcggcaacctgaccctgcagcaccacatgctggagcccgtgcagagaatccccagatacgagctgctgctgaaggactacctgctgaagctgccccacggcagccccgacagcaaggacgcccagaagagcctggagctgatcgccaccgccgccgagcacagcaacgccgccatcagaaagatggagagaatgcacaagctgctgaaggtgtacgagctgctgggcggcgaggaggacatcgtgagccccaccaaggagctgatcaaggagggccacatcctgaagctgagcgccaagaacggcaccacccaggacagatacctgatcctgttcaacgacagactgctgtactgcgtgcccagactgagactgctgggccagaagttcagcgtgagagccagaatcgacgtggacggcatggagctgaaggagagcagcaacctgaacctgcccagaaccttcctggtgagcggcaagcagagaagcctggagctgcaggccagaaccgaggaggagaagaaggactgggtgcaggccatcaacagcaccctgctgaagcacgagcagaccctggagaccttcaagctgctgaacagcaccaacagagaggacgaggacaccccccccaacagccccaacgtggacctgggcaagagagcccccacccccatcagagagaaggaggtgaccatgtgcatgagatgccaggagcccttcaacagcatcaccaagagaagacaccactgcaaggcctgcggccacgtggtgtgcggcaagtgcagcgagttcagagccagactggtgtacgacaacaacagaagcaacagagtgtgcaccgactgctacgtggccctgcacggcgtgcccggcagcagccccgcctgcagccagcacaccccccagagaagaagaagcatcctggagaagcaggccagcgtggccgccgagaacagcgtgatctgcagcttcctgcactacatggagaagggcggcaagggctggcacaaggcctggttcgtggtgcccgagaacgagcccctggtgctgtacatctacggcgccccccaggacgtgaaggcccagagaagcctgcccctgatcggcttcgaggtgggcccccccgaggccggcgagagacccgacagaagacacgtgttcaagatcacccagagccacctgagctggtacttcagccccgagaccgaggagctgcagagaagatggatggccgtgctgggcagagccggcagaggcgacaccttctgccccggccccaccctgagcgaggacagagagatggaggaggcccccgtggccgccctgggcgccaccgccgagccccccgagagcccccagaccagagacaagacctag

SEQ ID NO: 82234 - DNA, 1968 bp, Artificial Sequence
  Description of Artificial Sequence: Synthetic coding sequence
atgaagggcgccagcgaggagaagctggccagcgtgagcaacctggtgaccgtgttcgagaacagcagaacccccgaggccgcccccagaggccagagactggaggacgtgcaccacagacccgagtgcagaccccccgagagccccggccccagagagaagaccaacgtgggcgaggccgtgggcagcgagcccagaaccgtgagcagaagatacctgaacagcctgaagaacaagctgagcagcgaggcctggagaaagagctgccagcccgtgaccctgagcggcagcggcacccaggagcccgagaagaagatcgtgcaggagctgctggagaccgagcaggcctacgtggccagactgcacctgctggaccaggtgttcttccaggagctgctgaagaccgccagaagcagcaaggccttccccgaggacgtggtgagagtgatcttcagcaacatcagcagcatctaccagttccacagccagttcttcctgcccgagctgcagagaagactggacgactggaccgccaaccccagaatcggcgacgtgatccagaagctggcccccttcctgaagatgtacagcgagtacgtgaagaacttcgagagagccgccgagctgctggccacctggaccgacaagagccccctgttccaggaggtgctgaccagaatccagagcagcgaggccagcggcagcctgaccctgcagcaccacatgctggagcccgtgcagagaatccccagatacgagctgctgctgaaggagtacatccagaagctgcccgcccaggcccccgaccaggccgacgcccagaaggccctggacatgatcttcagcgccgcccagcacagcaacgccgccatcaccgagatggagagactgcaggacctgtgggaggtgtaccagagactgggcctggaggacgacatcgtggaccccagcaacaccctgctgagagagggccccgtgctgaagatcagcttcagaagaaacgaccccatggagagatacctgttcctgttcaacaacatgctgctgtactgcgtgcccagagtgatccaggtgggcgcccagttccaggtgagaaccagaatcgacgtggccggcatgaaggtgagagagctgatggacgccgagttcccccacagcttcctggtgagcggcaagcagagaaccctggagctgcaggccagaagccaggaggagatgatcagctggatgcaggccttccaggccgccatcgaccagatcgagaagagaaacgagaccttcaaggccgccgcccagggccccgagggcgacatccaggagcaggagctgcagagcgaggagctgggcctgagagccccccagtgggtgagagacaagatggtgaccatgtgcatgagatgccaggagcccttcaacgccctgaccagaagaagacaccactgcagagcctgcggctacgtggtgtgcgccagatgcagcgactacagagccgagctgaagtacgacgacaacagacccaacagagtgtgcctgcactgctacgccttcctgaccggcaacgtgctgcccgaggccaaggaggacaagagaagaggcatcctggagaagggcagcagcgccacccccgaccagagcctgatgtgcagcttcctgcagctgatcggcgacaagtggggcaagagcggccccagaggctggtgcgtgatccccagagacgaccccctggtgctgtacgtgtacgccgccccccaggacatgagagcccacaccagcatccccctgctgggctaccaggtgaccgtgggcccccagggcgaccccagagtgttccagctgcagcagagcggccagctgtacaccttcaaggccgagaccgaggagctgaagggcagatgggtgaaggccatggagagagccgccagcggctggagccccagctggcccaacgacggcgacctgagcgactag

SEQ ID NO: 82235 - DNA, 852 bp, Artificial Sequence
  Description of Artificial Sequence: Synthetic coding sequence
atgaaggtgagagagctgatggacgccgagttcccccacagcttcctggtgagcggcaagcagagaaccctggagctgcaggccagaagccaggaggagatgatcagctggatgcaggccttccaggccgccatcgaccagatcgagaagagaaacgagaccttcaaggccgccgcccagggccccgagggcgacatccaggagcaggagctgcagagcgaggagctgggcctgagagccccccagtgggtgagagacaagatggtgaccatgtgcatgagatgccaggagcccttcaacgccctgaccagaagaagacaccactgcagagcctgcggctacgtggtgtgcgccagatgcagcgactacagagccgagctgaagtacgacgacaacagacccaacagagtgtgcctgcactgctacgccttcctgaccggcaacgtgctgcccgaggccaaggaggacaagagaagaggcatcctggagaagggcagcagcgccacccccgaccagagcctgatgtgcagcttcctgcagctgatcggcgacaagtggggcaagagcggccccagaggctggtgcgtgatccccagagacgaccccctggtgctgtacgtgtacgccgccccccaggacatgagagcccacaccagcatccccctgctgggctaccaggtgaccgtgggcccccagggcgaccccagagtgttccagctgcagcagagcggccagctgtacaccttcaaggccgagaccgaggagctgaagggcagatgggtgaaggccatggagagagccgccagcggctggagccccagctggcccaacgacggcgacctgagcgactag

SEQ ID NO: 82236 - DNA, 2178 bp, Artificial Sequence
  Description of Artificial Sequence: Synthetic coding sequence
atggagagcggcagaggcagcagcaccccccccggccccatcgccgccctgggcatgcccgacaccggccccggcagcagcagcctgggcaagctgcaggccctgcccgtgggccccagagcccactgcggcgaccccgtgagcctggccgccgccggcgacggcagccccgacatcggccccaccggcgagctgagcggcagcctgaagatccccaacagagacagcggcatcgacagccccagcagcagcgtggccggcgagaacttcccctgcgaggagggcctggaggccggccccagccccaccgtgctgggcgcccacgccgagatggccctggacagccaggtgcccaaggtgaccccccaggaggaggccgacagcgacgtgggcgaggagcccgacagcgagaacaccccccagaaggccgacaaggacgccggcctggcccagcacagcggcccccagaagctgctgcacatcgcccaggagctgctgcacaccgaggagacctacgtgaagagactgcacctgctggaccaggtgttctgcaccagactgaccgacgccggcatcccccccgaggtgatcatgggcatcttcagcaacatcagcagcatccacagattccacggccagttcctgctgcccgagctgaagaccagaatcaccgaggagtgggacaccaaccccagactgggcgacatcctgcagaagctggcccccttcctgaagatgtacggcgagtacgtgaagaacttcgacagagccgtgggcctggtgagcacctggacccagagaagccccctgttcaaggacgtggtgcacagcatccagaagcaggaggtgtgcggcaacctgaccctgcagcaccacatgctggagcccgtgcagagagtgcccagatacgagctgctgctgaaggactacctgaagagactgccccaggacgcccccgacagaaaggacgccgagagaagcctggagctgatcagcaccgccgccaaccacagcaacgccgccatcagaaaggtggagaagatgcacaagctgctggaggtgtacgagcagctgggcggcgaggaggacatcgtgaaccccgccaacgagctgatcaaggagggccagatccagaagctgagcgccaagaacggcaccccccaggacagacacctgttcctgttcaacagcatgatcctgtactgcgtgcccaagctgagactgatgggccagaagttcagcgtgagagagaagatggacatcagcggcctgcaggtgcaggacatcgtgaagcccaacaccgcccacaccttcatcatcaccggcagaaagagaagcctggagctgcagaccagaaccgaggaggagaagaaggagtggatccagatcatccaggccaccatcgagaagcacaagcagaacagcgagaccttcaaggccttcggcggcgccttcagccaggacgaggaccccagcctgagccccgacatgcccatcaccagcaccagccccgtggagcccgtggtgaccaccgagggcagcagcggcgccgccggcctggagcccagaaagctgagcagcaagaccagaagagacaaggagaagcagagctgcaagagctgcggcgagaccttcaacagcatcaccaagagaagacaccactgcaagctgtgcggcgccgtgatctgcggcaagtgcagcgagttcaaggccgagaacagcagacagagcagagtgtgcagagactgcttcctgacccagcccgtggcccccgagagcaccgagaagacccccaccgccgacccccagcccagcctgctgtgcggccccctgagactgagcgagagcggcgagacctggagcgaggtgtgggccgccatccccatgagcgacccccaggtgctgcacctgcagggcggcagccaggacggcagactgcccagaaccatccccctgcccagctgcaagctgagcgtgcccgaccccgaggagagactggacagcggccacgtgtggaagctgcagtgggccaagcagagctggtacctgagcgccagcagcgccgagctgcagcagcagtggctggagaccctgagcaccgccgcccacggcgacaccgcccaggacagccccggcgccctgcagctgcaggtgcccatgggcgccgccgccccctag

SEQ ID NO: 82237 - DNA, 2178 bp, Artificial Sequence; identical to SEQ ID NO: 82236
  Description of Artificial Sequence: Synthetic coding sequence

SEQ ID NO: 82238 - DNA, 2175 bp, Artificial Sequence
  Description of Artificial Sequence: Synthetic coding sequence
atggagagcggcagaggcagcagcaccccccccggccccatcgccgccctgggcatgcccgacaccggccccggcagcagcagcctgggcaagctgcaggccctgcccgtgggccccagagcccactgcggcgaccccgtgagcctggccgccgccggcgacggcagccccgacatcggccccaccggcgagctgagcggcagcctgaagatccccaacagagacagcggcatcgacagccccagcagcagcgtggccggcgagaacttcccctgcgaggagggcctggaggccggccccagccccaccgtgctgggcgcccacgccgagatggccctggacagccaggtgcccaaggtgaccccccaggaggaggccgacagcgacgtgggcgaggagcccgacagcgagaacaccccccagaaggccgacaaggacgccggcctggcccagcacagcggcccccagaagctgctgcacatcgcccaggagctgctgcacaccgaggagacctacgtgaagagactgcacctgctggaccaggtgttctgcaccagactgaccgacgccggcatcccccccgaggtgatcatgggcatcttcagcaacatcagcagcatccacagattccacggccagttcctgctgcccgagctgaagaccagaatcaccgaggagtgggacaccaaccccagactgggcgacatcctgcagaagctggcccccttcctgaagatgtacggcgagtacgtgaagaacttcgacagagccgtgggcctggtgagcacctggacccagagaagccccctgttcaaggacgtggtgcacagcatccagaagcaggaggtgtgcggcaacctgaccctgcagcaccacatgctggagcccgtgcagagagtgcccagatacgagctgctgctgaaggactacctgaagagactgccccaggacgcccccgacagaaaggacgccgagagaagcctggagctgatcagcaccgccgccaaccacagcaacgccgccatcagaaaggtggagaagatgcacaagctgctggaggtgtacgagcagctgggcggcgaggaggacatcgtgaaccccgccaacgagctgatcaaggagggccagatccagaagctgagcgccaagaacggcaccccccaggacagacacctgttcctgttcaacagcatgatcctgtactgcgtgcccaagctgagactgatgggccagaagttcagcgtgagagagaagatggacatcagcggcctgcaggtgcaggacatcgtgaagcccaacaccgcccacaccttcatcatcaccggcagaaagagaagcctggagctgcagaccagaaccgaggaggagaagaaggagtggatccagatcatccaggccaccatcgagaagcacaagcagaacagcgagaccttcaaggccttcggcggcgccttcagccaggacgaggaccccagcctgagccccgacatgcccatcaccagcaccagccccgtggagcccgtggtgaccaccgagggcagcagcggcgccgccggcctggagcccagaaagctgagcagcaagaccagaagagacaaggagaagcagagctgcaagagctgcggcgagaccttcaacagcatcaccaagagaagacaccactgcaagctgtgcggcgccgtgatctgcggcaagtgcagcgagttcaaggccgagaacagcagacagagcagagtgtgcagagactgcttcctgacccagcccgtggcccccgagagcaccgagacccccaccgccgacccccagcccagcctgctgtgcggccccctgagactgagcgagagcggcgagacctggagcgaggtgtgggccgccatccccatgagcgacccccaggtgctgcacctgcagggcggcagccaggacggcagactgcccagaaccatccccctgcccagctgcaagctgagcgtgcccgaccccgaggagagactggacagcggccacgtgtggaagctgcagtgggccaagcagagctggtacctgagcgccagcagcgccgagctgcagcagcagtggctggagaccctgagcaccgccgcccacggcgacaccgcccaggacagccccggcgccctgcagctgcaggtgcccatgggcgccgccgccccctag

SEQ ID NO: 82239 - DNA, 987 bp, Artificial Sequence
  Description of Artificial Sequence: Synthetic coding sequence
atgatcctgtactgcgtgcccaagctgagactgatgggccagaagttcagcgtgagagagaagatggacatcagcggcctgcaggtgcaggacatcgtgaagcccaacaccgcccacaccttcatcatcaccggcagaaagagaagcctggagctgcagaccagaaccgaggaggagaagaaggagtggatccagatcatccaggccaccatcgagaagcacaagcagaacagcgagaccttcaaggccttcggcggcgccttcagccaggacgaggaccccagcctgagccccgacatgcccatcaccagcaccagccccgtggagcccgtggtgaccaccgagggcagcagcggcgccgccggcctggagcccagaaagctgagcagcaagaccagaagagacaaggagaagcagagctgcaagagctgcggcgagaccttcaacagcatcaccaagagaagacaccactgcaagctgtgcggcgccgtgatctgcggcaagtgcagcgagttcaaggccgagaacagcagacagagcagagtgtgcagagactgcttcctgacccagcccgtggcccccgagagcaccgagaagacccccaccgccgacccccagcccagcctgctgtgcggccccctgagactgagcgagagcggcgagacctggagcgaggtgtgggccgccatccccatgagcgacccccaggtgctgcacctgcagggcggcagccaggacggcagactgcccagaaccatccccctgcccagctgcaagctgagcgtgcccgaccccgaggagagactggacagcggccacgtgtggaagctgcagtgggccaagcagagctggtacctgagcgccagcagcgccgagctgcagcagcagtggctggagaccctgagcaccgccgcccacggcgacaccgcccaggacagccccggcgccctgcagctgcaggtgcccatgggcgccgccgccccctag

SEQ ID NO: 82240 - DNA, 1416 bp, Artificial Sequence
  Description of Artificial Sequence: Synthetic coding sequence
atggtgaacaagatcttcagcaacatcagcagcatcaacgccttccacagcaagttcctgctgcccgagctggagaagagaatgcaggagtgggagaccacccccagaatcggcgacatcctgcagaagctggcccccttcctgaagatgtacggcgagtacgtgaagggcttcgacaacgccatggagctggtgaagaacatgaccgagagaatcccccagttcaagagcgtggtggaggagatccagaagcagaagatctgcggcagcctgaccctgcagcaccacatgctggagcccgtgcagagaatccccagatacgagatgctgctgaaggactacctgagaaagctgccccccgacagcctggactggaacgacgccaagaagagcctggagatcatcagcaccgccgccagccacagcaacagcgccatcagaaagatggagaacctgaagaagctgctggagatctacgagatgctgggcgaggaggaggacatcgtgaaccccagcaacgagctgatcaaggagggccagatcctgaagctggccgccagaaacaccagcgcccaggagagatacctgttcctgttcaacaacatgctgctgtactgcgtgcccaagttcagcctggtgggcagcaagttcaccgtgagaaccagagtgggcatcgacggcatgaagatcgtggagacccagaacgaggagtacccccacaccttccaggtgagcggcaaggagagaaccctggagctgcaggccagcagcgcccaggacaaggaggagtggatcaaggccctgcaggagaccatcgacgccttccaccagagacacgagaccttcagaaacgccatcgccaaggacaacgacatccacagcgaggtgagcaccgccgagctgggcaagagagcccccagatggatcagagacaacgaggtgaccatgtgcatgaagtgcaaggagcccttcaacgccctgaccagaagaagacaccactgcagagcctgcggctacgtggtgtgctggaagtgcagcgactacaaggcccagctggagtacgacggcggcaagctgagcaaggtgtgcaaggactgctaccagatcatcagcggcttcaccgacagcgaggagaagaagagaaagggcatcctggagatcgagagcgccgaggtgagcggcaacagcgtggtgtgcagcttcctgcagtacatggagaagagcaagccctggcagaaggcctggtgcgtgatccccaagcaggaccccctggtgctgtacatgtacggcgccccccaggtgagcaagccccacctgagcgagggcaccgacgccctgggcggcaagggcaagagagtggacagcggcctgaagatctgcagaaccagagtgcaggccgtgagcctgttccactag

SEQ ID NO: 82241 - DNA, 843 bp, Artificial Sequence
  Description of Artificial Sequence: Synthetic coding sequence
atggtgaacaagatcttcagcaacatcagcagcatcaacgccttccacagcaagttcctgctgcccgagctggagaagagaatgcaggagtgggagaccacccccagaatcggcgacatcctgcagaagctggcccccttcctgaagatgtacggcgagtacgtgaagggcttcgacaacgccatggagctggtgaagaacatgaccgagagaatcccccagttcaagagcgtggtggaggagatccagaagcagaagatctgcggcagcctgaccctgcagcaccacatgctggagcccgtgcagagaatccccagatacgagatgctgctgaaggactacctgagaaagctgccccccgacagcctggactggaacgacgccaagaagagcctggagatcatcagcaccgccgccagccacagcaacagcgccatcagaaagatggagaacctgaagaagctgctggagatctacgagatgctgggcgaggaggaggacatcgtgaaccccagcaacgagctgatcaaggagggccagatcctgaagctggccgccagaaacaccagcgcccaggagagatacctgttcctgttcaacaacatgctgctgtactgcgtgcccaagttcagcctggtgggcagcaagttcaccgtgagaaccagagtgggcatcgacggcatgaagatcgtggagacccagaacgaggagtacccccacaccttccaggtgagcggcaaggagagaaccctggagctgcaggccagcagcgcccaggacaaggaggagtggatcaagagaagaggcttcgccatgctgcccagactgatcagcaacagctag

SEQ ID NO: 82242 - DNA, 567 bp, Artificial Sequence
  Description of Artificial Sequence: Synthetic coding sequence
atgttcagctgcttcctgtgcatcctgagcttcagcagcctgagcaactacagcgacctgaagaaggagagcgccgtgaacctgaacgcccccagaacccccggcagacacggcctgaccaccaccccccagcagaagctgctgagccagcacctgccccagagacagggcaacgacaccgacaagacccagggcgcccagacctgcgtggccaacggcgtgatggccgcccagaaccagatggagtgcgaggaggagaaggccgccaccctgagcagcgacaccagcatccaggccagcgagcccctgctggacacccacatcgtgaacggcgagagagacgagaccgccaccgcccccgccagccccaccaccgacagctgcgacggcaacgccagcgacagcagctacagaacccccggcatcggccccgtgctgcccctggaggagagaggcgccgagaccgagaccaaggtgcaggagagagagaacggcgagagccccctggagctggagcagctggaccagcaccacgagatgaaggtggagcacgagaccagcagctag

SEQ ID NO: 82243 - DNA, 2301 bp, Artificial Sequence
  Description of Artificial Sequence: Synthetic coding sequence
atggaggagatcaagcccgccagcgccagctgcgtgagcaaggagaagcccagcaaggtgagcgacctgatcagcagattcgagggcggcagcagcctgagcaactacagcgacctgaagaaggagagcgccgtgaacctgaacgcccccagaacccccggcagacacggcctgaccaccaccccccagcagaagctgctgagccagcacctgccccagagacagggcaacgacaccgacaagacccagggcgcccagacctgcgtggccaacggcgtgatggccgcccagaaccagatggagtgcgaggaggagaaggccgccaccctgagcagcgacaccagcatccaggccagcgagcccctgctggacacccacatcgtgaacggcgagagagacgagaccgccaccgcccccgccagccccaccaccgacagctgcgacggcaacgccagcgacagcagctacagaacccccggcatcggccccgtgctgcccctggaggagagaggcgccgagaccgagaccaaggtgcaggagagagagaacggcgagagccccctggagctggagcagctggaccagcaccacgagatgaaggagaccaacgagcagaagctgcacaagatcgccaacgagctgctgctgaccgagagagcctacgtgaacagactggacctgctggaccaggtgttctactgcaagctgctggaggaggccaacagaggcagcttccccgccgagatggtgaacaagatcttcagcaacatcagcagcatcaacgccttccacagcaagttcctgctgcccgagctggagaagagaatgcaggagtgggagaccacccccagaatcggcgacatcctgcagaagctggcccccttcctgaagatgtacggcgagtacgtgaagggcttcgacaacgccatggagctggtgaagaacatgaccgagagaatcccccagttcaagagcgtggtggaggagatccagaagcagaagatctgcggcagcctgaccctgcagcaccacatgctggagcccgtgcagagaatccccagatacgagatgctgctgaaggactacctgagaaagctgccccccgacagcctggactggaacgacgccaagaagagcctggagatcatcagcaccgccgccagccacagcaacagcgccatcagaaagatggagaacctgaagaagctgctggagatctacgagatgctgggcgaggaggaggacatcgtgaaccccagcaacgagctgatcaaggagggccagatcctgaagctggccgccagaaacaccagcgcccaggagagatacctgttcctgttcaacaacatgctgctgtactgcgtgcccaagttcagcctggtgggcagcaagttcaccgtgagaaccagagtgggcatcgacggcatgaagatcgtggagacccagaacgaggagtacccccacaccttccaggtgagcggcaaggagagaaccctggagctgcaggccagcagcgcccaggacaaggaggagtggatcaaggccctgcaggagaccatcgacgccttccaccagagacacgagaccttcagaaacgccatcgccaaggacaacgacatccacagcgaggtgagcaccgccgagctgggcaagagagcccccagatggatcagagacaacgaggtgaccatgtgcatgaagtgcaaggagcccttcaacgccctgaccagaagaagacaccactgcagagcctgcggctacgtggtgtgctggaagtgcagcgactacaaggcccagctggagtacgacggcggcaagctgagcaaggtgtgcaaggactgctaccagatcatcagcggcttcaccgacagcgaggagaagaagagaaagggcatcctggagatcgagagcgccgaggtgagcggcaacagcgtggtgtgcagcttcctgcagtacatggagaagagcaagccctggcagaaggcctggtgcgtgatccccaagcaggaccccctggtgctgtacatgtacggcgccccccaggacgtgagagcccaggccaccatccccctgctgggctacgtggtggacgagatgcccagaagcgccgacctgccccacagcttcaagctgacccagagcaagagcgtgcacagcttcgccgccgacagcgaggagctgaagcagaagtggctgaaggtgatcctgctggccgtgaccggcgagacccccggcggccccaacgagcaccccgccaccctggacgaccaccccgagcccaagaagaagagcgagtgctag

SEQ ID NO: 82244 - DNA, 624 bp, Artificial Sequence
  Description of Artificial Sequence: Synthetic coding sequence
atggaggagatcaagcccgccagcgccagctgcgtgagcaaggagaagcccagcaaggtgagcgacctgatcagcagattcgagggcggcagcagcctgagcaactacagcgacctgaagaaggagagcgccgtgaacctgaacgcccccagaacccccggcagacacggcctgaccaccaccccccagcagaagctgctgagccagcacctgccccagagacagggcaacgacaccgacaagacccagggcgcccagacctgcgtggccaacggcgtgatggccgcccagaaccagatggagtgcgaggaggagaaggccgccaccctgagcagcgacaccagcatccaggccagcgagcccctgctggacacccacatcgtgaacggcgagagagacgagaccgccaccgcccccgccagccccaccaccgacagctgcgacggcaacgccagcgacagcagctacagaacccccggcatcggccccgtgctgcccctggaggagagaggcgccgagaccgagaccaaggtgcaggagagagagaacggcgagagccccctggagctggagcagctggaccagcaccacgagatgaaggtggagcacgagaccagcagctag

SEQ ID NO: 82245 - DNA, 2637 bp, Artificial Sequence
  Description of Artificial Sequence: Synthetic coding sequence
atgaacttcaagagagtgaagcccaacatcttcctgctgaaccagagcagactgatcatcagcatctgcgagatcatgagcaccgaccagggcagcagcacctgccccaagatcgccctggtgcccccctgcagcaccagcagcaccaccaccctggtgggcgagaacgtgagcgaggaggaggcccagggcatcaacggcaacagacccgccaagcacagcgccgccagccccaagccccaggtgccccccaagcccctgcacctgcagaacagccccagcagcaacatccaccagacccccagacacaaggccctgcccagcgccaagcccagaatggaggagatcaagcccgccagcgccagctgcgtgagcaaggagaagcccagcaaggtgagcgacctgatcagcagattcgagggcggcagcagcctgagcaactacagcgacctgaagaaggagagcgccgtgaacctgaacgcccccagaacccccggcagacacggcctgaccaccaccccccagcagaagctgctgagccagcacctgccccagagacagggcaacgacaccgacaagacccagggcgcccagacctgcgtggccaacggcgtgatggccgcccagaaccagatggagtgcgaggaggagaaggccgccaccctgagcagcgacaccagcatccaggccagcgagcccctgctggacacccacatcgtgaacggcgagagagacgagaccgccaccgcccccgccagccccaccaccgacagctgcgacggcaacgccagcgacagcagctacagaacccccggcatcggccccgtgctgcccctggaggagagaggcgccgagaccgagaccaaggtgcaggagagagagaacggcgagagccccctggagctggagcagctggaccagcaccacgagatgaaggagaccaacgagcagaagctgcacaagatcgccaacgagctgctgctgaccgagagagcctacgtgaacagactggacctgctggaccaggtgttctactgcaagctgctggaggaggccaacagaggcagcttccccgccgagatggtgaacaagatcttcagcaacatcagcagcatcaacgccttccacagcaagttcctgctgcccgagctggagaagagaatgcaggagtgggagaccacccccagaatcggcgacatcctgcagaagctggcccccttcctgaagatgtacggcgagtacgtgaagggcttcgacaacgccatggagctggtgaagaacatgaccgagagaatcccccagttcaagagcgtggtggaggagatccagaagcagaagatctgcggcagcctgaccctgcagcaccacatgctggagcccgtgcagagaatccccagatacgagatgctgctgaaggactacctgagaaagctgccccccgacagcctggactggaacgacgccaagaagagcctggagatcatcagcaccgccgccagccacagcaacagcgccatcagaaagatggagaacctgaagaagctgctggagatctacgagatgctgggcgaggaggaggacatcgtgaaccccagcaacgagctgatcaaggagggccagatcctgaagctggccgccagaaacaccagcgcccaggagagatacctgttcctgttcaacaacatgctgctgtactgcgtgcccaagttcagcctggtgggcagcaagttcaccgtgagaaccagagtgggcatcgacggcatgaagatcgtggagacccagaacgaggagtacccccacaccttccaggtgagcggcaaggagagaaccctggagctgcaggccagcagcgcccaggacaaggaggagtggatcaaggccctgcaggagaccatcgacgccttccaccagagacacgagaccttcagaaacgccatcgccaaggacaacgacatccacagcgaggtgagcaccgccgagctgggcaagagagcccccagatggatcagagacaacgaggtgaccatgtgcatgaagtgcaaggagcccttcaacgccctgaccagaagaagacaccactgcagagcctgcggctacgtggtgtgctggaagtgcagcgactacaaggcccagctggagtacgacggcggcaagctgagcaaggtgtgcaaggactgctaccagatcatcagcggcttcaccgacagcgaggagaagaagagaaagggcatcctggagatcgagagcgccgaggtgagcggcaacagcgtggtgtgcagcttcctgcagtacatggagaagagcaagccctggcagaaggcctggtgcgtgatccccaagcaggaccccctggtgctgtacatgtacggcgccccccaggacgtgagagcccaggccaccatccccctgctgggctacgtggtggacgagatgcccagaagcgccgacctgccccacagcttcaagctgacccagagcaagagcgtgcacagcttcgccgccgacagcgaggagctgaagcagaagtggctgaaggtgatcctgctggccgtgaccggcgagacccccggcggccccaacgagcaccccgccaccctggacgaccaccccgagcccaagaagaagagcgagtgctag

SEQ ID NO: 82246 - DNA, 2556 bp, Artificial Sequence
  Description of Artificial Sequence: Synthetic coding sequence
atgggcggctgcagcagcacctgccccaagatcgccctggtgcccccctgcagcaccagcagcaccaccaccctggtgggcgagaacgtgagcgaggaggaggcccagggcatcaacggcaacagacccgccaagcacagcgccgccagccccaagccccaggtgccccccaagcccctgcacctgcagaacagccccagcagcaacatccaccagacccccagacacaaggccctgcccagcgccaagcccagaatggaggagatcaagcccgccagcgccagctgcgtgagcaaggagaagcccagcaaggtgagcgacctgatcagcagattcgagggcggcagcagcctgagcaactacagcgacctgaagaaggagagcgccgtgaacctgaacgcccccagaacccccggcagacacggcctgaccaccaccccccagcagaagctgctgagccagcacctgccccagagacagggcaacgacaccgacaagacccagggcgcccagacctgcgtggccaacggcgtgatggccgcccagaaccagatggagtgcgaggaggagaaggccgccaccctgagcagcgacaccagcatccaggccagcgagcccctgctggacacccacatcgtgaacggcgagagagacgagaccgccaccgcccccgccagccccaccaccgacagctgcgacggcaacgccagcgacagcagctacagaacccccggcatcggccccgtgctgcccctggaggagagaggcgccgagaccgagaccaaggtgcaggagagagagaacggcgagagccccctggagctggagcagctggaccagcaccacgagatgaaggagaccaacgagcagaagctgcacaagatcgccaacgagctgctgctgaccgagagagcctacgtgaacagactggacctgctggaccaggtgttctactgcaagctgctggaggaggccaacagaggcagcttccccgccgagatggtgaacaagatcttcagcaacatcagcagcatcaacgccttccacagcaagttcctgctgcccgagctggagaagagaatgcaggagtgggagaccacccccagaatcggcgacatcctgcagaagctggcccccttcctgaagatgtacggcgagtacgtgaagggcttcgacaacgccatggagctggtgaagaacatgaccgagagaatcccccagttcaagagcgtggtggaggagatccagaagcagaagatctgcggcagcctgaccctgcagcaccacatgctggagcccgtgcagagaatccccagatacgagatgctgctgaaggactacctgagaaagctgccccccgacagcctggactggaacgacgccaagaagagcctggagatcatcagcaccgccgccagccacagcaacagcgccatcagaaagatggagaacctgaagaagctgctggagatctacgagatgctgggcgaggaggaggacatcgtgaaccccagcaacgagctgatcaaggagggccagatcctgaagctggccgccagaaacaccagcgcccaggagagatacctgttcctgttcaacaacatgctgctgtactgcgtgcccaagttcagcctggtgggcagcaagttcaccgtgagaaccagagtgggcatcgacggcatgaagatcgtggagacccagaacgaggagtacccccacaccttccaggtgagcggcaaggagagaaccctggagctgcaggccagcagcgcccaggacaaggaggagtggatcaaggccctgcaggagaccatcgacgccttccaccagagacacgagaccttcagaaacgccatcgccaaggacaacgacatccacagcgaggtgagcaccgccgagctgggcaagagagcccccagatggatcagagacaacgaggtgaccatgtgcatgaagtgcaaggagcccttcaacgccctgaccagaagaagacaccactgcagagcctgcggctacgtggtgtgctggaagtgcagcgactacaaggcccagctggagtacgacggcggcaagctgagcaaggtgtgcaaggactgctaccagatcatcagcggcttcaccgacagcgaggagaagaagagaaagggcatcctggagatcgagagcgccgaggtgagcggcaacagcgtggtgtgcagcttcctgcagtacatggagaagagcaagccctggcagaaggcctggtgcgtgatccccaagcaggaccccctggtgctgtacatgtacggcgccccccaggacgtgagagcccaggccaccatccccctgctgggctacgtggtggacgagatgcccagaagcgccgacctgccccacagcttcaagctgacccagagcaagagcgtgcacagcttcgccgccgacagcgaggagctgaagcagaagtggctgaaggtgatcctgctggccgtgaccggcgagacccccggcggccccaacgagcaccccgccaccctggacgaccaccccgagcccaagaagaagagcgagtgctag

SEQ ID NO: 82247 - DNA, 2712 bp, Artificial Sequence
  Description of Artificial Sequence: Synthetic coding sequence
atgagcgacgagggcggcagcaacttcagaagagtggccatcagaagaaagagcaaccccagctacctgccccccggcgtgcccagaccctggagcagacccgccagccacctgggcagagtgggcaccgccgccttcaagggccaggtgcccagcggcgccaccggcagcagcacctgccccaagatcgccctggtgcccccctgcagcaccagcagcaccaccaccctggtgggcgagaacgtgagcgaggaggaggcccagggcatcaacggcaacagacccgccaagcacagcgccgccagccccaagccccaggtgccccccaagcccctgcacctgcagaacagccccagcagcaacatccaccagacccccagacacaaggccctgcccagcgccaagcccagaatggaggagatcaagcccgccagcgccagctgcgtgagcaaggagaagcccagcaaggtgagcgacctgatcagcagattcgagggcggcagcagcctgagcaactacagcgacctgaagaaggagagcgccgtgaacctgaacgcccccagaacccccggcagacacggcctgaccaccaccccccagcagaagctgctgagccagcacctgccccagagacagggcaacgacaccgacaagacccagggcgcccagacctgcgtggccaacggcgtgatggccgcccagaaccagatggagtgcgaggaggagaaggccgccaccctgagcagcgacaccagcatccaggccagcgagcccctgctggacacccacatcgtgaacggcgagagagacgagaccgccaccgcccccgccagccccaccaccgacagctgcgacggcaacgccagcgacagcagctacagaacccccggcatcggccccgtgctgcccctggaggagagaggcgccgagaccgagaccaaggtgcaggagagagagaacggcgagagccccctggagctggagcagctggaccagcaccacgagatgaaggagaccaacgagcagaagctgcacaagatcgccaacgagctgctgctgaccgagagagcctacgtgaacagactggacctgctggaccaggtgttctactgcaagctgctggaggaggccaacagaggcagcttccccgccgagatggtgaacaagatcttcagcaacatcagcagcatcaacgccttccacagcaagttcctgctgcccgagctggagaagagaatgcaggagtgggagaccacccccagaatcggcgacatcctgcagaagctggcccccttcctgaagatgtacggcgagtacgtgaagggcttcgacaacgccatggagctggtgaagaacatgaccgagagaatcccccagttcaagagcgtggtggaggagatccagaagcagaagatctgcggcagcctgaccctgcagcaccacatgctggagcccgtgcagagaatccccagatacgagatgctgctgaaggactacctgagaaagctgccccccgacagcctggactggaacgacgccaagaagagcctggagatcatcagcaccgccgccagccacagcaacagcgccatcagaaagatggagaacctgaagaagctgctggagatctacgagatgctgggcgaggaggaggacatcgtgaaccccagcaacgagctgatcaaggagggccagatcctgaagctggccgccagaaacaccagcgcccaggagagatacctgttcctgttcaacaacatgctgctgtactgcgtgcccaagttcagcctggtgggcagcaagttcaccgtgagaaccagagtgggcatcgacggcatgaagatcgtggagacccagaacgaggagtacccccacaccttccaggtgagcggcaaggagagaaccctggagctgcaggccagcagcgcccaggacaaggaggagtggatcaaggccctgcaggagaccatcgacgccttccaccagagacacgagaccttcagaaacgccatcgccaaggacaacgacatccacagcgaggtgagcaccgccgagctgggcaagagagcccccagatggatcagagacaacgaggtgaccatgtgcatgaagtgcaaggagcccttcaacgccctgaccagaagaagacaccactgcagagcctgcggctacgtggtgtgctggaagtgcagcgactacaaggcccagctggagtacgacggcggcaagctgagcaaggtgtgcaaggactgctaccagatcatcagcggcttcaccgacagcgaggagaagaagagaaagggcatcctggagatcgagagcgccgaggtgagcggcaacagcgtggtgtgcagcttcctgcagtacatggagaagagcaagccctggcagaaggcctggtgcgtgatccccaagcaggaccccctggtgctgtacatgtacggcgccccccaggacgtgagagcccaggccaccatccccctgctgggctacgtggtggacgagatgcccagaagcgccgacctgccccacagcttcaagctgacccagagcaagagcgtgcacagcttcgccgccgacagcgaggagctgaagcagaagtggctgaaggtgatcctgctggccgtgaccggcgagacccccggcggccccaacgagcaccccgccaccctggacgaccaccccgagcccaagaagaagagcgagtgctag

SEQ ID NO: 82248 - DNA, 420 bp, Artificial Sequence
  Description of Artificial Sequence: Synthetic coding sequence
atgagctggagaggcagaagcacctactactggcccagacccagaagatacgtgcagccccccgagatgatcggccccatgagacccgagcagttcagcgacgaggtggagcccgccacccccgaggagggcgagcccgccacccagagacaggaccccgccgccgcccaggagggcgaggacgagggcgccagcgccggccagggccccaagcccgaggccgacagccaggagcagggccacccccagaccggctgcgagtgcgaggacggccccgacggccaggagatggacccccccaaccccgaggaggtgaagacccccgaggaggagatgagaagccactacgtggcccagaccggcatcctgtggctgctgatgaacaactgcttcctgaacctgagccccagaaagccctag

SEQ ID NO: 82249 - DNA, 351 bp, Artificial Sequence
  Description of Artificial Sequence: Synthetic coding sequence
atgagctggagaggcagaagcacctacagaagcagacccagactgtacgtggagccccccgagatgatcggccccatgctgcccgagcagttcagcgacgaggtggagcccgccacccccgaggagggcgagcccgccacccagagacaggaccccgccgccgcccaggagggcgaggacgagggcgccagcgccggccagggccccaagcccgaggccgacagccaggagcaggtgcaccccaagaccggctgcgagtgcggcgacggccccgacggccaggagatgggcctgcccaaccccgaggaggtgaagagacccgaggagggcgagaagcagagccagtgctag

SEQ ID NO: 82250 - DNA, 354 bp, Artificial Sequence
  Description of Artificial Sequence: Synthetic coding sequence
atgagctggagaggcagaagcacctactactggcccagacccagaagatacgtgcagccccccgagatgatcggccccatgagacccgagcagttcagcgacgaggtggagcccgccacccccgaggagggcgagcccgccacccagtgccaggaccccgccgccgcccaggagggcgaggacgagggcgccagcgccggccagggccccaagcccgaggcccacagccaggagcagggccacccccagaccggctgcgagtgcgaggacggccccgacggccaggagatggacccccccaaccccgaggaggtgaagacccccgaggagggcgagaagcagagccagtgctag

SEQ ID NO: 82251 - DNA, 354 bp, Artificial Sequence; identical to SEQ ID NO: 82250
  Description of Artificial Sequence: Synthetic coding sequence

SEQ ID NO: 82252 - DNA, 354 bp, Artificial Sequence; identical to SEQ ID NO: 82250
  Description of Artificial Sequence: Synthetic coding sequence

SEQ ID NO: 82253 - DNA, 354 bp, Artificial Sequence
  Description of Artificial Sequence: Synthetic coding sequence
atgagctggagaggcagaagcacctactactggcccagacccagaagatacgtgcagccccccgagatgatcggccccatgagacccgagcagttcagcgacgaggtggagcccgccacccccgaggagggcgagcccgccacccagagacaggaccccgccgccgcccaggagggcgaggacgagggcgccagcgccggccagggccccaagcccgaggcccacagccaggagcagggccacccccagaccggctgcgagtgcgaggacggccccgacggccaggagatggacccccccaaccccgaggaggtgaagacccccgaggagggcgagaagcagagccagtgctag

SEQ ID NO: 82254 - DNA, 354 bp, Artificial Sequence; identical to SEQ ID NO: 82253
  Description of Artificial Sequence: Synthetic coding sequence

SEQ ID NO: 82255 - DNA, 354 bp, Artificial Sequence
  Description of Artificial Sequence: Synthetic coding sequence
atgagctggagaggcagaagcacctactactggcccagacccagaagatacgtgcagccccccgagatgatcggccccatgagacccgagcagttcagcgacgaggtggagcccgccacccccgaggagggcgagcccgccacccagtgccaggaccccgccgccgcccagaagggcgaggacgagggcgccagcgccggccagggccccaagcccgaggcccacagccaggagcagggccacccccagaccggctgcgagtgcgaggacggccccgacggccaggagatggacccccccaaccccgaggaggtgaagacccccgaggagggcgagaagcagagccagtgctag

SEQ ID NO: 82256 - DNA, 354 bp, Artificial Sequence
  Description of Artificial Sequence: Synthetic coding sequence
atgagctggagaggcagaagcacctactactggcccagacccagaccctacgtgcagccccccgagatgatcggccccatgagacccgagcagttcagcgacgaggtggagcccgccacccccgaggagggcgagcccgccacccagagacaggaccccgccgccgcccaggagggcgaggacgagggcgccagcgccggccagggccccaagcccgaggccgacagccaggagcagggccacccccagaccggctgcgagtgcgaggacggccccgacggccaggagatggacccccccaaccccgaggaggtgaagacccccgaggagggcaagaagcagagccagtgctag

SEQ ID NO: 82257 - DNA, 354 bp, Artificial Sequence
  Description of Artificial Sequence: Synthetic coding sequence
atgagctggagaggcagaagcacctactacagacccagacccagaagatacgtggagccccccgagatgatcggccccatgagacccgagcagttcagcgacgaggtggagcccgccacccccgaggagggcgagcccgccacccagtgccaggaccccgccgccgcccaggagggcgaggacgagggcgccagcgccggccagggccccaagcccgaggccgacagccaggagcagggccacccccagaccggctgcgagtgcgaggacggccccgacggccaggagatggacccccccaaccccgaggaggtgaagacccccgaggagggcaagaagcagagccagtgctag

SEQ ID NO: 82258 - DNA, 351 bp, Artificial Sequence
  Description of Artificial Sequence: Synthetic coding sequence
atgagctggagaggcagaagcacctacagacccagacccagaagatacgtggagccccccgagatgatcggccccatgagacccgagcagttcagcgacgaggtggagcccgccacccccgaggagggcgagcccgccacccagagacaggaccccgccgccgcccaggagggccaggacgagggcgccagcgccggccagggccccaagcccgaggcccacagccaggagcagggccacccccagaccggctgcgagtgcgaggacggccccgacggccaggagatggacccccccaaccccgaggaggtgaagacccccgaggagggcgagaagcagagccagtgctag

SEQ ID NO: 82259 - DNA, 351 bp, Artificial Sequence
  Description of Artificial Sequence: Synthetic coding sequence
atgagctggagaggcagaagcacctacagacccagacccagaagatacgtggagccccccgagatgatcggccccatgagacccgagcagttcagcgacgaggtggagcccgccacccccgaggagggcgagcccgccacccagagacaggaccccgccgccgcccaggagggcgaggacgagggcgccagcgccggccagggccccaagcccgaggcccacagccaggagcagggccacccccagaccggctgcgagtgcgaggacggccccgacggccaggagatggacccccccaaccccgaggaggtgaagacccccgaggagggcgagaagcagagccagtgctag

SEQ ID NO: 82260 - DNA, 351 bp, Artificial Sequence; identical to SEQ ID NO: 82259
  Description of Artificial Sequence: Synthetic coding sequence

SEQ ID NO: 82261 - DNA, 351 bp, Artificial Sequence
  Description of Artificial Sequence: Synthetic coding sequence
atgagctggagaggcagaagcacctacagacccagacccagaagatacgtggagccccccgagatgatcggccccatgagacccgagcagttcagcgacgaggtggagcccgccacccccgaggagggcgagcccgccacccagagacaggaccccgccgccgcccaggagggcgaggacgagggcgccagcgccggccagggccccaagcccgaggccgacagccaggagcagggccacccccagaccggctgcgagtgcgaggacggccccgacggccaggagatggacccccccaaccccgaggaggtgaagacccccgaggagggcgagaagcagagccagtgctag

SEQ ID NO: 82262 - DNA, 351 bp, Artificial Sequence
  Description of Artificial Sequence: Synthetic coding sequence
atgagctggagaggcagaagcacctacagacccagacccagaagatacgtggagccccccgagatgatcggccccatgagacccgagcagttcagcgacgaggtggagcccgccacccccgaggagggcgagcccgccacccagagacaggaccccgccgccgcccaggagggcgaggacgagggcgccagcgccggccagggccccaagcccgaggccgacagccaggagcagggccacccccagaccggctgcgagtgcgaggacggccccgacggccaggagatggacccccccaaccccgaggaggtgaagacccccgaggagggcaagaagcagagccagtgctag

SEQ ID NO: 82263 - DNA, 435 bp, Artificial Sequence
  Description of Artificial Sequence: Synthetic coding sequence
atgttcctggaggagaagatccccagcatcagcgacctgaagctggccatcagaagagccaccctgaagagaagcttcacccccgtgttcctgggcagcgccctgaagaacaagggcgtgcagcccctgctggacgccgtgctggagtacctgcccaaccccagcgaggtgcagaactacgccatcctgaacaaggaggacgacagcaaggagaagaccaagatcctgatgaacagcagcagagacaacagccaccccttcgtgggcctggccttcaagctggagttcctgagcagaagcttcttcagactgaccagacagaaggaccacagaagacccatccagagaaccaccctgtacctgatcgtgatgagcccctacgacctgctgggctgcaacagcttcctggacttcccctgcttcagcagagactag

SEQ ID NO: 82264 - DNA, 2256 bp, Artificial Sequence
  Description of Artificial Sequence: Synthetic coding sequence
atgagactgctgggcgccgccgccgtggccgccctgggcagaggcagagcccccgccagcctgggctggcagagaaagcaggtgaactggaaggcctgcagatggagcagcagcggcgtgatccccaacgagaagatcagaaacatcggcatcagcgcccacatcgacagcggcaagaccaccctgaccgagagagtgctgtactacaccggcagaatcgccaagatgcacgaggtgaagggcaaggacggcgtgggcgccgtgatggacagcatggagctggagagacagagaggcatcaccatccagagcgccgccacctacaccatgtggaaggacgtgaacatcaacatcatcgacacccccggccacgtggacttcaccatcgaggtggagagagccctgagagtgctggacggcgccgtgctggtgctgtgcgccgtgggcggcgtgcagtgccagaccatgaccgtgaacagacagatgaagagatacaacgtgcccttcctgaccttcatcaacaagctggacagaatgggcagcaaccccgccagagccctgcagcagatgagaagcaagctgaaccacaacgccgccttcatgcagatccccatgggcctggagggcaacttcaagggcatcgtggacctgatcgaggagagagccatctacttcgacggcgacttcggccagatcgtgagatacggcgagatccccgccgagctgagagccgccgccaccgaccacagacaggagctgatcgagtgcgtggccaacagcgacgagcagctgggcgagatgttcctggaggagaagatccccagcatcagcgacctgaagctggccatcagaagagccaccctgaagagaagcttcacccccgtgttcctgggcagcgccctgaagaacaagggcgtgcagcccctgctggacgccgtgctggagtacctgcccaaccccagcgaggtgcagaactacgccatcctgaacaaggaggacgacagcaaggagaagaccaagatcctgatgaacagcagcagagacaacagccaccccttcgtgggcctggccttcaagctggaggtgggcagattcggccagctgacctacgtgagaagctaccagggcgagctgaagaagggcgacaccatctacaacaccagaaccagaaagaaggtgagactgcagagactggccagaatgcacgccgacatgatggaggacgtggaggaggtgtacgccggcgacatctgcgccctgttcggcatcgactgcgccagcggcgacaccttcaccgacaaggccaacagcggcctgagcatggagagcatccacgtgcccgaccccgtgatcagcatcgccatgaagcccagcaacaagaacgacctggagaagttcagcaagggcatcggcagattcaccagagaggaccccaccttcaaggtgtacttcgacaccgagaacaaggagaccgtgatcagcggcatgggcgagctgcacctggagatctacgcccagagactggagagagagtacggctgcccctgcatcaccggcaagcccaaggtggccttcagagagaccatcaccgcccccgtgcccttcgacttcacccacaagaagcagagcggcggcgccggccagtacggcaaggtgatcggcgtgctggagcccctggaccccgaggactacaccaagctggagttcagcgacgagaccttcggcagcaacatccccaagcagttcgtgcccgccgtggagaagggcttcctggacgcctgcgagaagggccccctgagcggccacaagctgagcggcctgagattcgtgctgcaggacggcgcccaccacatggtggacagcaacgagatcagcttcatcagagccggcgagggcgccctgaagcaggccctggccaacgccaccctgtgcatcctggagcccatcatggccgtggaggtggtggcccccaacgagttccagggccaggtgatcgccggcatcaacagaagacacggcgtgatcaccggccaggacggcgtggaggactacttcaccctgtacgccgacgtgcccctgaacgacatgttcggctacagcaccgagctgagaagctgcaccgagggcaagggcgagtacaccatggagtacagcagataccagccctgcctgcccagcacccaggaggacgtgatcaacaagtacctggaggccaccggccagctgcccgtgaagaagggcaaggccaagaactag

SEQ ID NO: 82265 - DNA, 459 bp, Artificial Sequence
  Description of Artificial Sequence: Synthetic coding sequence
atgagcctggtgatccccgagaagttccagcacatcctgagagtgctgaacaccaacatcgacggcagaagaaagatcgccttcgccatcaccgccatcaagggcgtgggcagaagatacgcccacgtggtgctgagaaaggccgacatcgacctgaccaagagagccggcgagctgaccgaggacgaggtggagagagtgatcaccatcatgcagaaccccagacagtacaagatccccgactggttcctgaacagacagaaggacgtgaaggacggcaagtacagccaggtgctggccaacggcctggacaacaagctgagagaggacctggagagactgaagaagatcagagcccacagaggcctgagacacttctggggcctgagagtgagaggccagcacaccaagaccaccggcagaagaggcagaaccgtgggcgtgagcaagaagaagtag

SEQ ID NO: 82266 - DNA, 1071 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccagagccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagagccggccagggcgccgccgtgagctacctgctgggcagaggcgccgcctgggtgggcgtgtgcgagctgagcggcagagacgccgcccagctggccgaggaggccggcttccccgaggtggccagaatggtgagagagagccacggcgagaccagaagccccgagaacagaagccccacccccagcctgcagtactgcgagaactgcgacacccacttccaggacagcaaccacagaaccagcaccgcccacctgctgagcctgagccagggcccccagccccccaacctgcccctgggcgtgcccatcagcagccccggcttcaagctgctgctgagaggcggctgggagcccggcatgggcctgggccccagaggcgagggcagagccaaccccatccccaccgtgctgaagagagaccaggagggcctgggctacagaagcgccccccagcccagagtgacccacttccccgcctgggacaccagagccgtggccggcagagagagaccccccagagtggccaccctgagctggagagaggagagaagaagagaggagaaggacagagcctgggagagagacctgagaacctacatgaacctggagttctag

SEQ ID NO: 82267 - DNA, 1071 bp, Artificial Sequence; identical to SEQ ID NO: 82266
  Description of Artificial Sequence: Synthetic coding sequence

SEQ ID NO: 82268 - DNA, 1071 bp, Artificial Sequence; identical to SEQ ID NO: 82266
  Description of Artificial Sequence: Synthetic coding sequence

SEQ ID NO: 82269 - DNA, 1071 bp, Artificial Sequence; identical to SEQ ID NO: 82266
  Description of Artificial Sequence: Synthetic coding sequence

SEQ ID NO: 82270 - DNA, 1071 bp, Artificial Sequence; identical to SEQ ID NO: 82266
  Description of Artificial Sequence: Synthetic coding sequence

SEQ ID NO: 82271 - DNA, 1071 bp, Artificial Sequence; identical to SEQ ID NO: 74103
  Description of Artificial Sequence: Synthetic coding sequence

SEQ ID NO: 82272 - DNA, 1071 bp, Artificial Sequence; identical to SEQ ID NO: 74103
  Description of Artificial Sequence: Synthetic coding sequence

SEQ ID NO: 82273 - DNA, 1071 bp, Artificial Sequence; identical to SEQ ID NO: 74103
  Description of Artificial Sequence: Synthetic coding sequence

SEQ ID NO: 82274 - DNA, 1071 bp, Artificial Sequence; identical to SEQ ID NO: 74103
  Description of Artificial Sequence: Synthetic coding sequence

SEQ ID NO: 82275 - DNA, 1071 bp, Artificial Sequence; identical to SEQ ID NO: 74103
  Description of Artificial Sequence: Synthetic coding sequence

SEQ ID NO: 82276 - DNA, 498 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccagagccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagagccggccagggcgccgccgtgagctacctgctgggcagatag

SEQ ID NO: 82277 - DNA, 459 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccctggccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagatag

SEQ ID NO: 82278 - DNA, 1071 bp, Artificial Sequence; identical to SEQ ID NO: 74103
  Description of Artificial Sequence: Synthetic coding sequence

SEQ ID NO: 82279 - DNA, 459 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccagagccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagatag

SEQ ID NO: 82280 - DNA, 498 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccctggccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagagccggccagggcgccgccgtgagctacctgctgggcagatag

SEQ ID NO: 82281 - DNA, 273 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccctggccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggctag

SEQ ID NO: 82282 - DNA, 1071 bp, Artificial Sequence; identical to SEQ ID NO: 82266
  Description of Artificial Sequence: Synthetic coding sequence

SEQ ID NO: 82283 - DNA, 1071 bp, Artificial Sequence; identical to SEQ ID NO: 82266
  Description of Artificial Sequence: Synthetic coding sequence

SEQ ID NO: 82284 - DNA, 324 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccagagccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagatag

SEQ ID NO: 82285 - DNA, 324 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccctggccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagatag

SEQ ID NO: 82286 - DNA, 1071 bp, Artificial Sequence; identical to SEQ ID NO: 82266
  Description of Artificial Sequence: Synthetic coding sequence

SEQ ID NO: 82287 - DNA, 1071 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccagagccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagagccggccagggcgccgccgtgagctacctgctgggcagaggcgccgcctgggtgggcgtgtgcgagctgagcggcagagacgccgcccagctggccgaggaggccggcttccccgaggtggccagaatggtgagagagagccacggcgagaccagaagccccgagaacagaagccccacccccagcctgcagtactgcgagaactgcgacacccacttccaggacagcaaccacagaaccagcaccgcccacctgctgagcctgagccagggcccccagccccccaacctgcccctgggcgtgcccatcagcagccccggcttcaagctgctgctgagaagaggctgggagcccggcatgggcctgggccccagaggcgagggcagagccaaccccatccccaccgtgctgaagagagaccaggagggcctgggctacagaagcgccccccagcccagagtgacccacttccccgcctgggacaccagagccgtggccggcagagagagaccccccagagtggccaccctgagctggagagaggagagaagaagagaggagaaggacagagcctgggagagagacctgagaacctacatgaacctggagttctag

SEQ ID NO: 82288 - DNA, 1071 bp, Artificial Sequence; identical to SEQ ID NO: 82287
  Description of Artificial Sequence: Synthetic coding sequence

SEQ ID NO: 82289 - DNA, 498 bp, Artificial Sequence; identical to SEQ ID NO: 82276
  Description of Artificial Sequence: Synthetic coding sequence

SEQ ID NO: 82290 - DNA, 1071 bp, Artificial Sequence; identical to SEQ ID NO: 82266
  Description of Artificial Sequence: Synthetic coding sequence

SEQ ID NO: 82291 - DNA, 597 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccagagccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagagccggccagggcgccgccgtgagctacctgctgggcagaggcgccgcctgggtgggcgtgtgcgagctgagcggcagagacgccgcccagctggccgaggaggccggcttccccgaggtggccagaatggtgagagagtag

SEQ ID NO: 82292 - DNA, 1071 bp, Artificial Sequence; identical to SEQ ID NO: 82287
  Description of Artificial Sequence: Synthetic coding sequence

SEQ ID NO: 82293 - DNA, 498 bp, Artificial Sequence; identical to SEQ ID NO: 82280
  Description of Artificial Sequence: Synthetic coding sequence

SEQ ID NO: 82294 - DNA, 459 bp, Artificial Sequence; identical to SEQ ID NO: 82277
  Description of Artificial Sequence: Synthetic coding sequence

SEQ ID NO: 82295 - DNA, 459 bp, Artificial Sequence; identical to SEQ ID NO: 82277
  Description of Artificial Sequence: Synthetic coding sequence

SEQ ID NO: 82296 - DNA, 597 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccctggccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagagccggccagggcgccgccgtgagctacctgctgggcagaggcgccgcctgggtgggcgtgtgcgagctgagcggcagagacgccgcccagctggccgaggaggccggcttccccgaggtggccagaatggtgagagagtag

SEQ ID NO: 82297 - DNA, 597 bp, Artificial Sequence; identical to SEQ ID NO: 82296
  Description of Artificial Sequence: Synthetic coding sequence

SEQ ID NO: 82298 - DNA, 1071 bp, Artificial Sequence; identical to SEQ ID NO: 82287
  Description of Artificial Sequence: Synthetic coding sequence

SEQ ID NO: 82299 - DNA, 1071 bp, Artificial Sequence; identical to SEQ ID NO: 74103
  Description of Artificial Sequence: Synthetic coding sequence

SEQ ID NO: 82300 - DNA, 597 bp, Artificial Sequence; identical to SEQ ID NO: 82296
  Description of Artificial Sequence: Synthetic coding sequence

SEQ ID NO: 82301 - DNA, 1071 bp, Artificial Sequence; identical to SEQ ID NO: 74103
  Description of Artificial Sequence: Synthetic coding sequence

SEQ ID NO: 82302 - DNA, 597 bp, Artificial Sequence; identical to SEQ ID NO: 82291
  Description of Artificial Sequence: Synthetic coding sequence

SEQ ID NO: 82303 - DNA, 1071 bp, Artificial Sequence; identical to SEQ ID NO: 82266
  Description of Artificial Sequence: Synthetic coding sequence

SEQ ID NO: 82304 - DNA, 324 bp, Artificial Sequence; identical to SEQ ID NO: 82284
  Description of Artificial Sequence: Synthetic coding sequence

SEQ ID NO: 82305 - DNA, 1071 bp, Artificial Sequence; identical to SEQ ID NO: 82287
  Description of Artificial Sequence: Synthetic coding sequence

SEQ ID NO: 82306 - DNA, 324 bp, Artificial Sequence; identical to SEQ ID NO: 82284
  Description of Artificial Sequence: Synthetic coding sequence

SEQ ID NO: 82307 - DNA, 459 bp, Artificial Sequence; identical to SEQ ID NO: 82279
  Description of Artificial Sequence: Synthetic coding sequence

SEQ ID NO: 82308 - DNA, 1071 bp, Artificial Sequence; identical to SEQ ID NO: 74103
  Description of Artificial Sequence: Synthetic coding sequence

SEQ ID NO: 82309 - DNA, 1071 bp, Artificial Sequence; identical to SEQ ID NO: 74103
  Description of Artificial Sequence: Synthetic coding sequence

SEQ ID NO: 82310 - DNA, 498 bp, Artificial Sequence; identical to SEQ ID NO: 82276
  Description of Artificial Sequence: Synthetic coding sequence

SEQ ID NO: 82311 - DNA, 273 bp, Artificial Sequence; identical to SEQ ID NO: 82281
  Description of Artificial Sequence: Synthetic coding sequence

SEQ ID NO: 82312 - DNA, 1071 bp, Artificial Sequence; identical to SEQ ID NO: 82266
  Description of Artificial Sequence: Synthetic coding sequence

SEQ ID NO: 82313 - DNA, 273 bp, Artificial Sequence; identical to SEQ ID NO: 82281
  Description of Artificial Sequence: Synthetic coding sequence

SEQ ID NO: 82314 - DNA, 1071 bp, Artificial Sequence; identical to SEQ ID NO: 82266
  Description of Artificial Sequence: Synthetic coding sequence

SEQ ID NO: 82315 - DNA, 597 bp, Artificial Sequence; identical to SEQ ID NO: 82291
  Description of Artificial Sequence: Synthetic coding sequence

SEQ ID NO: 82316 - DNA, 324 bp, Artificial Sequence; identical to SEQ ID NO: 82285
  Description of Artificial Sequence: Synthetic coding sequence

SEQ ID NO: 82317 - DNA, 324 bp, Artificial Sequence; identical to SEQ ID NO: 82285
  Description of Artificial Sequence: Synthetic coding sequence

SEQ ID NO: 82318 - DNA, 273 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccagagccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggctag

SEQ ID NO: 82319 - DNA, 273 bp, Artificial Sequence; identical to SEQ ID NO: 82318
  Description of Artificial Sequence: Synthetic coding sequence

SEQ ID NO: 82320 - DNA, 459 bp, Artificial Sequence; identical to SEQ ID NO: 82279
  Description of Artificial Sequence: Synthetic coding sequence

SEQ ID NO: 82321 - DNA, 597 bp, Artificial Sequence; identical to SEQ ID NO: 82291
  Description of Artificial Sequence: Synthetic coding sequence

SEQ ID NO: 82322 - DNA, 1071 bp, Artificial Sequence; identical to SEQ ID NO: 74103
  Description of Artificial Sequence: Synthetic coding sequence

SEQ ID NO: 82323 - DNA, 1071 bp, Artificial Sequence; identical to SEQ ID NO: 82266
  Description of Artificial Sequence: Synthetic coding sequence

SEQ ID NO: 82324 - DNA, 1071 bp, Artificial Sequence; identical to SEQ ID NO: 82266
  Description of Artificial Sequence: Synthetic coding sequence

SEQ ID NO: 82325 - DNA, 498 bp, Artificial Sequence; identical to SEQ ID NO: 82280
  Description of Artificial Sequence: Synthetic coding sequence

SEQ ID NO: 82326 - DNA, 273 bp, Artificial Sequence; identical to SEQ ID NO: 82318
  Description of Artificial Sequence: Synthetic coding sequence

SEQ ID NO: 82327 - DNA, 324 bp, Artificial Sequence; identical to SEQ ID NO: 82284
  Description of Artificial Sequence: Synthetic coding sequence

SEQ ID NO: 82328 - DNA, 1071 bp, Artificial Sequence; identical to SEQ ID NO: 82266
  Description of Artificial Sequence: Synthetic coding sequence

SEQ ID NO: 82329 - DNA, 1071 bp, Artificial Sequence; identical to SEQ ID NO: 74103
  Description of Artificial Sequence: Synthetic coding sequence

SEQ ID NO: 82330 - DNA, 1071 bp, Artificial Sequence; identical to SEQ ID NO: 74103
  Description of Artificial Sequence: Synthetic coding sequence

SEQ ID NO: 82331 - DNA, 273 bp, Artificial Sequence; identical to SEQ ID NO: 82318
  Description of Artificial Sequence: Synthetic coding sequence

SEQ ID NO: 82332 - DNA, 1071 bp, Artificial Sequence; identical to SEQ ID NO: 74103
  Description of Artificial Sequence: Synthetic coding sequence

SEQ ID NO: 82333 - DNA, 498 bp, Artificial Sequence; identical to SEQ ID NO: 82276
  Description of Artificial Sequence: Synthetic coding sequence

SEQ ID NO: 82334 - DNA, 459 bp, Artificial Sequence; identical to SEQ ID NO: 82279
  Description of Artificial Sequence: Synthetic coding sequence

SEQ ID NO: 82335 - DNA, 4509 bp, Artificial Sequence
  Description of Artificial Sequence: Synthetic coding sequence
atggccgacagattcagcagattcaacgaggacagagacttccagggcaaccacttcgaccagtacgaggagggccacctggagatcgagcaggccagcctggacaagcccatcgagagcgacaacatcggccacagactgctgcagaagcacggctggaagctgggccagggcctgggcaagagcctgcagggcagaaccgaccccatccccatcgtggtgaagtacgacgtgatgggcatgggcagaatggagatggagctggactacgccgaggacgccaccgagagaagaagagtgctggaggtggagaaggaggacaccgaggagctgagacagaagtacaaggactacgtggacaaggagaaggccatcgccaaggccctggaggacctgagagccaacttctactgcgagctgtgcgacaagcagtaccagaagcaccaggagttcgacaaccacatcaacagctacgaccacgcccacaagcagagactgaaggacctgaagcagagagagttcgccagaaacgtgagcagcagaagcagaaaggacgagaagaagcaggagaaggccctgagaagactgcacgagctggccgagcagagaaagcaggccgagtgcgcccccggcagcggccccatgttcaagcccaccaccgtggccgtggacgaggagggcggcgaggacgacaaggacgagagcgccaccaacagcggcaccggcgccaccgccagctgcggcctgggcagcgagttcagcaccgacaagggcggccccttcaccgccgtgcagatcaccaacaccaccggcctggcccaggcccccggcctggccagccagggcatcagcttcggcatcaagaacaacctgggcacccccctgcagaagctgggcgtgagcttcagcttcgccaagaaggcccccgtgaagctggagagcatcgccagcgtgttcaaggaccacgccgaggagggcaccagcgaggacggcaccaagcccgacgagaagagcagcgaccagggcctgcagaaggtgggcgacagcgacggcagcagcaacctggacggcaagaaggaggacgaggacccccaggacggcggcagcctggccagcaccctgagcaagctgaagagaatgaagagagaggagggcgccggcgccaccgagcccgagtactaccactacatcccccccgcccactgcaaggtgaagcccaacttccccttcctgctgttcatgagagccagcgagcagatggacggcgacaacaccacccaccccaagaacgcccccgagagcaagaagggcagcagccccaagcccaagagctgcatcaaggccgccgccagccagggcgccgagaagaccgtgagcgaggtgagcgagcagcccaaggagaccagcatgaccgagcccagcgagcccggcagcaaggccgaggccaagaaggccctgggcggcgacgtgagcgaccagagcctggagagccacagccagaaggtgagcgagacccagatgtgcgagagcaacagcagcaaggagaccagcctggccacccccgccggcaaggagagccaggagggccccaagcaccccaccggccccttcttccccgtgctgagcaaggacgagagcaccgccctgcagtggcccagcgagctgctgatcttcaccaaggccgagcccagcatcagctacagctgcaaccccctgtacttcgacttcaagctgagcagaaacaaggacgccagaaccaagggcaccgagaagcccaaggacatcggcagcagcagcaaggaccacctgcagggcctggaccccggcgagcccaacaagagcaaggaggtgggcggcgagaagatcgtgagaagcagcggcggcagaatggacgcccccgccagcggcagcgcctgcagcggcctgaacaagcaggagcccggcggcagccacggcagcgagaccgaggacaccggcagaagcctgcccagcaagaaggagagaagcggcaagagccacagacacaagaagaagaagaagcacaagaagagcagcaagcacaagagaaagcacaaggccgacaccgaggagaagagcagcaaggccgagagcggcgagaagagcaagaagagaaagaagagaaagagaaagaagaacaagagcagcgcccccgccgacagcgagagaggccccaagcccgagccccccggcagcggcagccccgccccccccagaagaagaagaagagcccaggacgacagccagagaagaagcctgcccgccgaggagggcagcagcggcaagaaggacgagggcggcggcggcagcagcagccaggaccacggcggcagaaagcacaagggcgagctgccccccagcagctgccagagaagagccggcaccaagagaagcagcagaagcagccacagaagccagcccagcagcggcgacgaggacagcgacgacgccagcagccacagactgcaccagaagagccccagccagtacagcgaggaggaggaggaggaggacagcggcagcgagcacagcagaagcagaagcagaagcggcagaagacacagcagccacagaagcagcagaagaagctacagcagcagcagcgacgccagcagcgaccagagctgctacagcagacagagaagctacagcgacgacagctacagcgactacagcgacagaagcagaagacacagcaagagaagccacgacagcgacgacagcgactacgccagcagcaagcacagaagcaagagacacaagtacagcagcagcgacgacgactacagcctgagctgcagccagagcagaagcagaagcagaagccacaccagagagagaagcagaagcagaggcagaagcagaagcagcagctgcagcagaagcagaagcaagagaagaagcagaagcaccaccgcccacagctggcagagaagcagaagctacagcagagacagaagcagaagcaccagaagccccagccagagaagcggcagcagaaagagaagctggggccacgagagccccgaggagagacacagcggcagaagagacttcatcagaagcaagatctacagaagccagagcccccactacttcagaagcggcagaggcgagggccccggcaagaaggacgacggcagaggcgacgacagcaaggccaccggcccccccagccagaacagcaacatcggcaccggcagaggcagcgagggcgactgcagccccgaggacaagaacagcgtgaccgccaagctgctgctggagaagatccagagcagaaaggtggagagaaagcccagcgtgagcgaggaggtgcaggccacccccaacaaggccggccccaagctgaaggaccccccccagggctacttcggccccaagctgccccccagcctgggcaacaagcccgtgctgcccctgatcggcaagctgcccgccaccagaaagcccaacaagaagtgcgaggagagcggcctggagagaggcgaggagcaggagcagagcgagaccgaggagggcccccccggcagcagcgacgccctgttcggccaccagttccccagcgaggagaccaccggccccctgctggaccccccccccgaggagagcaagagcggcgaggccaccgccgaccaccccgtggcccccctgggcacccccgcccacagcgactgctaccccggcgaccccaccatcagccacaactacctgcccgaccccagcgacggcgacaccctggagagcctggacagcagcagccagcccggccccgtggagagcagcctgctgcccatcgcccccgacctggagcacttccccagctacgccccccccagcggcgaccccagcatcgagagcaccgacggcgccgaggacgccagcctggcccccctggagagccagcccatcaccttcacccccgaggagatggagaagtacagcaagctgcagcaggccgcccagcagcacatccagcagcagctgctggccaagcaggtgaaggccttccccgccagcgccgccctggcccccgccacccccgccctgcagcccatccacatccagcagcccgccaccgccagcgccaccagcatcaccaccgtgcagcacgccatcctgcagcaccacgccgccgccgccgccgccgccatcggcatccacccccacccccacccccagcccctggcccaggtgcaccacatcccccagccccacctgacccccatcagcctgagccacctgacccacagcatcatccccggccaccccgccaccttcctggccagccaccccatccacatcatccccgccagcgccatccaccccggccccttcaccttccaccccgtgccccacgccgccctgtaccccaccctgctggcccccagacccgccgccgccgccgccaccgccctgcacctgcaccccctgctgcaccccatcttcagcggccaggacctgcagcacccccccagccacggcacctag

SEQ ID NO: 82336 - DNA, 4275 bp, Artificial Sequence
  Description of Artificial Sequence: Synthetic coding sequence
atgggcatgggcagaatggagatggagctggactacgccgaggacgccaccgagagaagaagagtgctggaggtggagaaggaggacaccgaggagctgagacagaagtacaaggactacgtggacaaggagaaggccatcgccaaggccctggaggacctgagagccaacttctactgcgagctgtgcgacaagcagtaccagaagcaccaggagttcgacaaccacatcaacagctacgaccacgcccacaagcagagactgaaggacctgaagcagagagagttcgccagaaacgtgagcagcagaagcagaaaggacgagaagaagcaggagaaggccctgagaagactgcacgagctggccgagcagagaaagcaggccgagtgcgcccccggcagcggccccatgttcaagcccaccaccgtggccgtggacgaggagggcggcgaggacgacaaggacgagagcgccaccaacagcggcaccggcgccaccgccagctgcggcctgggcagcgagttcagcaccgacaagggcggccccttcaccgccgtgcagatcaccaacaccaccggcctggcccaggcccccggcctggccagccagggcatcagcttcggcatcaagaacaacctgggcacccccctgcagaagctgggcgtgagcttcagcttcgccaagaaggcccccgtgaagctggagagcatcgccagcgtgttcaaggaccacgccgaggagggcaccagcgaggacggcaccaagcccgacgagaagagcagcgaccagggcctgcagaaggtgggcgacagcgacggcagcagcaacctggacggcaagaaggaggacgaggacccccaggacggcggcagcctggccagcaccctgagcaagctgaagagaatgaagagagaggagggcgccggcgccaccgagcccgagtactaccactacatcccccccgcccactgcaaggtgaagcccaacttccccttcctgctgttcatgagagccagcgagcagatggacggcgacaacaccacccaccccaagaacgcccccgagagcaagaagggcagcagccccaagcccaagagctgcatcaaggccgccgccagccagggcgccgagaagaccgtgagcgaggtgagcgagcagcccaaggagaccagcatgaccgagcccagcgagcccggcagcaaggccgaggccaagaaggccctgggcggcgacgtgagcgaccagagcctggagagccacagccagaaggtgagcgagacccagatgtgcgagagcaacagcagcaaggagaccagcctggccacccccgccggcaaggagagccaggagggccccaagcaccccaccggccccttcttccccgtgctgagcaaggacgagagcaccgccctgcagtggcccagcgagctgctgatcttcaccaaggccgagcccagcatcagctacagctgcaaccccctgtacttcgacttcaagctgagcagaaacaaggacgccagaaccaagggcaccgagaagcccaaggacatcggcagcagcagcaaggaccacctgcagggcctggaccccggcgagcccaacaagagcaaggaggtgggcggcgagaagatcgtgagaagcagcggcggcagaatggacgcccccgccagcggcagcgcctgcagcggcctgaacaagcaggagcccggcggcagccacggcagcgagaccgaggacaccggcagaagcctgcccagcaagaaggagagaagcggcaagagccacagacacaagaagaagaagaagcacaagaagagcagcaagcacaagagaaagcacaaggccgacaccgaggagaagagcagcaaggccgagagcggcgagaagagcaagaagagaaagaagagaaagagaaagaagaacaagagcagcgcccccgccgacagcgagagaggccccaagcccgagccccccggcagcggcagccccgccccccccagaagaagaagaagagcccaggacgacagccagagaagaagcctgcccgccgaggagggcagcagcggcaagaaggacgagggcggcggcggcagcagcagccaggaccacggcggcagaaagcacaagggcgagctgccccccagcagctgccagagaagagccggcaccaagagaagcagcagaagcagccacagaagccagcccagcagcggcgacgaggacagcgacgacgccagcagccacagactgcaccagaagagccccagccagtacagcgaggaggaggaggaggaggacagcggcagcgagcacagcagaagcagaagcagaagcggcagaagacacagcagccacagaagcagcagaagaagctacagcagcagcagcgacgccagcagcgaccagagctgctacagcagacagagaagctacagcgacgacagctacagcgactacagcgacagaagcagaagacacagcaagagaagccacgacagcgacgacagcgactacgccagcagcaagcacagaagcaagagacacaagtacagcagcagcgacgacgactacagcctgagctgcagccagagcagaagcagaagcagaagccacaccagagagagaagcagaagcagaggcagaagcagaagcagcagctgcagcagaagcagaagcaagagaagaagcagaagcaccaccgcccacagctggcagagaagcagaagctacagcagagacagaagcagaagcaccagaagccccagccagagaagcggcagcagaaagagaagctggggccacgagagccccgaggagagacacagcggcagaagagacttcatcagaagcaagatctacagaagccagagcccccactacttcagaagcggcagaggcgagggccccggcaagaaggacgacggcagaggcgacgacagcaaggccaccggcccccccagccagaacagcaacatcggcaccggcagaggcagcgagggcgactgcagccccgaggacaagaacagcgtgaccgccaagctgctgctggagaagatccagagcagaaaggtggagagaaagcccagcgtgagcgaggaggtgcaggccacccccaacaaggccggccccaagctgaaggaccccccccagggctacttcggccccaagctgccccccagcctgggcaacaagcccgtgctgcccctgatcggcaagctgcccgccaccagaaagcccaacaagaagtgcgaggagagcggcctggagagaggcgaggagcaggagcagagcgagaccgaggagggcccccccggcagcagcgacgccctgttcggccaccagttccccagcgaggagaccaccggccccctgctggaccccccccccgaggagagcaagagcggcgaggccaccgccgaccaccccgtggcccccctgggcacccccgcccacagcgactgctaccccggcgaccccaccatcagccacaactacctgcccgaccccagcgacggcgacaccctggagagcctggacagcagcagccagcccggccccgtggagagcagcctgctgcccatcgcccccgacctggagcacttccccagctacgccccccccagcggcgaccccagcatcgagagcaccgacggcgccgaggacgccagcctggcccccctggagagccagcccatcaccttcacccccgaggagatggagaagtacagcaagctgcagcaggccgcccagcagcacatccagcagcagctgctggccaagcaggtgaaggccttccccgccagcgccgccctggcccccgccacccccgccctgcagcccatccacatccagcagcccgccaccgccagcgccaccagcatcaccaccgtgcagcacgccatcctgcagcaccacgccgccgccgccgccgccgccatcggcatccacccccacccccacccccagcccctggcccaggtgcaccacatcccccagccccacctgacccccatcagcctgagccacctgacccacagcatcatccccggccaccccgccaccttcctggccagccaccccatccacatcatccccgccagcgccatccaccccggccccttcaccttccaccccgtgccccacgccgccctgtaccccaccctgctggcccccagacccgccgccgccgccgccaccgccctgcacctgcaccccctgctgcaccccatcttcagcggccaggacctgcagcacccccccagccacggcacctag

SEQ ID NO: 82337 - DNA, 132 bp, Artificial Sequence
  Description of Artificial Sequence: Synthetic coding sequence
atggccgacagattcagcagattcaacgaggacagagacttccagggcaaccacttcgaccagtacgaggagggccacctggagatcgagcaggccagcctggacaagcccatcgagagcagctgcttctag

SEQ ID NO: 82338 - DNA, 4509 bp, Artificial Sequence; identical to SEQ ID NO: 82335
  Description of Artificial Sequence: Synthetic coding sequence

SEQ ID NO: 82339 - DNA, 1476 bp, Artificial Sequence
  Description of Artificial Sequence: Synthetic coding sequence
atgcccctgcccgtgcaggtgttcaacctgcagggcgccgtggagcccatgcagatcgacgtggacccccaggaggacccccagaacgcccccgacgtgaactacgtggtggagaaccccagcctggacctggagcagtacgccgccagctacagcggcctgatgagaatcgagagactgcagttcatcgccgaccactgccccaccctgagagtggaggccctgaagatggccctgagcttcgtgcagagaaccttcaacgtggacatgtacgaggagatccacagaaagctgagcgaggccaccagaagcagcctgagagagctgcagaacgcccccgacgccatccccgagagcggcgtggagccccccgccctggacaccgcctgggtggaggccaccagaaagaaggccctgctgaagctggagaagctggacaccgacctgaagaactacaagggcaacagcatcaaggagagcatcagaagaggccacgacgacctgggcgaccactacctggactgcggcgacctgagcaacgccctgaagtgctacagcagagccagagactactgcaccagcgccaagcacgtgatcaacatgtgcctgaacgtgatcaaggtgagcgtgtacctgcagaactggagccacgtgctgagctacgtgagcaaggccgagagcacccccgagatcgccgagcagagaggcgagagagacagccagacccaggccatcctgaccaagctgaagtgcgccgccggcctggccgagctggccgccagaaagtacaagcaggccgccaagtgcctgctgctggccagcttcgaccactgcgacttccccgagctgctgagccccagcaacgtggccatctacggcggcctgtgcgccctggccaccttcgacagacaggagctgcagagaaacgtgatcagcagcagcagcttcaagctgttcctggagctggagccccaggtgagagacatcatcttcaagttctacgagagcaagtacgccagctgcctgaagatgctggacgagatgaaggacaacctgctgctggacatgtacctggccccccacgtgagaaccctgtacacccagatcagaaacagagccctgatccagtacttcagcccctacgtgagcgccgacatgcacagaatggccgccgccttcaacaccaccgtggccgccctggaggacgagctgacccagctgatcctggagggcctgatcagcgccagagtggacagccacagcaagatcctgtacgccagagacgtggaccagagaagcaccaccttcgagaagagcctgctgatgggcaaggagttccagagaagagccaaggccatgatgctgagagccgccgtgctgagaaaccagatccacgtgaagagcccccccagagagggcagccagggcgagctgacccccgccaacagccagagcagaatgagcaccaacatgtag

SEQ ID NO: 82340 - DNA, 1653 bp, Artificial Sequence
  Description of Artificial Sequence: Synthetic coding sequence
atgcccctgcccgtgcaggtgttcaacctgcagcagcccgccagcagcgtgagcggcagcggcggcgccgagagccaggacagaatgagagacagcagcgcccccagcagcgccagcagcagcgtgaccgacctgtactgcaccccccacagcagcagaagcgacctggtgctgcccggcaccgccggcgacttcagcctgagcgccagcctgagcgcctgcaccctgctgtacgagggcgccgtggagcccatgcagatcgacgtggacccccaggaggacccccagaacgcccccgacgccatccccgagagcggcgtggagccccccgccctggacaccgcctgggtggaggccaccagaaagaaggccctgctgaagctggagaagctggacaccgacctgaagaactacaagggcaacagcatcaaggagagcatcagaagaggccacgacgacctgggcgaccactacctggactgcggcgacctgagcaacgccctgaagtgctacagcagagccagagactactgcaccagcgccaagcacgtgatcaacatgtgcctgaacgtgatcaaggtgagcgtgtacctgcagaactggagccacgtgctgagctacgtgagcaaggccgagagcacccccgagatcgccgagcagagaggcgagagagacagccagacccaggccatcctgaccaagctgaagtgcgccgccggcctggccgagctggccgccagaaagtacaagcaggccgccaagtgcctgctgctggccagcttcgaccactgcgacttccccgagctgctgagccccagcaacgtggccatctacggcggcctgtgcgccctggccaccttcgacagacaggagctgcagagaaacgtgatcagcagcagcagcttcaagctgttcctggagctggagccccaggtgagagacatcatcttcaagttctacgagagcaagtacgccagctgcctgaagatgctggacgagatgaaggacaacctgctgctggacatgtacctggccccccacgtgagaaccctgtacacccagatcagaaacagagccctgatccagtacttcagcccctacgtgagcgccgacatgcacagaatggccgccgccttcaacaccaccgtggccgccctggaggacgagctgacccagctgatcctggagggcctgatcagcgccagagtggacagccacagcaagatcctgtacgccagagacgtggaccagagaagcaccaccttcgagaagagcctgctgatgggcaaggagttccagagaagagccaaggccatgatgctgagagccgccgtgctgagaaaccagatccacgtgaagcccctgcccaccagcaccgacctgggcccccccggcggcagcgtgctgcccgccgcccagctgagaggcctggccaccggctgccaccccgcctgcgtgcccagcctgggcctgagaagacaggccgccgccagctgcggccccagctggaaggagagacccgccggcctggaccccgtgggcttctgcccccagggcgccgactgcgccgcccccagacccagcggcaccatcagccagaccccccccgtgcccgccagcgtgagatgcagacaggtgggcggcgtgcactag

SEQ ID NO: 82341 - DNA, 1584 bp, Artificial Sequence
  Description of Artificial Sequence: Synthetic coding sequence
atgagagacagcagcgcccccagcagcgccagcagcagcgtgaccgacctgtactgcaccccccacagcagcagaagcgacctggtgctgcccggcaccgccggcgacttcagcctgagcgccagcctgagcgcctgcaccctgctgtacgagggcgccgtggagcccatgcagatcgacgtggacccccaggaggacccccagaacgcccccgacgtgaactacgtggtggagaaccccagcctggacctggagcagtacgccgccagctacagcggcctgatgagaatcgagagactgcagttcatcgccgaccactgccccaccctgagagtggaggccctgaagatggccctgagcttcgtgcagagaaccttcaacgtggacatgtacgaggagatccacagaaagctgagcgaggccaccagagagctgcagaacgcccccgacgccatccccgagagcggcgtggagccccccgccctggacaccgcctgggtggaggccaccagaaagaaggccctgctgaagctggagaagctggacaccgacctgaagaactacaagggcaacagcatcaaggagagcatcagaagaggccacgacgacctgggcgaccactacctggactgcggcgacctgagcaacgccctgaagtgctacagcagagccagagactactgcaccagcgccaagcacgtgatcaacatgtgcctgaacgtgatcaaggtgagcgtgtacctgcagaactggagccacgtgctgagctacgtgagcaaggccgagagcacccccgagatcgccgagcagagaggcgagagagacagccagacccaggccatcctgaccaagctgaagtgcgccgccggcctggccgagctggccgccagaaagtacaagcaggccgccaagtgcctgctgctggccagcttcgaccactgcgacttccccgagctgctgagccccagcaacgtggccatctacggcggcctgtgcgccctggccaccttcgacagacaggagctgcagagaaacgtgatcagcagcagcagcttcaagctgttcctggagctggagccccaggtgagagacatcatcttcaagttctacgagagcaagtacgccagctgcctgaagatgctggacgagatgaaggacaacctgctgctggacatgtacctggccccccacgtgagaaccctgtacacccagatcagaaacagagccctgatccagtacttcagcccctacgtgagcgccgacatgcacagaatggccgccgccttcaacaccaccgtggccgccctggaggacgagctgacccagctgatcctggagggcctgatcagcgccagagtggacagccacagcaagatcctgtacgccagagacgtggaccagagaagcaccaccttcgagaagagcctgctgatgggcaaggagttccagagaagagccaaggccatgatgctgagagccgccgtgctgagaaaccagatccacgtgaagagcccccccagagagggcagccagggcgagctgacccccgccaacagccagagcagaatgagcaccaacatgtag

SEQ ID NO: 82342 - DNA, 855 bp, Artificial Sequence
  Description of Artificial Sequence: Synthetic coding sequence
ggccagcccgagatcggcggcttcctgcccagcagcctggcccccgtgaccgccgccatcctgatggccagaagcagcctgagagagctgcagaacgcccccgacgccatccccgagagcggcgtggagccccccgccctggacaccgcctgggtggaggccaccagaaagaaggccctgctgaagctggagaagctggacaccgacctgaagaactacaagggcaacagcatcaaggagagcatcagaagaggccacgacgacctgggcgaccactacctggactgcggcgacctgagcaacgccctgaagtgctacagcagagccagagactactgcaccagcgccaagcacgtgatcaacatgtgcctgaacgtgatcaaggtgagcgtgtacctgcagaactggagccacgtgctgagctacgtgagcaaggccgagagcacccccgagatcgccgaggtgagagccaccagcagcgagaccctgccccccggcttcctgaccaccgccggccccagctgccccccccccccccacagcccccccgacctgaacctgcccagcagccccctgagcctgggcgccggccacagagccctgggcaacgtggagcacggcccccacgcctgcggcttcctgctgcagcagagaggcgagagagacagccagacccaggccatcctgaccaagctgaagtgcgccgccggcgagggcctgggccacgcccagctgacccccagaagccccgtggccaagagcagccagcccagagccgtgggctggagcctgccccagcccggcaagaccagcctggccggcagaagaatgctgtgggcccacgtgcaggtgtag

SEQ ID NO: 82343 - DNA, 1584 bp, Artificial Sequence; identical to SEQ ID NO: 82341
  Description of Artificial Sequence: Synthetic coding sequence

SEQ ID NO: 82344 - DNA, 993 bp, Artificial Sequence
  Description of Artificial Sequence: Synthetic coding sequence
atgacccccaacagcaccggcgaggtgcccagccccatccccaagggcgccctgggcctgagcctggccctggccagcctgatcatcaccgccaacctgctgctggccctgggcatcgcctgggacagaagactgagaagcccccccgccggctgcttcttcctgagcctgctgctggccggcctgctgaccggcctggccctgcccaccctgcccggcctgtggaaccagagcagaagaggctactggagctgcctgctggtgtacctggcccccaacttcagcttcctgagcctgctggccaacctgctgctggtgcacggcgagagatacatggccgtgctgagacccctgcagccccccggcagcatcagactggccctgctgctgacctgggccggccccctgctgttcgccagcctgcccgccctgggctggaaccactggacccccggcgccaactgcagcagccaggccatcttccccgccccctacctgtacctggaggtgtacggcctgctgctgcccgccgtgggcgccgccgccttcctgagcgtgagagtgctggccaccgcccacagacagctgcaggacatctgcagactggagagagccgtgtgcagagacgagcccagcgccctggccagagccctgacctggagacaggccagagcccaggccggcgccatgctgctgttcggcctgtgctggggcccctacgtggccaccctgctgctgagcgtgctggcctacgagcagagaccccccctgggccccggcaccctgctgagcctgctgagcctgggcagcgccagcgccgccgccgtgcccgtggccatgggcctgggcgaccagagatacaccgccccctggagagccgccgcccagagatgcctgcagggcctgtggggcagagccagcagagacagccccggccccagcatcgcctaccaccccagcagccagagcagcgtggacctggacctgaactag

SEQ ID NO: 82345 - DNA, 993 bp, Artificial Sequence; identical to SEQ ID NO: 82344
  Description of Artificial Sequence: Synthetic coding sequence

SEQ ID NO: 82346 - DNA, 993 bp, Artificial Sequence; identical to SEQ ID NO: 82344
  Description of Artificial Sequence: Synthetic coding sequence

SEQ ID NO: 82347 - DNA, 993 bp, Artificial Sequence; identical to SEQ ID NO: 82344
  Description of Artificial Sequence: Synthetic coding sequence

SEQ ID NO: 82348 - DNA, 1128 bp, Artificial Sequence
  Description of Artificial Sequence: Synthetic coding sequence
atggacgtgaccagccaggccagaggcgtgggcctggagatgtaccccggcaccgcccagcccgccgcccccaacaccaccagccccgagctgaacctgagccaccccctgctgggcaccgccctggccaacggcaccggcgagctgagcgagcaccagcagtacgtgatcggcctgttcctgagctgcctgtacaccatcttcctgttccccatcggcttcgtgggcaacatcctgatcctggtggtgaacatcagcttcagagagaagatgaccatccccgacctgtacttcatcaacctggccgtggccgacctgatcctggtggccgacagcctgatcgaggtgttcaacctgcacgagagatactacgacatcgccgtgctgtgcaccttcatgagcctgttcctgcaggtgaacatgtacagcagcgtgttcttcctgacctggatgagcttcgacagatacatcgccctggccagagccatgagatgcagcctgttcagaaccaagcaccacgccagactgagctgcggcctgatctggatggccagcgtgagcgccaccctggtgcccttcaccgccgtgcacctgcagcacaccgacgaggcctgcttctgcttcgccgacgtgagagaggtgcagtggctggaggtgaccctgggcttcatcgtgcccttcgccatcatcggcctgtgctacagcctgatcgtgagagtgctggtgagagcccacagacacagaggcctgagacccagaagacagaaggccctgagaatgatcctggccgtggtgctggtgttcttcgtgtgctggctgcccgagaacgtgttcatcagcgtgcacctgctgcagagaacccagcccggcgccgccccctgcaagcagagcttcagacacgcccaccccctgaccggccacatcgtgaacctggccgccttcagcaacagctgcctgaaccccctgatctacagcttcctgggcgagaccttcagagacaagctgagactgtacatcgagcagaagaccaacctgcccgccctgaacagattctgccacgccgccctgaaggccgtgatccccgacagcaccgagcagagcgacgtgagattcagcagcgccgtgtag

SEQ ID NO: 82349 - DNA, 531 bp, Artificial Sequence
  Description of Artificial Sequence: Synthetic coding sequence
atgagcctgaactgcggccagatgtggctgctggcccccagaggcctggccagagtgaccctggcctggagcccctggggctgcctgggcaacctgaccaccggccacctggccctgctgacccagaactgctacaaccccaaggccctggccccccagggccccaaggccagcggcgaccagcccgtgacccagctgctgcccgccaaccccgcctgcagatgcacctgcctgcccctgcaggagaccttcctgagcgtgctgcacctgcccggctggcagcagtggagatgcgccgccagccccggccccagaggcgccgccgccctgggccccgagcagcaggagggccccagcgtggagagaccccccagcgcccccggctggttcagccactgcctgctgaccagcacctggcagctgcacagctgcggcctgggcccctgcgagctgccctgcggcctggtgggctgccaggacaacgagatcctgcagcacctgtggctgaccaacctgttcctgcagaagtag

SEQ ID NO: 82350 - DNA, 1128 bp, Artificial Sequence; identical to SEQ ID NO: 82348
  Description of Artificial Sequence: Synthetic coding sequence

SEQ ID NO: 82351 - DNA, 1128 bp, Artificial Sequence; identical to SEQ ID NO: 82348
  Description of Artificial Sequence: Synthetic coding sequence

SEQ ID NO: 82352 - DNA, 1128 bp, Artificial Sequence; identical to SEQ ID NO: 82348
  Description of Artificial Sequence: Synthetic coding sequence

SEQ ID NO: 82353 - DNA, 222 bp, Artificial Sequence
  Description of Artificial Sequence: Synthetic coding sequence
atggacgtgaccagccaggccagaggcgtgggcctggagatgtaccccggcaccgcccagcccgccgcccccaacaccaccagccccgagctgaacctgagccaccccctgctgggcaccgccctggccaacggcaccggcgagctgagcgagcaccagcagtacgtgatcggcctgttcctgagctgcctgtacaccatcttcctgttccccatcggctag

SEQ ID NO: 82354 - DNA, 1227 bp, Artificial Sequence
  Description of Artificial Sequence: Synthetic coding sequence
atggacgtgaccagccaggccagaggcgtgggcctggagatgtaccccggcaccgcccagcccgccgcccccaacaccaccagccccgagctgaacctgagccaccccctgctgggcaccgccctggccaacggcaccggcgagctgagcgagcaccagcagtacgtgatcggcctgttcctgagctgcctgtacaccatcttcctgttccccatcggcttcgtgggcaacatcctgatcctggtggtgaacatcagcttcagagagaagatgaccatccccgacctgtacttcatcaacctggccgtggccgacctgatcctggtggccgacagcctgatcgaggtgttcaacctgcacgagagatactacgacatcgccgtgctgtgcaccttcatgagcctgttcctgcaggtgaacatgtacagcagcgtgttcttcctgacctggatgagcttcgacagatacatcgccctggccagagccatgagatgcagcctgttcagaaccaagcaccacgccagactgagctgcggcctgatctggatggccagcgtgagcgccaccctggtgcccttcaccgccgtgcacctgcagcacaccgacgaggcctgcttctgcttcgccgacgtgagagaggtgcagtggctggaggtgaccctgggcttcatcgtgcccttcgccatcatcggcctgtgctacagcctgatcgtgagagtgctggtgagagcccacagacacagaggcctgagacccagaagacagaaggccctgagaatgatcctggccgtggtgctggtgttcttcgtgtgctggctgcccgagaacgtgttcatcagcgtgcacctgctgcagagaacccagcccggcgccgccccctgcaagcagagcttcagacacgcccaccccctgacccacggccacgtgatgagcctgaactgcggccagatgtggctgctggcccccagaggcctggccagagtgaccctggcctggagcccctggggctgcctgggcaacctgaccaccggccacctggccctgctgacccagaactgctacaaccccaaggccctggccccccagggccccaaggccagcggcgaccagcccgtgacccagctgctgcccgccaaccccgcctgcagatgcacctgcctgcccctgcaggagaccttcctgacccccagcaccagaaaggccaccagaagaggccactgcggctag

SEQ ID NO: 82355 - DNA, 1068 bp, Artificial Sequence
  Description of Artificial Sequence: Synthetic coding sequence
atggaggacctggaggagaccctgttcgaggagttcgagaactacagctacgacctggactactacagcctggagagcgacctggaggagaaggtgcagctgggcgtggtgcactgggtgagcctggtgctgtactgcctggccttcgtgctgggcatccccggcaacgccatcgtgatctggttcaccggcttcaagtggaagaagaccgtgaccaccctgtggttcctgaacctggccatcgccgacttcatcttcctgctgttcctgcccctgtacatcagctacgtggccatgaacttccactggcccttcggcatctggctgtgcaaggccaacagcttcaccgcccagctgaacatgttcgccagcgtgttcttcctgaccgtgatcagcctggaccactacatccacctgatccaccccgtgctgagccacagacacagaaccctgaagaacagcctgatcgtgatcatcttcatctggctgctggccagcctgatcggcggccccgccctgtacttcagagacaccgtggagttcaacaaccacaccctgtgctacaacaacttccagaagcacgaccccgacctgaccctgatcagacaccacgtgctgacctgggtgaagttcatcatcggctacctgttccccctgctgaccatgagcatctgctacctgtgcctgatcttcaaggtgaagaagagaagcatcctgatcagcagcagacacttctggaccatcctggtggtggtggtggccttcgtggtgtgctggaccccctaccacctgttcagcatctgggagctgaccatccaccacaacagctacagccaccacgtgatgcaggccggcatccccctgagcaccggcctggccttcctgaacagctgcctgaaccccatcctgtacgtgctgatcagcaagaagttccaggccagattcagaagcagcgtggccgagatcctgaagtacaccctgtgggaggtgagctgcagcggcaccgtgagcgagcagctgagaaacagcgagaccaagaacctgtgcctgctggagaccgcccagtag

SEQ ID NO: 82356 - DNA, 225 bp, Artificial Sequence
  Description of Artificial Sequence: Synthetic coding sequence
atggaggacctggaggagaccctgttcgaggagttcgagaactacagctacgacctggactactacagcctggagagcgacctggaggagaaggtgcagctgggcgtggtgcactgggtgagcctggtgctgtactgcctggccttcgtgctgggcatccccggcaacgccatcgtgatctggttcaccggcttcaagtggaagaagaccgtgaccaccctgtag

SEQ ID NO: 82357 - DNA, 1068 bp, Artificial Sequence; identical to SEQ ID NO: 82355
  Description of Artificial Sequence: Synthetic coding sequence

SEQ ID NO: 82358 - DNA, 249 bp, Artificial Sequence
  Description of Artificial Sequence: Synthetic coding sequence
atggaggacctggaggagaccctgttcgaggagttcgagaactacagctacgacctggactactacagcctggagagcgacctggaggagaaggtgcagctgggcgtggtgcactgggtgagcctggtgctgtactgcctggccttcgtgctgggcatccccggcaacgccatcgtgatctggttcaccggcttcaagtggaagaagaccgtgaccaccctgtggttcctgaacctggccatcgcctag

SEQ ID NO: 82359 - DNA, 684 bp, Artificial Sequence
  Description of Artificial Sequence: Synthetic coding sequence
atggaggacctggaggagaccctgttcgaggagttcgagaactacagctacgacctggactactacagcctggagagcgacctggaggagaaggtgcagctgggcgtggtgcactgggtgagcctggtgctgtactgcctggccttcgtgctgggcatccccggcaacgccatcgtgatctggttcaccggcttcaagtggaagaagaccgtgaccaccctgtggttcctgaacctggccatcgccgacttcatcttcctgctgttcctgcccctgtacatcagctacgtggccatgaacttccactggcccttcggcatctggctgtgcaaggccaacagcttcaccgcccagctgaacatgttcgccagcgtgttcttcctgaccgtgatcagcctggaccactacatccacctgatccaccccgtgctgagccacagacacagaaccctgaagaacagcctgatcgtgatcatcttcatctggctgctggccagcctgatcggcggccccgccctgtacttcagagacaccgtggagttcaacaaccacaccctgtgctacaacaacttccagaagcacgaccccgacctgaccctgatcagacaccacgtgctgacctgggtgaagttcatcatcggctacctgttccccctgctgaccatgagcatctgctacctgtag

SEQ ID NO: 82360 - DNA, 414 bp, Artificial Sequence
  Description of Artificial Sequence: Synthetic coding sequence
atggaggacctggaggagaccctgttcgaggagttcgagaactacagctacgacctggactactacagcctggagagcgacctggaggagaaggtgcagctgggcgtggtgcactgggtgagcctggtgctgtactgcctggccttcgtgctgggcatccccggcaacgccatcgtgatctggttcaccggcttcaagtggaagaagaccgtgaccaccctgtggttcctgaacctggccatcgccgacttcatcttcctgctgttcctgcccctgtacatcagctacgtggccatgaacttccactggcccttcggcatctggctgtgcaaggccaacagcttcaccgcccagctgaacatgttcgccagcgtgttcttcctgaccgtgatcagcctggaccactacatctag

SEQ ID NO: 82361 - DNA, 537 bp, Artificial Sequence
  Description of Artificial Sequence: Synthetic coding sequence
atggaggacctggaggagaccctgttcgaggagttcgagaactacagctacgacctggactactacagcctggagagcgacctggaggagaaggtgcagctgggcgtggtgcactgggtgagcctggtgctgtactgcctggccttcgtgctgggcatccccggcaacgccatcgtgatctggttcaccggcttcaagtggaagaagaccgtgaccaccctgtggttcctgaacctggccatcgccgacttcatcttcctgctgttcctgcccctgtacatcagctacgtggccatgaacttccactggcccttcggcatctggctgtgcaaggccaacagcttcaccgcccagctgaacatgttcgccagcgtgttcttcctgaccgtgatcagcctggaccactacatccacctgatccaccccgtgctgagccacagacacagaaccctgaagaacagcctgatcgtgatcatcttcatctggctgctggccagcctgatcggcggccccgccctgtacttcagagacacctag

SEQ ID NO: 82362 - DNA, 60 bp, Artificial Sequence
  Description of Artificial Sequence: Synthetic coding sequence
atggaggacctggaggagaccctgttcgaggagttcgagaactacagctacgacctgtag

SEQ ID NO: 82363 - DNA, 1527 bp, Artificial Sequence
  Description of Artificial Sequence: Synthetic coding sequence
atgaccagcacctgcaccaacagcaccagagagagcaacagcagccacacctgcatgcccctgagcaagatgcccatcagcctggcccacggcatcatcagaagcaccgtgctggtgatcttcctggccgccagcttcgtgggcaacatcgtgctggccctggtgctgcagagaaagccccagctgctgcaggtgaccaacagattcatcttcaacctgctggtgaccgacctgctgcagatcagcctggtggccccctgggtggtggccaccagcgtgcccctgttctggcccctgaacagccacttctgcaccgccctggtgagcctgacccacctgttcgccttcgccagcgtgaacaccatcgtggtggtgagcgtggacagatacctgagcatcatccaccccctgagctaccccagcaagatgacccagagaagaggctacctgctgctgtacggcacctggatcgtggccatcctgcagagcaccccccccctgtacggctggggccaggccgccttcgacgagagaaacgccctgtgcagcatgatctggggcgccagccccagctacaccatcctgagcgtggtgagcttcatcgtgatccccctgatcgtgatgatcgcctgctacagcgtggtgttctgcgccgccagaagacagcacgccctgctgtacaacgtgaagagacacagcctggaggtgagagtgaaggactgcgtggagaacgaggacgaggagggcgccgagaagaaggaggagttccaggacgagagcgagttcagaagacagcacgagggcgaggtgaaggccaaggagggcagaatggaggccaaggacggcagcctgaaggccaaggagggcagcaccggcaccagcgagagcagcgtggaggccagaggcagcgaggaggtgagagagagcagcaccgtggccagcgacggcagcatggagggcaaggagggcagcaccaaggtggaggagaacagcatgaaggccgacaagggcagaaccgaggtgaaccagtgcagcatcgacctgggcgaggacgacatggagttcggcgaggacgacatcaacttcagcgaggacgacgtggaggccgtgaacatccccgagagcctgccccccagcagaagaaacagcaacagcaacccccccctgcccagatgctaccagtgcaaggccgccaaggtgatcttcatcatcatcttcagctacgtgctgagcctgggcccctactgcttcctggccgtgctggccgtgtgggtggacgtggagacccaggtgccccagtgggtgatcaccatcatcatctggctgttcttcctgcagtgctgcatccacccctacgtgtacggctacatgcacaagaccatcaagaaggagatccaggacatgctgaagaagttcttctgcaaggagaagccccccaaggaggacagccaccccgacctgcccggcaccgagggcggcaccgagggcaagatcgtgcccagctacgacagcgccaccttcccctag

SEQ ID NO: 82364 - DNA, 2088 bp, Artificial Sequence
  Description of Artificial Sequence: Synthetic coding sequence
atgaagatgaagagccaggccaccatgatctgctgcctggtgttcttcctgagcaccgagtgcagccactacagaagcaagatccacctgaaggccggcgacaagctgcagagccccgagggcaagcccaagaccggcagaatccaggagaagtgcgagggcccctgcatcagcagcagcaactgcagccagccctgcgccaaggacttccacggcgagatcggcttcacctgcaaccagaagaagtggcagaagagcgccgagacctgcaccagcctgagcgtggagaagctgttcaaggacagcaccggcgccagcagactgagcgtggccgcccccagcatccccctgcacatcctggacttcagagcccccgagaccatcgagagcgtggcccagggcatcagaaagaactgccccttcgactacgcctgcatcaccgacatggtgaagagcagcgagaccaccagcggcaacatcgccttcatcgtggagctgctgaagaacatcagcaccgacctgagcgacaacgtgaccagagagaagatgaagagctacagcgaggtggccaaccacatcctggacaccgccgccatcagcaactgggccttcatccccaacaagaacgccagcagcgacctgctgcagagcgtgaacctgttcgccagacagctgcacatccacaacaacagcgagaacatcgtgaacgagctgttcatccagaccaagggcttccacatcaaccacaacaccagcgagaagagcctgaacttcagcatgagcatgaacaacaccaccgaggacatcctgggcatggtgcagatccccagacaggagctgagaaagctgtggcccaacgccagccaggccatcagcatcgccttccccaccctgggcgccatcctgagagaggcccacctgcagaacgtgagcctgcccagacaggtgaacggcctggtgctgagcgtggtgctgcccgagagactgcaggagatcatcctgaccttcgagaagatcaacaagaccagaaacgccagagcccagtgcgtgggctggcacagcaagaagagaagatgggacgagaaggcctgccagatgatgctggacatcagaaacgaggtgaagtgcagatgcaactacaccagcgtggtgatgagcttcagcatcctgatgagcagcaagagcatgaccgacaaggtgctggactacatcacctgcatcggcctgagcgtgagcatcctgagcctggtgctgtgcctgatcatcgaggccaccgtgtggagcagagtggtggtgaccgagatcagctacatgagacacgtgtgcatcgtgaacatcgccgtgagcctgctgaccgccaacgtgtggttcatcatcggcagccacttcaacatcaaggcccaggactacaacatgtgcgtggccgtgaccttcttcagccacttcttctacctgagcctgttcttctggatgctgttcaaggccctgctgatcatctacggcatcctggtgatcttcagaagaatgatgaagagcagaatgatggtgatcggcttcgccatcggctacggctgccccctgatcatcgccgtgaccaccgtggccatcaccgagcccgagaagggctacatgagacccgaggcctgctggctgaactgggacaacaccaaggccctgctggccttcgccatccccgccttcgtgatcgtggccgtgaacctgatcgtggtgctggtggtggccgtgaacacccagagacccagcatcggcagcagcaagagccaggacgtggtgatcatcatgagaatcagcaagaacgtggccatcctgacccccctgctgggcctgacctggggcttcggcatcgccaccctgatcgagggcaccagcctgaccttccacatcatcttcgccctgctgaacgccttccagggcttcttcatcctgctgttcggcaccatcatggaccacaagatcagagacgccctgagaatgagaatgagcagcctgaagggcaagagcagagccgccgagaacgccagcctgggccccaccaacggcagcaagctgatgaacagacagggctag

SEQ ID NO: 82365 - DNA, 2088 bp, Artificial Sequence; identical to SEQ ID NO: 82364
  Description of Artificial Sequence: Synthetic coding sequence

SEQ ID NO: 82366 - DNA, 2259 bp, Artificial Sequence
  Description of Artificial Sequence: Synthetic coding sequence
atgtacaccggcccctgcaaggtgctgcacctgagcagcggcctgctgcccaacagcggcagattcggcatcgtgctgagcgacgagtaccaggtggtgaccagcctgtggtgccagctgtacaccacccacgccccccagcaggccagcggcatgctgctgctgaactacctggtgatccccagcaaggcccaggtgaacaagcccggctacatccccaacctgggcgagtgcagccactacagaagcaagatccacctgaaggccggcgacaagctgcagagccccgagggcaagcccaagaccggcagaatccaggagaagtgcgagggcccctgcatcagcagcagcaactgcagccagccctgcgccaaggacttccacggcgagatcggcttcacctgcaaccagaagaagtggcagaagagcgccgagacctgcaccagcctgagcgtggagaagctgttcaaggacagcaccggcgccagcagactgagcgtggccgcccccagcatccccctgcacatcctggacttcagagcccccgagaccatcgagagcgtggcccagggcatcagaaagaactgccccttcgactacgcctgcatcaccgacatggtgaagagcagcgagaccaccagcggcaacatcgccttcatcgtggagctgctgaagaacatcagcaccgacctgagcgacaacgtgaccagagagaagatgaagagctacagcgaggtggccaaccacatcctggacaccgccgccatcagcaactgggccttcatccccaacaagaacgccagcagcgacctgctgcagagcgtgaacctgttcgccagacagctgcacatccacaacaacagcgagaacatcgtgaacgagctgttcatccagaccaagggcttccacatcaaccacaacaccagcgagaagagcctgaacttcagcatgagcatgaacaacaccaccgaggacatcctgggcatggtgcagatccccagacaggagctgagaaagctgtggcccaacgccagccaggccatcagcatcgccttccccaccctgggcgccatcctgagagaggcccacctgcagaacgtgagcctgcccagacaggtgaacggcctggtgctgagcgtggtgctgcccgagagactgcaggagatcatcctgaccttcgagaagatcaacaagaccagaaacgccagagcccagtgcgtgggctggcacagcaagaagagaagatgggacgagaaggcctgccagatgatgctggacatcagaaacgaggtgaagtgcagatgcaactacaccagcgtggtgatgagcttcagcatcctgatgagcagcaagagcatgaccgacaaggtgctggactacatcacctgcatcggcctgagcgtgagcatcctgagcctggtgctgtgcctgatcatcgaggccaccgtgtggagcagagtggtggtgaccgagatcagctacatgagacacgtgtgcatcgtgaacatcgccgtgagcctgctgaccgccaacgtgtggttcatcatcggcagccacttcaacatcaaggcccaggactacaacatgtgcgtggccgtgaccttcttcagccacttcttctacctgagcctgttcttctggatgctgttcaaggccctgctgatcatctacggcatcctggtgatcttcagaagaatgatgaagagcagaatgatggtgatcggcttcgccatcggctacggctgccccctgatcatcgccgtgaccaccgtggccatcaccgagcccgagaagggctacatgagacccgaggcctgctggctgaactgggacaacaccaaggccctgctggccttcgccatccccgccttcgtgatcgtggccgtgaacctgatcgtggtgctggtggtggccgtgaacacccagagacccagcatcggcagcagcaagagccaggacgtggtgatcatcatgagaatcagcaagaacgtggccatcctgacccccctgctgggcctgacctggggcttcggcatcgccaccctgatcgagggcaccagcctgaccttccacatcatcttcgccctgctgaacgccttccagggcttcttcatcctgctgttcggcaccatcatggaccacaagatcagagacgccctgagaatgagaatgagcagcctgaagggcaagagcagagccgccgagaacgccagcctgggccccaccaacggcagcaagctgatgaacagacagggctag

SEQ ID NO: 82367 - DNA, 1005 bp, Artificial Sequence
  Description of Artificial Sequence: Synthetic coding sequence
atgaacgaggacctgaaggtgaacctgagcggcctgcccagagactacctggacgccgccgccgccgagaacatcagcgccgccgtgagcagcagagtgcccgccgtggagcccgagcccgagctggtggtgaacccctgggacatcgtgctgtgcaccagcggcaccctgatcagctgcgagaacgccatcgtggtgctgatcatcttccacaaccccagcctgagagcccccatgttcctgctgatcggcagcctggccctggccgacctgctggccggcatcggcctgatcaccaacttcgtgttcgcctacctgctgcagagcgaggccaccaagctggtgaccatcggcctgatcgtggccagcttcagcgccagcgtgtgcagcctgctggccatcaccgtggacagatacctgagcctgtactacgccctgacctaccacagcgagagaaccgtgaccttcacctacgtgatgctggtgatgctgtggggcaccagcatctgcctgggcctgctgcccgtgatgggctggaactgcctgagagacgagagcacctgcagcgtggtgagacccctgaccaagaacaacgccgccatcctgagcgtgagcttcctgttcatgttcgccctgatgctgcagctgtacatccagatctgcaagatcgtgatgagacacgcccaccagatcgccctgcagcaccacttcctggccaccagccactacgtgaccaccagaaagggcgtgagcaccctggccatcatcctgggcaccttcgccgcctgctggatgcccttcaccctgtacagcctgatcgccgactacacctaccccagcatctacacctacgccaccctgctgcccgccacctacaacagcatcatcaaccccgtgatctacgccttcagaaaccaggagatccagaaggccctgtgcctgatctgctgcggctgcatccccagcagcctggcccagagagccagaagccccagcgacgtgtag

SEQ ID NO: 82368 - DNA, 1005 bp, Artificial Sequence; identical to SEQ ID NO: 82367
  Description of Artificial Sequence: Synthetic coding sequence

SEQ ID NO: 82369 - DNA, 3840 bp, Artificial Sequence
  Description of Artificial Sequence: Synthetic coding sequence
atgagaggccacggcaaccacagcagactgaagagcagatgcgccagcctgggcaacgtgcaccaccaccaggcccagatggcccacggcgcccactgcagaggcggcagaaccccccagagccccgacagcagaggccccaccgccggcggccacaccagaggcagatggacctacagacccatcgaggccctgatcaacgtgagcttccccggcgccaagggcggcagaaccgccgagggcgagcccagctgggcctgggtgttcagaagcggctacctgcagagacaggccctgcccggcctgcccgtgagcaccagagtggccgcctgctggtggcagcaccaccccggcagagacagcggcttcctgggccccggcttcatcgacctgctgagagaggagcccagcggcagagccgacggcaaggccgccgcccagaagaccggcagactgtacctgttccccaccttcctgggcaacaagctgcccgaggccgccgacagcttcggcgagatcgccagcggcaacagcgtgatcttcaccagcgtgctgcagagcagccacccccccggcacccccccccccagcgccagaaagcccagccccggcgccgccatgctggtgtgcgaggagaccctggagctgggcgcccagggctgctggggcagcaccagccccagaggccaggccgtgagcctggtgggcggccccaccgccggcggcagcagactgggcggcgccggctgcaccatgggcctgctgatggccctgcaggccagaagacccagagacggcacctgggccgaccccagaagatgcagcagagccgtggagggcagcggcctgaccagagccgccctggtgagccccggccccagcggcgtggaggaggacaccagaagagagggctgcgtgctggtgggcagctggagaagcagcacccacagaagcagagtgctgatcatcaacacccccagcggcagaaccccctggagccagggcagcctgggcagcaccggcagatacaaccagaccagagcccccggcagccagcagcagggcctgtgcagcgacgccgccctgcacgaggacttcgtgcccgagcccacccccgccttcttccagtaccccccccaggccttcagcaagaccaaggtgagagacctgggcagaggcggcctgtacgccttcagcaaggaggagaaggtgagcgaggcccagagagtggaggcctacgagacccacggcctgggcctgagcaccggcagacagaaccccgtgcccagcccctgcaagcccggctgcgtgtgccagggcctggccctggacgccgaggcctggcccagacaccccggcagaagaccctgcgccgccaaggaggcctgcctgggcccccccggctgcagcggcgagctgagcctgcccgaggaggagggcatcgcccccggcgccgccaccgccgcccccgcctgggtgccccacggcagagtgagcagattcctgaccgtgaagctgttcacctacgtgaccatgtaccagtgcaagcaggagagaatcctgagactgtgcatcagcggcgagagcggcagatacgtgagaagaagcagattcagaaacttcgccgccctgatggtgagcaccggcgtgcccggcgtgctgcagctgggcgccagacccctgagaggcggcggccacccctacggcgacagccaggccggcaaggtggtggagtggagagccggcgacagagccagcggcctgagcgccggcgagagaagattcctgagccagagcgagctgcagacctggcccagaaccccccactgcgtgggcaagaaggtgccccagcccgtgggcgccgccgacctggcccccgacaccagcctgtgcagaaaggagggcagcagcgccagcagaagctgcagacccggccccggccacctgaccagaagagaggaggacagcttcagacagctggccttccccagattcgaggaggtgaccttcccccccctgaccgccgccgagagagcccccagcgtgcacggcggccacagcctggccagccagggcctggtgctggccggcagaaccagaagcgtggccagcggcggcaagcaggagctgagcggccccctggccgcctgcatccccacccaggacctgaagaccgtgctgagcctgcccagataccccggcgagttcctgcaccccgtggtgtacgcctgcaccgccgtgatgctgctgtgcctgctggccagcttcgtgacctacatcgtgcaccagagcgccatcagaatcagcagaaagggcagacacaccctgctgaacttctgcttccacgccgccctgaccttcaccgtgttcgccggcggcatcaacagaaccaagtaccccatcctgtgccaggccgtgggcatcgtgctgcactacagcaccctgagcaccatgctgtggatcggcgtgaccgccagaaacatctacaagcaggtgaccaagaaggcccccctgtgcctggacaccgaccagcccccctaccccagacagcccctgctgagattctacctggtgagcggcggcgtgcccttcatcatctgcggcgtgaccgccgccaccaacatcagaaactacggcaccgaggacgaggacaccgcctgctggatggcctgggagcccagcctgggcgccttctacggccccgccgccatcatcaccctggtgacctgcgtgtacttcctgggcacctacgtgcagctgagaagacaccccggcagaagatacgagctgagaacccagcccgaggagcagagaagactggccacccccgagggcggcagaggcatcagacccggcaccccccccgcccacgacgcccccggcgccagcgtgctgcagaacgagcacagcttccaggcccagctgagagccgccgccttcaccctgttcctgttcaccgccacctgggccttcggcgccctggccgtgagccagggccacttcctggacatggtgttcagctgcctgtacggcgccttctgcgtgaccctgggcctgttcgtgctgatccaccactgcgccaagagagaggacgtgtggcagtgctggtgggcctgctgcccccccagaaaggacgcccaccccgccctggacgccaacggcgccgccctgggcagagccgcctgcctgcacagccccggcctgggccagcccagaggcttcgcccacccccccggcccctgcaagatgaccaacctgcaggccgcccagggccacgccagctgcctgagccccgccaccccctgctgcgccaagatgcactgcgagcccctgaccgccgacgaggcccacgtgcacctgcaggaggagggcgccttcggccacgacccccacctgcacggctgcctgcagggcagaaccaagcccccctacttcagcagacaccccgccgaggagcccgagtacgcctaccacatccccagcagcctggacggcagccccagaagcagcagaaccgacagcccccccagcagcctggacggccccgccggcacccacaccctggcctgctgcacccagggcgaccccttccccatggtgacccagcccgagggcagcgacggcagccccgccctgtacagctgccccacccagcccggcagagaggccgccctgggccccggccacctggagatgctgagaagaacccagagcctgcccttcggcggccccagccagaacggcctgcccaagggcaagctgctggagggcctgcccttcggcaccgacggcaccggcaacatcagaaccggcccctggaagaacgagaccaccgtgtag

SEQ ID NO: 82370 - DNA, 1395 bp, Artificial Sequence
  Description of Artificial Sequence: Synthetic coding sequence
atgctgtggatcggcgtgaccgccagaaacatctacaagcaggtgaccaagaaggcccccctgtgcctggacaccgaccagcccccctaccccagacagcccctgctgagcagattctacctggtgagcggcggcgtgcccttcatcatctgcggcgtgaccgccgccaccaacatcagaaactacggcaccgaggacgaggacaccgcctactgctggatggcctgggagcccagcctgggcgccttctacggccccgccgccatcatcaccctggtgacctgcgtgtacttcctgggcacctacgtgcagctgagaagacaccccggcagaagatacgagctgagaacccagcccgaggagcagagaagactggccacccccgagggcggcagaggcatcagacccggcaccccccccgcccacgacgcccccggcgccagcgtgctgcagaacgagcacagcttccaggcccagctgagagccgccgccttcaccctgttcctgttcaccgccacctgggccttcggcgccctggccgtgagccagggccacttcctggacatggtgttcagctgcctgtacggcgccttctgcgtgaccctgggcctgttcgtgctgatccaccactgcgccaagagagaggacgtgtggcagtgctggtgggcctgctgcccccccagaaaggacgcccaccccgccctggacgccaacggcgccgccctgggcagagccgcctgcctgcacagccccggcctgggccagcccagaggcttcgcccacccccccggcccctgcaagatgaccaacctgcaggccgcccagggccacgccagctgcctgagccccgccaccccctgctgcgccaagatgcactgcgagcccctgaccgccgacgaggcccacgtgcacctgcaggaggagggcgccttcggccacgacccccacctgcacggctgcctgcagggcagaaccaagcccccctacttcagcagacaccccgccgaggagcccgagtacgcctaccacatccccagcagcctggacggcagccccagaagcagcagaaccgacagcccccccagcagcctggacggccccgccggcacccacaccctggcctgctgcacccagggcgaccccttccccatggtgacccagcccgagggcagcgacggcagccccgccctgtacagctgccccacccagcccggcagagaggccgccctgggccccggccacctggagatgctgagaagaacccagagcctgcccttcggcggccccagccagaacggcctgcccaagggcaagctgctggagggcctgcccttcggcaccgacggcaccggcaacatcagaaccggcccctggaagaacgagaccaccgtgtag

SEQ ID NO: 82371 - DNA, 1683 bp, Artificial Sequence
  Description of Artificial Sequence: Synthetic coding sequence
atggacctgaagaccgtgctgagcctgcccagataccccggcgagttcctgcaccccgtggtgtacgcctgcaccgccgtgatgctgctgtgcctgctggccagcttcgtgacctacatcgtgcaccagagcgccatcagaatcagcagaaagggcagacacaccctgctgaacttctgcttccacgccgccctgaccttcaccgtgttcgccggcggcatcaacagaaccaagtaccccatcctgtgccaggccgtgggcatcgtgctgcactacagcaccctgagcaccatgctgtggatcggcgtgaccgccagaaacatctacaagcaggtgaccaagaaggcccccctgtgcctggacaccgaccagcccccctaccccagacagcccctgctgagattctacctggtgagcggcggcgtgcccttcatcatctgcggcgtgaccgccgccaccaacatcagaaactacggcaccgaggacgaggacaccgcctactgctggatggcctgggagcccagcctgggcgccttctacggccccgccgccatcatcaccctggtgacctgcgtgtacttcctgggcacctacgtgcagctgagaagacaccccggcagaagatacgagctgagaacccagcccgaggagcagagaagactggccacccccgagggcggcagaggcatcagacccggcaccccccccgcccacgacgcccccggcgccagcgtgctgcagaacgagcacagcttccaggcccagctgagagccgccgccttcaccctgttcctgttcaccgccacctgggccttcggcgccctggccgtgagccagggccacttcctggacatggtgttcagctgcctgtacggcgccttctgcgtgaccctgggcctgttcgtgctgatccaccactgcgccaagagagaggacgtgtggcagtgctggtgggcctgctgcccccccagaaaggacgcccaccccgccctggacgccaacggcgccgccctgggcagagccgcctgcctgcacagccccggcctgggccagcccagaggcttcgcccacccccccggcccctgcaagatgaccaacctgcaggccgcccagggccacgccagctgcctgagccccgccaccccctgctgcgccaagatgcactgcgagcccctgaccgccgacgaggcccacgtgcacctgcaggaggagggcgccttcggccacgacccccacctgcacggctgcctgcagggcagaaccaagcccccctacttcagcagacaccccgccgaggagcccgagtacgcctaccacatccccagcagcctggacggcagccccagaagcagcagaaccgacagcccccccagcagcctggacggccccgccggcacccacaccctggcctgctgcacccagggcgaccccttccccatggtgacccagcccgagggcagcgacggcagccccgccctgtacagctgccccacccagcccggcagagaggccgccctgggccccggccacctggagatgctgagaagaacccagagcctgcccttcggcggccccagccagaacggcctgcccaagggcaagctgctggagggcctgcccttcggcaccgacggcaccggcaacatcagaaccggcccctggaagaacgagaccaccgtgtag

SEQ ID NO: 82372 - DNA, 2562 bp, Artificial Sequence
  Description of Artificial Sequence: Synthetic coding sequence
atgagaggccacggcaaccacagcagactgaagagcagatgcgccagcctgggcaacgtgcaccaccaccaggcccagatggcccacggcgcccactgcagaggcggcagaaccccccagagccccgacagcagaggccccaccgccggcggccacaccagaggcagatggacctacagacccatcgaggccctgatcaacgtgagcttccccggcgccaagggcggcagaaccgccgagggcgagcccagctgggcctgggtgttcagaagcggctacctgcagagacaggccctgcccggcctgcccgtgagcaccagagtggccgcctgctggtggcagcaccaccccggcagagacagcggcttcctgggccccggcttcatcgacctgctgagagaggagcccagcggcagagccgacggcaaggccgccgcccagaagaccggcagactgtacctgttccccaccttcctgggcaacaagctgcccgaggccgccgacagcttcggcgagatcgccagcggcaacagcgtgatcttcaccagcgtgctgcagagcagccacccccccggcacccccccccccagcgccagaaagcccagccccggcgccgccatgctggtgtgcgaggagaccctggagctgggcgcccagggctgctggggcagcaccagccccagaggccaggccgtgagcctggtgggcggccccaccgccggcggcagcagactgggcggcgccggctgcaccatgggcctgctgatggccctgcaggccagaagacccagagacggcacctgggccgaccccagaagatgcagcagagccgtggagggcagcggcctgaccagagccgccctggtgagccccggccccagcggcgtggaggaggacaccagaagagagggctgcgtgctggtgggcagctggagaagcagcacccacagaagcagagtgctgatcatcaacacccccagcggcagaaccccctggagccagggcagcctgggcagcaccggcagatacaaccagaccagagcccccggcagccagcagcagggcctgtgcagcgacgccgccctgcacgaggacttcgtgcccgagcccacccccgccttcttccagtaccccccccaggccttcagcaagaccaaggtgagagacctgggcagaggcggcctgtacgccttcagcaaggaggagaaggtgagcgaggcccagagagtggaggcctacgagacccacggcctgggcctgagcaccggcagacagaaccccgtgcccagcccctgcaagcccggctgcgtgtgccagggcctggccctggacgccgaggcctggcccagacaccccggcagaagaccctgcgccgccaaggaggcctgcctgggcccccccggctgcagcggcgagctgagcctgcccgaggaggagggcatcgcccccggcgccgccaccgccgcccccgcctgggtgccccacggcagagtgagcagattcctgaccgtgaagctgttcacctacgtgaccatgtaccagtgcaagcaggagagaatcctgagactgtgcatcagcggcgagagcggcagatacgtgagaagaagcagattcagaaacttcgccgccctgatggtgagcaccggcgtgcccggcgtgctgcagctgggcgccagacccctgagaggcggcggccacccctacggcgacagccaggccggcaaggtggtggagtggagagccggcgacagagccagcggcctgagcgccggcgagagaagattcctgagccagagcgagctgcagacctggcccagaaccccccactgcgtgggcaagaaggtgccccagcccgtgggcgccgccgacctggcccccgacaccagcctgtgcagaaaggagggcagcagcgccagcagaagctgcagacccggccccggccacctgaccagaagagaggaggacagcttcagacagctggccttccccagattcgaggaggtgaccttcccccccctgaccgccgccgagagagcccccagcgtgcacggcggccacagcctggccagccagggcctggtgctggccggcagaaccagaagcgtggccagcggcggcaagcaggagctgagcggccccctggccgcctgcatccccacccaggacctgaagaccgtgctgagcctgcccagataccccggcgagttcctgcaccccgtggtgtacgcctgcaccgccgtgatgctgctgtgcctgctggccagcttcgtgacctacatcgtgcaccagagcgccatcagaatcagcagaaagggcagacacaccctgctgaacttctgcttccacgccgccgagcaccccggcgtgacccccctgagaaccagcccccccctgccctggtggacccccatccaggtgggcatcgtgctgcactacagcaccctgagcaccatgctgtggatcggcgtgaccgccagaaacatctacaagcaggtgaccaagaaggcccccctgtgcctggacaccgaccagcccccctaccccagacagcccctgctgtag

SEQ ID NO: 82373 - DNA, 3366 bp, Artificial Sequence
  Description of Artificial Sequence: Synthetic coding sequence
atgggcgccggcggcagaagaatgagaggcgcccccgccagactgctgctgcccctgctgccctggctgctgctgctgctggcccccgaggccagaggcgcccccggctgccccctgagcatcagaagctgcaagtgcagcggcgagagacccaagggcctgagcggcggcgtgcccggccccgccagaagaagagtggtgtgcagcggcggcgacctgcccgagccccccgagcccggcctgctgcccaacggcaccgtgaccctgctgctgagcaacaacaagatcaccggcctgagaaacggcagcttcctgggcctgagcctgctggagaagctggacctgagaaacaacatcatcagcaccgtgcagcccggcgccttcctgggcctgggcgagctgaagagactggacctgagcaacaacagaatcggctgcctgaccagcgagaccttccagggcctgcccagactgctgagactgaacatcagcggcaacatcttcagcagcctgcagcccggcgtgttcgacgagctgcccgccctgaaggtggtggacctgggcaccgagttcctgacctgcgactgccacctgagatggctgctgccctgggcccagaacagaagcctgcagctgagcgagcacaccctgtgcgcctaccccagcgccctgcacgcccaggccctgggcagcctgcaggaggcccagctgtgctgcgagggcgccctggagctgcacacccaccacctgatccccagcctgagacaggtggtgttccagggcgacagactgcccttccagtgcagcgccagctacctgggcaacgacaccagaatcagatggtaccacaacagagcccccgtggagggcgacgagcaggccggcatcctgctggccgagagcctgatccacgactgcaccttcatcaccagcgagctgaccctgagccacatcggcgtgtgggccagcggcgagtgggagtgcaccgtgagcatggcccagggcaacgccagcaagaaggtggagatcgtggtgctggagaccagcgccagctactgccccgccgagagagtggccaacaacagaggcgacttcagatggcccagaaccctggccggcatcaccgcctaccagagctgcctgcagtaccccttcaccagcgtgcccctgggcggcggcgcccccggcaccagagccagcagaagatgcgacagagccggcagatgggagcccggcgactacagccactgcctgtacaccaacgacatcaccagagtgctgtacaccttcgtgctgatgcccatcaacgccagcaacgccctgaccctggcccaccagctgagagtgtacaccgccgaggccgccagcttcagcgacatgatggacgtggtgtacgtggcccagatgatccagaagttcctgggctacgtggaccagatcaaggagctggtggaggtgatggtggacatggccagcaacctgatgctggtggacgagcacctgctgtggctggcccagagagaggacaaggcctgcagcagaatcgtgggcgccctggagagaatcggcggcgccgccctgagcccccacgcccagcacatcagcgtggagctgagcgccttccccagagaggtgggcggcgccggcgccggcctgcaccccgtggtgtacccctgcaccgccctgctgctgctgtgcctgttcgccaccatcatcacctacatcctgaaccacagcagcatcagagtgagcagaaagggctggcacatgctgctgaacctgtgcttccacatcgccatgaccagcgccgtgttcgccggcggcatcaccctgaccaactaccagatggtgtgccaggccgtgggcatcaccctgcactacagcagcctgagcaccctgctgtggatgggcgtgaaggccagagtgctgcacaaggagctgacctggagagccccccccccccaggagggcgaccccgccctgcccacccccagccccatgctgagattctacctgatcgccggcggcatccccctgatcatctgcggcatcaccgccgccgtgaacatccacaactacagagaccacagcccctactgctggctggtgtggagacccagcctgggcgccttctacatccccgtggccctgatcctgctgatcacctggatctacttcctgtgcgccggcctgagactgagaggccccctggcccagaaccccaaggccggcaacagcagagccagcctggaggccggcgaggagctgagaggcagcaccagactgagaggcagcggccccctgctgagcgacagcggcagcctgctggccaccggcagcgccagagtgggcacccccggcccccccgaggacggcgacagcctgtacagccccggcgtgcagctgggcgccctggtgaccacccacttcctgtacctggccatgtgggcctgcggcgccctggccgtgagccagagatggctgcccagagtggtgtgcagctgcctgtacggcgtggccgccagcgccctgggcctgttcgtgttcacccaccactgcgccagaagaagagacgtgagagccagctggagagcctgctgcccccccgccagccccgccgccccccacgccccccccagagccctgcccgccgccgccgaggacggcagccccgtgttcggcgagggcccccccagcctgaagagcagccccagcggcagcagcggccaccccctggccctgggcccctgcaagctgaccaacctgcagctggcccagagccaggtgtgcgaggccggcgccgccgccggcggcgagggcgagcccgagcccgccggcaccagaggcaacctggcccacagacaccccaacaacgtgcaccacggcagaagagcccacaagagcagagccaagggccacagagccggcgaggcctgcggcaagaacagactgaaggccctgagaggcggcgccgccggcgccctggagctgctgagcagcgagagcggcagcctgcacaacagccccaccgacagctacctgggcagcagcagaaacagccccggcgccggcctgcagctggagggcgagcccatgctgacccccagcgagggcagcgacaccagcgccgcccccctgagcgaggccggcagagccggccagagaagaagcgccagcagagacagcctgaagggcggcggcgccctggagaaggagagccacagaagaagctaccccctgaacgccgccagcctgaacggcgcccccaagggcggcaagtacgacgacgtgaccctgatgggcgccgaggtggccagcggcggctgcatgaagaccggcctgtggaagagcgagaccaccgtgtag

SEQ ID NO: 82374 - DNA, 4017 bp, Artificial Sequence
  Description of Artificial Sequence: Synthetic coding sequence
atgggcgccggcggcagaagaatgagaggcgcccccgccagactgctgctgcccctgctgccctggctgctgctgctgctggcccccgaggccagaggcgcccccggctgccccctgagcatcagaagctgcaagtgcagcggcgagagacccaagggcctgagcggcggcgtgcccggccccgccagaagaagagtggtgtgcagcggcggcgacctgcccgagccccccgagcccggcctgctgcccaacggcaccgtgaccctgctgctgagcaacaacaagatcaccggcctgagaaacggcagcttcctgggcctgagcctgctggagaagctggacctgagaaacaacatcatcagcaccgtgcagcccggcgccttcctgggcctgggcgagctgaagagactggacctgagcaacaacagaatcggctgcctgaccagcgagaccttccagggcctgcccagactgctgagactgaacatcagcggcaacatcttcagcagcctgcagcccggcgtgttcgacgagctgcccgccctgaaggtggtggacctgggcaccgagttcctgacctgcgactgccacctgagatggctgctgccctgggcccagaacagaagcctgcagctgagcgagcacaccctgtgcgcctaccccagcgccctgcacgcccaggccctgggcagcctgcaggaggcccagctgtgctgcgagggcgccctggagctgcacacccaccacctgatccccagcctgagacaggtggtgttccagggcgacagactgcccttccagtgcagcgccagctacctgggcaacgacaccagaatcagatggtaccacaacagagcccccgtggagggcgacgagcaggccggcatcctgctggccgagagcctgatccacgactgcaccttcatcaccagcgagctgaccctgagccacatcggcgtgtgggccagcggcgagtgggagtgcaccgtgagcatggcccagggcaacgccagcaagaaggtggagatcgtggtgctggagaccagcgccagctactgccccgccgagagagtggccaacaacagaggcgacttcagatggcccagaaccctggccggcatcaccgcctaccagagctgcctgcagtaccccttcaccagcgtgcccctgggcggcggcgcccccggcaccagagccagcagaagatgcgacagagccggcagatgggagcccggcgactacagccactgcctgtacaccaacgacatcaccagagtgctgtacaccttcgtgctgatgcccatcaacgccagcaacgccctgaccctggcccaccagctgagagtgtacaccgccgaggccgccagcttcagcgacatgatggacgtggtgtacgtggcccagatgatccagaagttcctgggctacgtggaccagatcaaggagctggtggaggtgatggtggacatggccagcaacctgatgctggtggacgagcacctgctgtggctggcccagagagaggacaaggcctgcagcagaatcgtgggcgccctggagagaatcggcggcgccgccctgagcccccacgcccagcacatcagcgtgaacgccagaaacgtggccctggaggcctacctgatcaagccccacagctacgtgggcctgacctgcaccgccttccagagaagagagggcggcgtgcccggcaccagacccggcagccccggccagaaccccccccccgagcccgagccccccgccgaccagcagctgagattcagatgcaccaccggcagacccaacgtgagcctgagcagcttccacatcaagaacagcgtggccctggccagcatccagctgccccccagcctgttcagcagcctgcccgccgccctggccccccccgtgccccccgactgcaccctgcagctgctggtgttcagaaacggcagactgttccacagccacagcaacaccagcagacccggcgccgccggccccggcaagagaagaggcgtggccacccccgtgatcttcgccggcaccagcggctgcggcgtgggcaacctgaccgagcccgtggccgtgagcctgagacactgggccgagggcgccgagcccgtggccgcctggtggagccaggagggccccggcgaggccggcggctggaccagcgagggctgccagctgagaagcagccagcccaacgtgagcgccctgcactgccagcacctgggcaacgtggccgtgctgatggagctgagcgccttccccagagaggtgggcggcgccggcgccggcctgcaccccgtggtgtacccctgcaccgccctgctgctgctgtgcctgttcgccaccatcatcacctacatcctgaaccacagcagcatcagagtgagcagaaagggctggcacatgctgctgaacctgtgcttccacatcgccatgaccagcgccgtgttcgccggcggcatcaccctgaccaactaccagatggtgtgccaggccgtgggcatcaccctgcactacagcagcctgagcaccctgctgtggatgggcgtgaaggccagagtgctgcacaaggagctgacctggagagccccccccccccaggagggcgaccccgccctgcccacccccagccccatgctgagattctacctgatcgccggcggcatccccctgatcatctgcggcatcaccgccgccgtgaacatccacaactacagagaccacagcccctactgctggctggtgtggagacccagcctgggcgccttctacatccccgtggccctgatcctgctgatcacctggatctacttcctgtgcgccggcctgagactgagaggccccctggcccagaaccccaaggccggcaacagcagagccagcctggaggccggcgaggagctgagaggcagcaccagactgagaggcagcggccccctgctgagcgacagcggcagcctgctggccaccggcagcgccagagtgggcacccccggcccccccgaggacggcgacagcctgtacagccccggcgtgcagctgggcgccctggtgaccacccacttcctgtacctggccatgtgggcctgcggcgccctggccgtgagccagagatggctgcccagagtggtgtgcagctgcctgtacggcgtggccgccagcgccctgggcctgttcgtgttcacccaccactgcgccagaagaagagacgtgagagccagctggagagcctgctgcccccccgccagccccgccgccccccacgccccccccagagccctgcccgccgccgccgaggacggcagccccgtgttcggcgagggcccccccagcctgaagagcagccccagcggcagcagcggccaccccctggccctgggcccctgcaagctgaccaacctgcagctggcccagagccaggtgtgcgaggccggcgccgccgccggcggcgagggcgagcccgagcccgccggcaccagaggcaacctggcccacagacaccccaacaacgtgcaccacggcagaagagcccacaagagcagagccaagggccacagagccggcgaggcctgcggcaagaacagactgaaggccctgagaggcggcgccgccggcgccctggagctgctgagcagcgagagcggcagcctgcacaacagccccaccgacagctacctgggcagcagcagaaacagccccggcgccggcctgcagctggagggcgagcccatgctgacccccagcgagggcagcgacaccagcgccgcccccctgagcgaggccggcagagccggccagagaagaagcgccagcagagacagcctgaagggcggcggcgccctggagaaggagagccacagaagaagctaccccctgaacgccgccagcctgaacggcgcccccaagggcggcaagtacgacgacgtgaccctgatgggcgccgaggtggccagcggcggctgcatgaagaccggcctgtggaagagcgagaccaccgtgtag

SEQ ID NO: 82375 - DNA, 3771 bp, Artificial Sequence
  Description of Artificial Sequence: Synthetic coding sequence
atgagaggcgcccccgccagactgctgctgcccctgctgccctggctgctgctgctgctggcccccgaggccagaggcgcccccggctgccccctgagcatcagaagctgcaagtgcagcggcgagagacccaagggcctgagcggcggcgtgcccggccccgccagaagaagagtggtgtgcagcggcggcgacctgcccgagccccccgagcccggcctgctgcccaacggcaccgtgaccctgctgctgagcaacaacaagatcaccggcctgagaaacggcagcttcctgggcctgagcctgctggagaagctggacctgagaaacaacatcatcagcaccgtgcagcccggcgccttcctgggcctgggcgagctgaagagactggacctgagcaacaacagaatcggctgcctgaccagcgagaccttccagggcctgcccagactgctgagactgaacatcagcggcaacatcttcagcagcctgcagcccggcgtgttcgacgagctgcccgccctgaaggtggtggacctgggcaccgagttcctgacctgcgactgccacctgagatggctgctgccctgggcccagaacagaagcctgcagctgagcgagcacaccctgtgcgcctaccccagcgccctgcacgcccaggccctgggcagcctgcaggaggcccagctgtgctgcgagggcgccctggagctgcacacccaccacctgatccccagcctgagacaggtggtgttccagggcgacagactgcccttccagtgcagcgccagctacctgggcaacgacaccagaatcagatggtaccacaacagagcccccgtggagggcgacgagcaggccggcatcctgctggccgagagcctgatccacgactgcaccttcatcaccagcgagctgaccctgagccacatcggcgtgtgggccagcggcgagtgggagtgcaccgtgagcatggcccagggcaacgccagcaagaaggtggagatcgtggtgctggagaccagcgccagctactgccccgccgagagagtggccaacaacagaggcgacttcagatggcccagaaccctggccggcatcaccgcctaccagagctgcctgcagtaccccttcaccagcgtgcccctgggcggcggcgcccccggcaccagagccagcagaagatgcgacagagccggcagatgggagcccggcgactacagccactgcctgtacaccaacgacatcaccagagtgctgtacaccttcgtgctgatgcccatcaacgccagcaacgccctgaccctggcccaccagctgagagtgtacaccgccgaggccgccagcttcagcgacatgatggacgtggtgtacgtggcccagatgatccagaagttcctgggctacgtggaccagatcaaggagctggtggaggtgatggtggacatggccagcaacctgatgctggtggacgagcacctgctgtggctggcccagagagaggacaaggcctgcagcagaatcgtgggcgccctggagagaatcggcggcgccgccctgagcccccacgcccagcacatcagcgtgaacgccagaaacgtggccctggaggcctacctgatcaagccccacagctacgtgggcctgacctgcaccgccttccagagaagagagggcggcgtgcccggcaccagacccggcagccccggccagaaccccccccccgagcccgagccccccgccgaccagcagctgagattcagatgcaccaccggcagacccaacgtgagcctgagcagcttccacatcaagaacagcgtggccctggccagcatccagctgccccccagcctgttcagcagcctgcccgccgccctggccccccccgtgccccccgactgcaccctgcagctgctggtgttcagaaacggcagactgttccacagccacagcaacaccagcagacccggcgccgccggccccggcaagagaagaggcgtggccacccccgtgatcttcgccggcaccagcggctgcggcgtgggcaacctgaccgagcccgtggccgtgagcctgagacactgggccgagggcgccgagcccgtggccgcctggtggagccaggagggccccggcgaggccggcggctggaccagcgagggctgccagctgagaagcagccagcccaacgtgagcgccctgcactgccagcacctgggcaacgtggccgtgctgatggagctgagcgccttccccagagaggtgggcggcgccggcgccggcctgcaccccgtggtgtacccctgcaccgccctgctgctgctgtgcctgttcgccaccatcatcacctacatcctgaaccacagcagcatcagagtgagcagaaagggctggcacatgctgctgaacctgtgcttccacatcgccatgaccagcgccgtgttcgccggcggcatcaccctgaccaactaccagatggtgtgccaggccgtgggcatcaccctgcactacagcagcctgagcaccctgctgtggatgggcgtgaaggccagagtgctgcacaaggagctgacctggagagccccccccccccaggagggcgaccccgccctgcccacccccagccccatgctgagattctacctgatcgccggcggcatccccctgatcatctgcggcatcaccgccgccgtgaacatccacaactacagagaccacagcccctactgctggctggtgtggagacccagcctgggcgccttctacatccccgtggccctgatcctgctgatcacctggatctacttcctgtgcgccggcctgagactgagaggccccctggcccagaaccccaaggccggcaacagcagagccagcctggaggccggcgaggagctgagaggcagcaccagactgagaggcagcggccccctgctgagcgacagcggcagcctgctggccaccggcagcgccagagtgggcacccccggcccccccgaggacggcgacagcctgtacagccccggcgtgcagagaggcgccggcgaccacgccctgcccgtgctgggccacgtgggcctgagaggcagcggcagcgtgcccgccctggccgcccccggcggcgtgcagctgctggtgagaggcggcagcctgagacccggccccctgagactgcacagccccctgtgccaggccgagggcagagagagcctggtggccagactgctgcccccctgcctgagcagaggccccccctgccccgcccccggccccgccagaagaagaagaggcagattccccggcgtgagaggcggcccccccctgccccaggtgctgcccaagagacagcagagacccagcgccggcagcggccccctgcaggcccaccagcccgccgccggccccgagagcggcgtgagaggcggcggcggcggcagaagaggcagaagagccggcgccggcggccaccccggcaagcccagacccccccccccccagcagagagcccccagagccagcggcgcccaggagcccggccagggcacccccagaggcggcggcctgagacaggagcccgcccagggccccgccagaggcagaggcggcggcgccggcgccgccgtgcagagagagagacagagcgcccagcagccccacagacagctgcccggccagcagccccagcagcccggcagaagacccgccgccggcagaagagcccacgcccacgccgtgagaggccagagacaccagagaagagccgccttctag

SEQ ID NO: 82376 - DNA, 3966 bp, Artificial Sequence
  Description of Artificial Sequence: Synthetic coding sequence
atggagccccccggcagaagaagaggcagagcccagccccccctgctgctgcccctgagcctgctggccctgctggccctgctgggcggcggcggcggcggcggcgccgccgccctgcccgccggctgcaagcacgacggcagacccagaggcgccggcagagccgccggcgccgccgagggcaaggtggtgtgcagcagcctggagctggcccaggtgctgccccccgacaccctgcccaacagaaccgtgaccctgatcctgagcaacaacaagatcagcgagctgaagaacggcagcttcagcggcctgagcctgctggagagactggacctgagaaacaacctgatcagcagcatcgaccccggcgccttctggggcctgagcagcctgaagagactggacctgaccaacaacagaatcggctgcctgaacgccgacatcttcagaggcctgaccaacctggtgagactgaacctgagcggcaacctgttcagcagcctgagccagggcaccttcgactacctggccagcctgagaagcctggagttccagaccgagtacctgctgtgcgactgcaacatcctgtggatgcacagatgggtgaaggagaagaacatcaccgtgagagacaccagatgcgtgtaccccaagagcctgcaggcccagcccgtgaccggcgtgaagcaggagctgctgacctgcgacccccccctggagctgcccagcttctacatgacccccagccacagacaggtggtgttcgagggcgacagcctgcccttccagtgcatggccagctacatcgaccaggacatgcaggtgctgtggtaccaggacggcagaatcgtggagaccgacgagagccagggcatcttcgtggagaagaacatgatccacaactgcagcctgatcgccagcgccctgaccatcagcaacatccaggccggcagcaccggcaactggggctgccacgtgcagaccaagagaggcaacaacaccagaaccgtggacatcgtggtgctggagagcagcgcccagtactgcccccccgagagagtggtgaacaacaagggcgacttcagatggcccagaaccctggccggcatcaccgcctacctgcagtgcaccagaaacacccacggcagcggcatctaccccggcaacccccaggacgagagaaaggcctggagaagatgcgacagaggcggcttctgggccgacgacgactacagcagatgccagtacgccaacgacgtgaccagagtgctgtacatgttcaaccagatgcccctgaacctgaccaacgccgtggccaccgccagacagctgctggcctacaccgtggaggccgccaacttcagcgacaagatggacgtgatcttcgtggccgagatgatcgagaagttcggcagattcaccaaggaggagaagagcaaggagctgggcgacgtgatggtggacatcgccagcaacatcatgctggccgacgagagagtgctgtggctggcccagagagaggccaaggcctgcagcagaatcgtgcagtgcctgcagagaatcgccacctacagactggccggcggcgcccacgtgtacagcacctacagccccaacatcgccctggaggcctacgtgatcaagagcaccggcttcaccggcatgacctgcaccgtgttccagaaggtggccgccagcgacagaaccggcctgagcgactacggcagaagagaccccgagggcaacctggacaagcagctgagcttcaagtgcaacgtgagcaacaccttcagcagcctggccctgaagaacaccatcgtggaggccagcatccagctgccccccagcctgttcagccccaagcagaagagagagctgagacccaccgacgacagcctgtacaagctgcagctgatcgccttcagaaacggcaagctgttccccgccaccggcaacagcaccaacctggccgacgacggcaagagaagaaccgtggtgacccccgtgatcctgaccaagatcgacggcgtgaacgtggacacccaccacatccccgtgaacgtgaccctgagaagaatcgcccacggcgccgacgccgtggccgccagatgggacttcgacctgctgaacggccagggcggctggaagagcgacggctgccacatcctgtacagcgacgagaacatcaccaccatccagtgctacagcctgagcaactacgccgtgctgatggacctgaccggcagcgagctgtacacccaggccgccagcctgctgcaccccgtggtgtacaccaccgccatcatcctgctgctgtgcctgctggccgtgatcgtgagctacatctaccaccacagcctgatcagaatcagcctgaagagctggcacatgctggtgaacctgtgcttccacatcttcctgacctgcgtggtgttcgtgggcggcatcacccagaccagaaacgccagcatctgccaggccgtgggcatcatcctgcactacagcaccctggccaccgtgctgtgggtgggcgtgaccgccagaaacatctacaagcaggtgaccaagaaggccaagagatgccaggaccccgacgagcccccccccccccccagacccatgctgagattctacctgatcggcggcggcatccccatcatcgtgtgcggcatcaccgccgccgccaacatcaagaactacggcagcagacccaacgccccctactgctggatggcctgggagcccagcctgggcgccttctacggccccgccagcttcatcaccttcgtgaactgcatgtacttcctgagcatcttcatccagctgaagagacaccccgagagaaagtacgagctgaaggagcccaccgaggagcagcagagactggccgccaacgagaacggcgagatcaaccaccaggacagcatgagcctgagcctgatcagcaccagcgccctggagaacgagcacaccttccacagccagctgctgggcgccagcctgaccctgctgctgtacgtggccctgtggatgttcggcgccctggccgtgagcctgtactaccccctggacctggtgttcagcttcgtgttcggcgccaccagcctgagcttcagcgccttcttcgtggtgcaccactgcgtgaacagagaggacgtgagactggcctggatcatgacctgctgccccggcagaagcagctacagcgtgcaggtgaacgtgcagccccccaacagcaacggcaccaacggcgaggcccccaagtgccccaacagcagcgccgagagcagctgcaccaacaagagcgccagcagcttcaagaacagcagccagggctgcaagctgaccaacctgcaggccgccgccgcccagtgccacgccaacagcctgcccctgaacagcaccccccagctggacaacagcctgaccgagcacagcatggacaacgacatcaagatgcacgtggcccccctggaggtgcagttcagaaccaacgtgcacagcagcagacaccacaagaacagaagcaagggccacagagccagcagactgaccgtgctgagagagtacgcctacgacgtgcccaccagcgtggagggcagcgtgcagaacggcctgcccaagagcagactgggcaacaacgagggccacagcagaagcagaagagcctacctggcctacagagagagacagtacaaccccccccagcaggacagcagcgacgcctgcagcaccctgcccaagagcagcagaaacttcgagaagcccgtgagcaccaccagcaagaaggacgccctgagaaagcccgccgtggtggagctggagaaccagcagaagagctacggcctgaacctggccatccagaacggccccatcaagagcaacggccaggagggccccctgctgggcaccgacagcaccggcaacgtgagaaccggcctgtggaagcacgagaccaccgtgtag

SEQ ID NO: 82377 - DNA, 1851 bp, Artificial Sequence
  Description of Artificial Sequence: Synthetic coding sequence
atggagccccccggcagaagaagaggcagagcccagccccccctgctgctgcccctgagcctgctggccctgctggccctgctgggcggcggcggcggcggcggcgccgccgccctgcccgccggctgcaagcacgacggcagacccagaggcgccggcagagccgccggcgccgccgagggcaaggtggtgtgcagcagcctggagctggcccaggtgctgccccccgacaccctgcccaacagaaccgtgaccctgatcctgagcaacaacaagatcagcgagctgaagaacggcagcttcagcggcctgagcctgctggagagactggacctgagaaacaacctgatcagcagcatcgaccccggcgccttctggggcctgagcagcctgaagagactggacctgaccaacaacagaatcggctgcctgaacgccgacatcttcagaggcctgaccaacctggtgagactgaacctgagcggcaacctgttcagcagcctgagccagggcaccttcgactacctggccagcctgagaagcctggagttccagaccgagtacctgctgtgcgactgcaacatcctgtggatgcacagatgggtgaaggagaagaacatcaccgtgagagacaccagatgcgtgtaccccaagagcctgcaggcccagcccgtgaccggcgtgaagcaggagctgctgacctgcgacccccccctggagctgcccagcttctacatgacccccagccacagacaggtggtgttcgagggcgacagcctgcccttccagtgcatggccagctacatcgaccaggacatgcaggtgctgtggtaccaggacggcagaatcgtggagaccgacgagagccagggcatcttcgtggagaagaacatgatccacaactgcagcctgatcgccagcgccctgaccatcagcaacatccaggccggcagcaccggcaactggggctgccacgtgcagaccaagagaggcaacaacaccagaaccgtggacatcgtggtgctggagagcagcgcccagtactgcccccccgagagagtggtgaacaacaagggcgacttcagatggcccagaaccctggccggcatcaccgcctacctgcagtgcaccagaaacacccacggcagcggcatctaccccggcaacccccaggacgagagaaaggcctggagaagatgcgacagaggcggcttctgggccgacgacgactacagcagatgccagtacgccaacgacgtgaccagagtgctgtacatgttcaaccagatgcccctgaacctgaccaacgccgtggccaccgccagacagctgctggcctacaccgtggaggccgccaacttcagcgacaagatggacgtgatcttcgtggccgagatgatcgagaagttcggcagattcaccaaggaggagaagagcaaggagctgggcgacgtgatggtggacatcgccagcaacatcatgctggccgacgagagagtgctgtggctggcccagagagaggccaaggcctgcagcagaatcgtgcagtgcctgcagagaatcgccacctacagactggccggcggcgcccacgtgtacagcacctacagccccaacatcgccctggaggcctacgtgatcaagagcaccggcttcaccggcatgacctgcaccgtgttccagaaggtggccgccagcgacagaaccggcctgagcgactacggcagaagagaccccgagggcaacctggacaagcagctgagcttcaagtgcaacgtgagcaacaccttcagcagcctggccctgaaggtgtgctacatcctgcagagcttcaagaccatctacagctag

SEQ ID NO: 82378 - DNA, 1146 bp, Artificial Sequence
  Description of Artificial Sequence: Synthetic coding sequence
atgcccctgaagagaaacaacagcaagtacccccccctggagctgcccagcttctacatgacccccagccacagacaggtggtgttcgagggcgacagcctgcccttccagtgcatggccagctacatcgaccaggacatgcaggtgctgtggtaccaggacggcagaatcgtggagaccgacgagagccagggcatcttcgtggagaagaacatgatccacaactgcagcctgatcgccagcgccctgaccatcagcaacatccaggccggcagcaccggcaactggggctgccacgtgcagaccaagagaggcaacaacaccagaaccgtggacatcgtggtgctggagagcagcgcccagtactgcccccccgagagagtggtgaacaacaagggcgacttcagatggcccagaaccctggccggcatcaccgcctacctgcagtgcaccagaaacacccacggcagcggcatctaccccggcaacccccaggacgagagaaaggcctggagaagatgcgacagaggcggcttctgggccgacgacgactacagcagatgccagtacgccaacgacgtgaccagagtgctgtacatgttcaaccagatgcccctgaacctgaccaacgccgtggccaccgccagacagctgctggcctacaccgtggaggccgccaacttcagcgacaagatggacgtgatcttcgtggccgagatgatcgagaagttcggcagattcaccaaggaggagaagagcaaggagctgggcgacgtgatggtggacatcgccagcaacatcatgctggccgacgagagagtgctgtggctggcccagagagaggccaaggcctgcagcagaatcgtgcagtgcctgcagagaatcgccacctacagactggccggcggcgcccacgtgtacagcacctacagccccaacatcgccctggaggcctacgtgatcaagagcaccggcttcaccggcatgacctgcaccgtgttccagaaggtggccgccagcgacagaaccggcctgagcgactacggcagaagagaccccgagggcaacctggacaagcagctgagcttcaagtgcaacgtgagcaacaccttcagcagcctggccctgaagggcaagttcagatag

SEQ ID NO: 82379 - DNA, 2724 bp, Artificial Sequence
  Description of Artificial Sequence: Synthetic coding sequence
atgcccaccgccgccgcccccatcatcagcagcgtgcagaagctggtgctgtacgagaccagagccagatacttcctggtgggcagcaacaacgccgagaccaagtacagagtgctgaagatcgacagaaccgagcccaaggacctggtgatcatcgacgacagacacgtgtacacccagcaggaggtgagagagctgctgggcagactggacctgggcaacagaaccaagatgggccagaagggcagcagcggcctgttcagagccgtgagcgccttcggcgtggtgggcttcgtgagattcctggagggctactacatcgtgctgatcaccaagagaagaaagatggccgacatcggcggccacgccatctacaaggtggaggacaccaacatgatctacatccccaacgacagcgtgagagtgacccaccccgacgaggccagatacctgagaatcttccagaacgtggacctgagcagcaacttctacttcagctacagctacgacctgagccacagcctgcagtacaacctgaccgtgctgagaatgcccctggagatgctgaagagcgagatgacccagaacagacaggagagcttcgacatcttcgaggacgagggcctgatcacccagggcggcagcggcgtgttcggcatctgcagcgagccctacatgaagtacgtgtggaacggcgagctgctggacatcatcaagagcaccgtgcacagagactggctgctgtacatcatccacggcttctgcggccagagcaagctgctgatctacggcagacccgtgtacgtgaccctgatcgccagaagaagcagcaagttcgccggcaccagattcctgaagagaggcgccaactgcgagggcgacgtggccaacgaggtggagaccgagcagatcctgtgcgacgccagcgtgatgagcttcaccgccggcagctacagcagctacgtgcaggtgagaggcagcgtgcccctgtactggagccaggacatcagcaccatgatgcccaagccccccatcaccctggaccaggccgaccccttcgcccacgtggccgccctgcacttcgaccagatgttccagagattcggcagccccatcatcatcctgaacctggtgaaggagagagagaagagaaagcacgagagaatcctgagcgaggagctggtggccgccgtgacctacctgaaccagttcctgccccccgagcacaccatcgtgtacatcccctgggacatggccaagtacaccaagagcaagctgtgcaacgtgctggacagactgaacgtgatcgccgagagcgtggtgaagaagaccggcttcttcgtgaacagacccgacagctactgcagcatcctgagacccgacgagaagtggaacgagctgggcggctgcgtgatccccaccggcagactgcagaccggcatcctgagaaccaactgcgtggactgcctggacagaaccaacaccgcccagttcatggtgggcaagtgcgccctggcctaccagctgtacagcctgggcctgatcgacaagcccaacctgcagttcgacaccgacgccgtgagactgttcgaggagctgtacgaggaccacggcgacaccctgagcctgcagtacggcggcagccagctggtgcacagagtgaagacctacagaaagatcgccccctggacccagcacagcaaggacatcatgcagaccctgagcagatactacagcaacgccttcagcgacgccgacagacaggacagcatcaacctgttcctgggcgtgttccaccccaccgagggcaagccccacctgtgggagctgcccaccgacttctacctgcaccacaagaacaccatgagactgctgcccaccagaagaagctacacctactggtggacccccgaggtgatcaagcacctgcccctgccctacgacgaggtgatctgcgccgtgaacctgaagaagctgatcgtgaagaagttccacaagtacgaggaggagatcgacatccacaacgagttcttcagaccctacgagctgagcagcttcgacgacaccttctgcctggccatgaccagcagcgccagagacttcatgcccaagaccgtgggcatcgaccccagccccttcaccgtgagaaagcccgacgagaccggcaagagcgtgctgggcaacaagagcaacagagaggaggccgtgctgcagagaaagaccgccgccagcgccccccccccccccagcgaggaggccgtgagcagcagcagcgaggacgacagcggcaccgacagagaggaggagggcagcgtgagccagagaagcacccccgtgaagatgaccgacgccggcgacagcgccaaggtgaccgagaacgtggtgcagcccatgaaggagctgtacggcatcaacctgagcgacggcctgagcgaggaggacttcagcatctacagcagattcgtgcagctgggccagagccagcacaagcaggacaagaacagccagcagccctgcagcagatgcagcgacggcgtgatcaagctgacccccatcagcgccttcagccaggacaacatctacgaggtgcagccccccagagtggacagaaagagcaccgagatcttccaggcccacatccaggccagccagggcatcatgcagcccctgggcaaggaggacagcagcatgtacagagagtacatcagaaacagatacctgtag

SEQ ID NO: 82380 - DNA, 3582 bp, Artificial Sequence
  Description of Artificial Sequence: Synthetic coding sequence
atgatgttcagaagcgacagaatgtggagctgccactggaagtggaagcccagccccctgctgttcctgttcgccctgtacatcatgtgcgtgccccacagcgtgtggggctgcgccaactgcagagtggtgctgagcaaccccagcggcaccttcaccagcccctgctaccccaacgactaccccaacagccaggcctgcatgtggaccctgagagcccccaccggctacatcatccagatcaccttcaacgacttcgacatcgaggaggcccccaactgcatctacgacagcctgagcctggacaacggcgagagccagaccaagttctgcggcgccaccgccaagggcctgagcttcaacagcagcgccaacgagatgcacgtgagcttcagcagcgacttcagcatccagaagaagggcttcaacgccagctacatcagagtggccgtgagcctgagaaaccagaaggtgatcctgccccagaccagcgacgcctaccaggtgagcgtggccaagagcatcagcatccccgagctgagcgccttcaccctgtgcttcgaggccaccaaggtgggccacgaggacagcgactggaccgccttcagctacagcaacgccagcttcacccagctgctgagcttcggcaaggccaagagcggctacttcctgagcatcagcgacagcaagtgcctgctgaacaacgccctgcccgtgaaggagaaggaggacatcttcgccgagagcttcgagcagctgtgcctggtgtggaacaacagcctgggcagcatcggcgtgaacttcaagagaaactacgagaccgtgccctgcgacagcaccatcagcaaggtgatccccggcaacggcaagctgctgctgggcagcaaccagaacgagatcgtgagcctgaagggcgacatctacaacttcagactgtggaacttcaccatgaacgccaagatcctgagcaacctgagctgcaacgtgaagggcaacgtggtggactggcagaacgacttctggaacatccccaacctggccctgaaggccgagagcaacctgagctgcggcagctacctgatccccctgcccgccgccgagctggccagctgcgccgacctgggcaccctgtgccaggacggcatcatctacagaatcagcgtggtgatccagaacatcctgagacaccccgaggtgaaggtgcagagcaaggtggccgagtggctgaacagcaccttccagaactggaactacaccgtgtacgtggtgaacatcagcttccacctgagcgccggcgaggacaagatcaaggtgaagagaagcctggaggacgagcccagactggtgctgtgggccctgctggtgtacaacgccaccaacaacaccaacctggagggcaagatcatccagcagaagctgctgaagaacaacgagagcctggacgagggcctgagactgcacaccgtgaacgtgagacagctgggccactgcctggccatggaggagcccaagggctactactggcccagcatccagcccagcgagtacgtgctgccctgccccgacaagcccggcttcagcgccagcagaatctgcttctacaacgccaccaaccccctggtgacctactggggccccgtggacatcagcaactgcctgaaggaggccaacgaggtggccaaccagatcctgaacctgaccgccgacggccagaacctgaccagcgccaacatcaccaacatcgtggagcaggtgaagagaatcgtgaacaaggaggagaacatcgacatcaccctgggcagcaccctgatgaacatcttcagcaacatcctgagcagcagcgacagcgacctgctggagagcagcagcgaggccctgaagaccatcgacgagctggccttcaagatcgacctgaacagcaccagccacgtgaacatcaccaccagaaacctggccctgagcgtgagcagcctgctgcccggcaccaacgccatcagcaacttcagcatcggcctgcccagcaacaacgagagctacttccagatggacttcgagagcggccaggtggaccccctggccagcgtgatcctgccccccaacctgctggagaacctgagccccgaggacagcgtgctggtgagaagagcccagttcaccttcttcaacaagaccggcctgttccaggacgtgggcccccagagaaagaccctggtgagctacgtgatggcctgcagcatcggcaacatcaccatccagaacctgaaggaccccgtgcagatcaagatcaagcacaccagaacccaggaggtgcaccaccccatctgcgccttctgggacctgaacaagaacaagagcttcggcggctggaacaccagcggctgcgtggcccacagagacagcgacgccagcgagaccgtgtgcctgtgcaaccacttcacccacttcggcgtgctgatggacctgcccagaagcgccagccagctggacgccagaaacaccaaggtgctgaccttcatcagctacatcggctgcggcatcagcgccatcttcagcgccgccaccctgctgacctacgtggccttcgagaagctgagaagagactaccccagcaagatcctgatgaacctgagcaccgccctgctgttcctgaacctgctgttcctgctggacggctggatcaccagcttcaacgtggacggcctgtgcatcgccgtggccgtgctgctgcacttcttcctgctggccaccttcacctggatgggcctggaggccatccacatgtacatcgccctggtgaaggtgttcaacacctacatcagaagatacatcctgaagttctgcatcatcggctggggcctgcccgccctggtggtgagcgtggtgctggccagcagaaacaacaacgaggtgtacggcaaggagagctacggcaaggagaagggcgacgagttctgctggatccaggaccccgtgatcttctacgtgacctgcgccggctacttcggcgtgatgttcttcctgaacatcgccatgttcatcgtggtgatggtgcagatctgcggcagaaacggcaagagaagcaacagaaccctgagagaggaggtgctgagaaacctgagaagcgtggtgagcctgaccttcctgctgggcatgacctggggcttcgccttcttcgcctggggccccctgaacatccccttcatgtacctgttcagcatcttcaacagcctgcagggcctgttcatcttcatcttccactgcgccatgaaggagaacgtgcagaagcagtggagacagcacctgtgctgcggcagattcagactggccgacaacagcgactggagcaagaccgccaccaacatcatcaagaagagcagcgacaacctgggcaagagcctgagcagcagcagcatcggcagcaacagcacctacctgaccagcaagagcaagagcagcagcaccacctacttcaagagaaacagccacaccgacaacgtgagctacgagcacagcttcaacaagagcggcagcctgagacagtgcttccacggccaggtgctggtgaagaccggcccctgctag

SEQ ID NO: 82381 - DNA, 3669 bp, Artificial Sequence
  Description of Artificial Sequence: Synthetic coding sequence
atgatgttcagaagcgacagaatgtggagctgccactggaagtggaagcccagccccctgctgttcctgttcgccctgtacatcatgtgcgtgccccacagcgtgtggggctgcgccaactgcagagtggtgctgagcaaccccagcggcaccttcaccagcccctgctaccccaacgactaccccaacagccaggcctgcatgtggaccctgagagcccccaccggctacatcatccagatcaccttcaacgacttcgacatcgaggaggcccccaactgcatctacgacagcctgagcctggacaacggcgagagccagaccaagttctgcggcgccaccgccaagggcctgagcttcaacagcagcgccaacgagatgcacgtgagcttcagcagcgacttcagcatccagaagaagggcttcaacgccagctacatcagagtggccgtgagcctgagaaaccagaaggtgatcctgccccagaccagcgacgcctaccaggtgagcgtggccaagagcatcagcatccccgagctgagcgccttcaccctgtgcttcgaggccaccaaggtgggccacgaggacagcgactggaccgccttcagctacagcaacgccagcttcacccagctgctgagcttcggcaaggccaagagcggctacttcctgagcatcagcgacagcaagtgcctgctgaacaacgccctgcccgtgaaggagaaggaggacatcttcgccgagagcttcgagcagctgtgcctggtgtggaacaacagcctgggcagcatcggcgtgaacttcaagagaaactacgagaccgtgccctgcgacagcaccatcagcaaggtgatccccggcaacggcaagctgctgctgggcagcaaccagaacgagatcgtgagcctgaagggcgacatctacaacttcagactgtggaacttcaccatgaacgccaagatcctgagcaacctgagctgcaacgtgaagggcaacgtggtggactggcagaacgacttctggaacatccccaacctggccctgaaggccgagagcaacctgagctgcggcagctacctgatccccctgcccgccgccgagctggccagctgcgccgacctgggcaccctgtgccaggacggcatcatctacagaatcagcgtggtgatccagaacatcctgagacaccccgaggtgaaggtgcagagcaaggtggccgagtggctgaacagcaccttccagaactggaactacaccgtgtacgtggtgaacatcagcttccacctgagcgccggcgaggacaagatcaaggtgaagagaagcctggaggacgagcccagactggtgctgtgggccctgctggtgtacaacgccaccaacaacaccaacctggagggcaagatcatccagcagaagctgctgaagaacaacgagagcctggacgagggcctgagactgcacaccgtgaacgtgagacagctgggccactgcctggccatggaggagcccaagggctactactggcccagcatccagcccagcgagtacgtgctgccctgccccgacaagcccggcttcagcgccagcagaatctgcttctacaacgccaccaaccccctggtgacctactggggccccgtggacatcagcaactgcctgaaggaggccaacgaggtggccaaccagatcctgaacctgaccgccgacggccagaacctgaccagcgccaacatcaccaacatcgtggagcaggtgaagagaatcgtgaacaaggaggagaacatcgacatcaccctgggcagcaccctgatgaacatcttcagcaacatcctgagcagcagcgacagcgacctgctggagagcagcagcgaggccctgaagaccatcgacgagctggccttcaagatcgacctgaacagcaccagccacgtgaacatcaccaccagaaacctggccctgagcgtgagcagcctgctgcccggcaccaacgccatcagcaacttcagcatcggcctgcccagcaacaacgagagctacttccagatggacttcgagagcggccaggtggaccccctggccagcgtgatcctgccccccaacctgctggagaacctgagccccgaggacagcgtgctggtgagaagagcccagttcaccttcttcaacaagaccggcctgttccaggacgtgggcccccagagaaagaccctggtgagctacgtgatggcctgcagcatcggcaacatcaccatccagaacctgaaggaccccgtgcagatcaagatcaagcacaccagaacccaggaggtgcaccaccccatctgcgccttctgggacctgaacaagaacaagagcttcggcggctggaacaccagcggctgcgtggcccacagagacagcgacgccagcgagaccgtgtgcctgtgcaaccacttcacccacttcggcgtgctgatggacctgcccagaagcgccagccagctggacgccagaaacaccaaggtgctgaccttcatcagctacatcggctgcggcatcagcgccatcttcagcgccgccaccctgctgacctacgtggccttcgagaagctgagaagagactaccccagcaagatcctgatgaacctgagcaccgccctgctgttcctgaacctgctgttcctgctggacggctggatcaccagcttcaacgtggacggcctgtgcatcgccgtggccgtgctgctgcacttcttcctgctggccaccttcacctggatgggcctggaggccatccacatgtacatcgccctggtgaaggtgttcaacacctacatcagaagatacatcctgaagttctgcatcatcggctggggcctgcccgccctggtggtgagcgtggtgctggccagcagaaacaacaacgaggtgtacggcaaggagagctacggcaaggagaagggcgacgagttctgctggatccaggaccccgtgatcttctacgtgacctgcgccggctacttcggcgtgatgttcttcctgaacatcgccatgttcatcgtggtgatggtgcagatctgcggcagaaacggcaagagaagcaacagaaccctgagagaggaggtgctgagaaacctgagaagcgtggtgagcctgaccttcctgctgggcatgacctggggcttcgccttcttcgcctggggccccctgaacatccccttcatgtacctgttcagcatcttcaacagcctgcagggcctgttcatcttcatcttccactgcgccatgaaggagaacgtgcagaagcagtggagacagcacctgtgctgcggcagattcagactggccgacaacagcgactggagcaagaccgccaccaacatcatcaagaagagcagcgacaacctgggcaagagcctgagcagcagcagcatcggcagcaacagcacctacctgaccagcaagagcaagagcagcagcaccacctacttcaagagaaacagccacaccgacagcgccagcatggacaagagcctgagcaagctggcccacgccgacggcgaccagaccagcatcatccccgtgcaccaggtgatcgacaaggtgaagggctactgcaacgcccacagcgacaacttctacaagaacatcatcatgagcgacaccttcagccacagcaccaagttctag

SEQ ID NO: 82382 - DNA, 3753 bp, Artificial Sequence
  Description of Artificial Sequence: Synthetic coding sequence
atgatgttcagaagcgacagaatgtggagctgccactggaagtggaagcccagccccctgctgttcctgttcgccctgtacatcatgtgcgtgccccacagcgtgtggggctgcgccaactgcagagtggtgctgagcaaccccagcggcaccttcaccagcccctgctaccccaacgactaccccaacagccaggcctgcatgtggaccctgagagcccccaccggctacatcatccagatcaccttcaacgacttcgacatcgaggaggcccccaactgcatctacgacagcctgagcctggacaacggcgagagccagaccaagttctgcggcgccaccgccaagggcctgagcttcaacagcagcgccaacgagatgcacgtgagcttcagcagcgacttcagcatccagaagaagggcttcaacgccagctacatcagagtggccgtgagcctgagaaaccagaaggtgatcctgccccagaccagcgacgcctaccaggtgagcgtggccaagagcatcagcatccccgagctgagcgccttcaccctgtgcttcgaggccaccaaggtgggccacgaggacagcgactggaccgccttcagctacagcaacgccagcttcacccagctgctgagcttcggcaaggccaagagcggctacttcctgagcatcagcgacagcaagtgcctgctgaacaacgccctgcccgtgaaggagaaggaggacatcttcgccgagagcttcgagcagctgtgcctggtgtggaacaacagcctgggcagcatcggcgtgaacttcaagagaaactacgagaccgtgccctgcgacagcaccatcagcaaggtgatccccggcaacggcaagctgctgctgggcagcaaccagaacgagatcgtgagcctgaagggcgacatctacaacttcagactgtggaacttcaccatgaacgccaagatcctgagcaacctgagctgcaacgtgaagggcaacgtggtggactggcagaacgacttctggaacatccccaacctggccctgaaggccgagagcaacctgagctgcggcagctacctgatccccctgcccgccgccgagctggccagctgcgccgacctgggcaccctgtgccaggccaccgtgaacagccccagcaccaccccccccaccgtgaccaccaacatgcccgtgaccaacagaatcgacaagcagagaaacgacggcatcatctacagaatcagcgtggtgatccagaacatcctgagacaccccgaggtgaaggtgcagagcaaggtggccgagtggctgaacagcaccttccagaactggaactacaccgtgtacgtggtgaacatcagcttccacctgagcgccggcgaggacaagatcaaggtgaagagaagcctggaggacgagcccagactggtgctgtgggccctgctggtgtacaacgccaccaacaacaccaacctggagggcaagatcatccagcagaagctgctgaagaacaacgagagcctggacgagggcctgagactgcacaccgtgaacgtgagacagctgggccactgcctggccatggaggagcccaagggctactactggcccagcatccagcccagcgagtacgtgctgccctgccccgacaagcccggcttcagcgccagcagaatctgcttctacaacgccaccaaccccctggtgacctactggggccccgtggacatcagcaactgcctgaaggaggccaacgaggtggccaaccagatcctgaacctgaccgccgacggccagaacctgaccagcgccaacatcaccaacatcgtggagcaggtgaagagaatcgtgaacaaggaggagaacatcgacatcaccctgggcagcaccctgatgaacatcttcagcaacatcctgagcagcagcgacagcgacctgctggagagcagcagcgaggccctgaagaccatcgacgagctggccttcaagatcgacctgaacagcaccagccacgtgaacatcaccaccagaaacctggccctgagcgtgagcagcctgctgcccggcaccaacgccatcagcaacttcagcatcggcctgcccagcaacaacgagagctacttccagatggacttcgagagcggccaggtggaccccctggccagcgtgatcctgccccccaacctgctggagaacctgagccccgaggacagcgtgctggtgagaagagcccagttcaccttcttcaacaagaccggcctgttccaggacgtgggcccccagagaaagaccctggtgagctacgtgatggcctgcagcatcggcaacatcaccatccagaacctgaaggaccccgtgcagatcaagatcaagcacaccagaacccaggaggtgcaccaccccatctgcgccttctgggacctgaacaagaacaagagcttcggcggctggaacaccagcggctgcgtggcccacagagacagcgacgccagcgagaccgtgtgcctgtgcaaccacttcacccacttcggcgtgctgatggacctgcccagaagcgccagccagctggacgccagaaacaccaaggtgctgaccttcatcagctacatcggctgcggcatcagcgccatcttcagcgccgccaccctgctgacctacgtggccttcgagaagctgagaagagactaccccagcaagatcctgatgaacctgagcaccgccctgctgttcctgaacctgctgttcctgctggacggctggatcaccagcttcaacgtggacggcctgtgcatcgccgtggccgtgctgctgcacttcttcctgctggccaccttcacctggatgggcctggaggccatccacatgtacatcgccctggtgaaggtgttcaacacctacatcagaagatacatcctgaagttctgcatcatcggctggggcctgcccgccctggtggtgagcgtggtgctggccagcagaaacaacaacgaggtgtacggcaaggagagctacggcaaggagaagggcgacgagttctgctggatccaggaccccgtgatcttctacgtgacctgcgccggctacttcggcgtgatgttcttcctgaacatcgccatgttcatcgtggtgatggtgcagatctgcggcagaaacggcaagagaagcaacagaaccctgagagaggaggtgctgagaaacctgagaagcgtggtgagcctgaccttcctgctgggcatgacctggggcttcgccttcttcgcctggggccccctgaacatccccttcatgtacctgttcagcatcttcaacagcctgcagggcctgttcatcttcatcttccactgcgccatgaaggagaacgtgcagaagcagtggagacagcacctgtgctgcggcagattcagactggccgacaacagcgactggagcaagaccgccaccaacatcatcaagaagagcagcgacaacctgggcaagagcctgagcagcagcagcatcggcagcaacagcacctacctgaccagcaagagcaagagcagcagcaccacctacttcaagagaaacagccacaccgacagcgccagcatggacaagagcctgagcaagctggcccacgccgacggcgaccagaccagcatcatccccgtgcaccaggtgatcgacaaggtgaagggctactgcaacgcccacagcgacaacttctacaagaacatcatcatgagcgacaccttcagccacagcaccaagttctag

SEQ ID NO: 82383 - DNA, 2394 bp, Artificial Sequence
  Description of Artificial Sequence: Synthetic coding sequence
atggccagctgcagagcctggaacctgagagtgctggtggccgtggtgtgcggcctgctgaccggcatcatcctgggcctgggcatctggagaatcgtgatcagaatccagagaggcaagagcaccagcagcagcagcacccccaccgagttctgcagaaacggcggcacctgggagaacggcagatgcatctgcaccgaggagtggaagggcctgagatgcaccatcgccaacttctgcgagaacagcacctacatgggcttcaccttcgccagaatccccgtgggcagatacggccccagcctgcagacctgcggcaaggacacccccaacgccggcaaccccatggccgtgagactgtgcagcctgagcctgtacggcgagatcgagctgcagaaggtgaccatcggcaactgcaacgagaacctggagaccctggagaagcaggtgaaggacgtgaccgcccccctgaacaacatcagcagcgaggtgcagatcctgaccagcgacgccaacaagctgaccgccgagaacatcaccagcgccaccagagtggtgggccagatcttcaacaccagcagaaacgccagccccgaggccaagaaggtggccatcgtgaccgtgagccagctgctggacgccagcgaggacgccttccagagagtggccgccaccgccaacgacgacgccctgaccaccctgatcgagcagatggagacctacagcctgagcctgggcaaccagagcgtggtggagcccaacatcgccatccagagcgccaacttcagcagcgagaacgccgtgggccccagcaacgtgagattcagcgtgcagaagggcgccagcagcagcctggtgagcagcagcaccttcatccacaccaacgtggacggcctgaaccccgacgcccagaccgagctgcaggtgctgctgaacatgaccaagaactacaccaagacctgcggcttcgtggtgtaccagaacgacaagctgttccagagcaagaccttcaccgccaagagcgacttcagccagaagatcatcagcagcaagaccgacgagaacgagcaggaccagagcgccagcgtggacatggtgttcagccccaagtacaaccagaaggagttccagctgtacagctacgcctgcgtgtactggaacctgagcgccaaggactgggacacctacggctgccagaaggacaagggcaccgacggcttcctgagatgcagatgcaaccacaccaccaacttcgccgtgctgatgaccttcaagaaggactaccagtaccccaagagcctggacatcctgagcaacgtgggctgcgccctgagcgtgaccggcctggccctgaccgtgatcttccagatcgtgaccagaaaggtgagaaagaccagcgtgacctgggtgctggtgaacctgtgcatcagcatgctgatcttcaacctgctgttcgtgttcggcatcgagaacagcaacaagaacctgcagaccagcgacggcgacatcaacaacatcgacttcgacaacaacgacatccccagaaccgacaccatcaacatccccaaccccatgtgcaccgccatcgccgccctgctgcactacttcctgctggtgaccttcacctggaacgccctgagcgccgcccagctgtactacctgctgatcagaaccatgaagcccctgcccagacacttcatcctgttcatcagcctgatcggctggggcgtgcccgccatcgtggtggccatcaccgtgggcgtgatctacagccagaacggcaacaacccccagtgggagctggactacagacaggagaagatctgctggctggccatccccgagcccaacggcgtgatcaagagccccctgctgtggagcttcatcgtgcccgtgaccatcatcctgatcagcaacgtggtgatgttcatcaccatcagcatcaaggtgctgtggaagaacaaccagaacctgaccagcaccaagaaggtgagcagcatgaagaagatcgtgagcaccctgagcgtggccgtggtgttcggcatcacctggatcctggcctacctgatgctggtgaacgacgacagcatcagaatcgtgttcagctacatcttctgcctgttcaacaccacccagggcctgcagatcttcatcctgtacaccgtgagaaccaaggtgttccagagcgaggccagcaaggtgctgatgctgctgagcagcatcggcagaagaaagagcctgcccagcgtgaccagacccagactgagagtgaagatgtacaacttcctgagaagcctgcccaccctgcacgagagattcagactgctggagaccagccccagcaccgaggagatcaccctgagcgagagcgacaacgccaaggagagcatctag

SEQ ID NO: 82384 - DNA, 1509 bp, Artificial Sequence
  Description of Artificial Sequence: Synthetic coding sequence
atgcccgtgaagatgctgttcaaggagctgctgctgctgctgatgatgatgcccctgcagcactacaccaagacctgcggcttcgtggtgtaccagaacgacaagctgttccagagcaagaccttcaccgccaagagcgacttcagccagaagatcatcagcagcaagaccgacgagaacgagcaggaccagagcgccagcgtggacatggtgttcagccccaagtacaaccagaaggagttccagctgtacagctacgcctgcgtgtactggaacctgagcgccaaggactgggacacctacggctgccagaaggacaagggcaccgacggcttcctgagatgcagatgcaaccacaccaccaacttcgccgtgctgatgaccttcaagaaggactaccagtaccccaagagcctggacatcctgagcaacgtgggctgcgccctgagcgtgaccggcctggccctgaccgtgatcttccagatcgtgaccagaaaggtgagaaagaccagcgtgacctgggtgctggtgaacctgtgcatcagcatgctgatcttcaacctgctgttcgtgttcggcatcgagaacagcaacaagaacctgcagaccagcgacggcgacatcaacaacatcgacttcgacaacaacgacatccccagaaccgacaccatcaacatccccaaccccatgtgcaccgccatcgccgccctgctgcactacttcctgctggtgaccttcacctggaacgccctgagcgccgcccagctgtactacctgctgatcagaaccatgaagcccctgcccagacacttcatcctgttcatcagcctgatcggctggggcgtgcccgccatcgtggtggccatcaccgtgggcgtgatctacagccagaacggcaacaacccccagtgggagctggactacagacaggagaagatctgctggctggccatccccgagcccaacggcgtgatcaagagccccctgctgtggagcttcatcgtgcccgtgaccatcatcctgatcagcaacgtggtgatgttcatcaccatcagcatcaaggtgctgtggaagaacaaccagaacctgaccagcaccaagaaggtgagcagcatgaagaagatcgtgagcaccctgagcgtggccgtggtgttcggcatcacctggatcctggcctacctgatgctggtgaacgacgacagcatcagaatcgtgttcagctacatcttctgcctgttcaacaccacccagggcctgcagatcttcatcctgtacaccgtgagaaccaaggtgttccagagcgaggccagcaaggtgctgatgctgctgagcagcatcggcagaagaaagagcctgcccagcgtgaccagacccagactgagagtgaagatgtacaacttcctgagaagcctgcccaccctgcacgagagattcagactgctggagaccagccccagcaccgaggagatcaccctgagcgagagcgacaacgccaaggagagcatctag

SEQ ID NO: 82385 - DNA, 1143 bp, Artificial Sequence
  Description of Artificial Sequence: Synthetic coding sequence
atgtgccccatgctgctgaagaacggctacaacggcaacgccacccccgtgaccaccaccgccccctgggccagcctgggcctgagcgccaagacctgcaacaacgtgagcttcgaggagagcagaatcgtgctggtggtggtgtacagcgccgtgtgcaccctgggcgtgcccgccaactgcctgaccgcctggctggccctgctgcaggtgctgcagggcaacgtgctggccgtgtacctgctgtgcctggccctgtgcgagctgctgtacaccggcaccctgcccctgtgggtgatctacatcagaaaccagcacagatggaccctgggcctgctggcctgcaaggtgaccgcctacatcttcttctgcaacatctacgtgagcatcctgttcctgtgctgcatcagctgcgacagattcgtggccgtggtgtacgccctggagagcagaggcagaagaagaagaagaaccgccatcctgatcagcgcctgcatcttcatcctggtgggcatcgtgcactaccccgtgttccagaccgaggacaaggagacctgcttcgacatgctgcagatggacagcagaatcgccggctactactacgccagattcaccgtgggcttcgccatccccctgagcatcatcgccttcaccaaccacagaatcttcagaagcatcaagcagagcatgggcctgagcgccgcccagaaggccaaggtgaagcacagcgccatcgccgtggtggtgatcttcctggtgtgcttcgccccctaccacctggtgctgctggtgaaggccgccgccttcagctactacagaggcgacagaaacgccatgtgcggcctggaggagagactgtacaccgccagcgtggtgttcctgtgcctgagcaccgtgaacggcgtggccgaccccatcatctacgtgctggccaccgaccacagcagacaggaggtgagcagaatccacaagggctggaaggagtggagcatgaagaccgacgtgaccagactgacccacagcagagacaccgaggagctgcagagccccgtggccctggccgaccactacaccttcagcagacccgtgcacccccccggcagcccctgccccgccaagagactgatcgaggagagctgctag

SEQ ID NO: 82386 - DNA, 1116 bp, Artificial Sequence
  Description of Artificial Sequence: Synthetic coding sequence
atgcccggcaacgccacccccgtgaccaccaccgccccctgggccagcctgggcctgagcgccaagacctgcaacaacgtgagcttcgaggagagcagaatcgtgctggtggtggtgtacagcgccgtgtgcaccctgggcgtgcccgccaactgcctgaccgcctggctggccctgctgcaggtgctgcagggcaacgtgctggccgtgtacctgctgtgcctggccctgtgcgagctgctgtacaccggcaccctgcccctgtgggtgatctacatcagaaaccagcacagatggaccctgggcctgctggcctgcaaggtgaccgcctacatcttcttctgcaacatctacgtgagcatcctgttcctgtgctgcatcagctgcgacagattcgtggccgtggtgtacgccctggagagcagaggcagaagaagaagaagaaccgccatcctgatcagcgcctgcatcttcatcctggtgggcatcgtgcactaccccgtgttccagaccgaggacaaggagacctgcttcgacatgctgcagatggacagcagaatcgccggctactactacgccagattcaccgtgggcttcgccatccccctgagcatcatcgccttcaccaaccacagaatcttcagaagcatcaagcagagcatgggcctgagcgccgcccagaaggccaaggtgaagcacagcgccatcgccgtggtggtgatcttcctggtgtgcttcgccccctaccacctggtgctgctggtgaaggccgccgccttcagctactacagaggcgacagaaacgccatgtgcggcctggaggagagactgtacaccgccagcgtggtgttcctgtgcctgagcaccgtgaacggcgtggccgaccccatcatctacgtgctggccaccgaccacagcagacaggaggtgagcagaatccacaagggctggaaggagtggagcatgaagaccgacgtgaccagactgacccacagcagagacaccgaggagctgcagagccccgtggccctggccgaccactacaccttcagcagacccgtgcacccccccggcagcccctgccccgccaagagactgatcgaggagagctgctag

SEQ ID NO: 82387 - DNA, 1143 bp, Artificial Sequence; identical to SEQ ID NO: 82385
  Description of Artificial Sequence: Synthetic coding sequence

SEQ ID NO: 82388 - DNA, 33 bp, Artificial Sequence
  Description of Artificial Sequence: Synthetic coding sequence
atgtgccccatgctgctgaagaacggctactag

SEQ ID NO: 82389 - DNA, 2625 bp, Artificial Sequence
  Description of Artificial Sequence: Synthetic coding sequence
atggagaagctgctgagactgtgctgctggtacagctggctgctgctgttctactacaacttccaggtgagaggcgtgtacagcagaagccaggaccaccccggcttccaggtgctggccagcgccagccactactggcccctggagaacgtggacggcatccacgagctgcaggacaccaccggcgacatcgtggagggcaaggtgaacaagggcatctacctgaaggaggagaagggcgtgaccctgctgtactacggcagatacaacagcagctgcatcagcaagcccgagcagtgcggccccgagggcgtgaccttcagcttcttctggaagacccagggcgagcagagcagacccatccccagcgcctacggcggccaggtgatcagcaacggcttcaaggtgtgcagcagcggcggcagaggcagcgtggagctgtacaccagagacaacagcatgacctgggaggccagcttcagcccccccggcccctactggacccacgtgctgttcacctggaagagcaaggagggcctgaaggtgtacgtgaacggcaccctgagcaccagcgaccccagcggcaaggtgagcagagactacggcgagagcaacgtgaacctggtgatcggcagcgagcaggaccaggccaagtgctacgagaacggcgccttcgacgagttcatcatctgggagagagccctgacccccgacgagatcgccatgtacttcaccgccgccatcggcaagcacgccctgctgagcagcaccctgcccagcctgttcatgaccagcaccgccagccccgtgatgcccaccgacgcctaccaccccatcatcaccaacctgaccgaggagagaaagaccttccagagccccggcgtgatcctgagctacctgcagaacgtgagcctgagcctgcccagcaagagcctgagcgagcagaccgccctgaacctgaccaagaccttcctgaaggccgtgggcgagatcctgctgctgcccggctggatcgccctgagcgaggacagcgccgtggtgctgagcctgatcgacaccatcgacaccgtgatgggccacgtgagcagcaacctgcacggcagcaccccccaggtgaccgtggagggcagcagcgccatggccgagttcagcgtggccaagatcctgcccaagaccgtgaacagcagccactacagattccccgcccacggccagagcttcatccagatcccccacgaggccttccacagacacgcctggagcaccgtggtgggcctgctgtaccacagcatgcactactacctgaacaacatctggcccgcccacaccaagatcgccgaggccatgcaccaccaggactgcctgctgttcgccaccagccacctgatcagcctggaggtgagccccccccccaccctgagccagaacctgagcggcagccccctgatcaccgtgcacctgaagcacagactgaccagaaagcagcacagcgaggccaccaacagcagcaacagagtgttcgtgtactgcgccttcctggacttcagcagcggcgagggcgtgtggagcaaccacggctgcgccctgaccagaggcaacctgacctacagcgtgtgcagatgcacccacctgaccaacttcgccatcctgatgcaggtggtgcccctggagctggccagaggccaccaggtggccctgagcagcatcagctacgtgggctgcagcctgagcgtgctgtgcctggtggccaccctggtgaccttcgccgtgctgagcagcgtgagcaccatcagaaaccagagataccacatccacgccaacctgagcttcgccgtgctggtggcccaggtgctgctgctgatcagcttcagactggagcccggcaccaccccctgccaggtgatggccgtgctgctgcactacttcttcctgagcgccttcgcctggatgctggtggagggcctgcacctgtacagcatggtgatcaaggtgttcggcagcgaggacagcaagcacagatactactacggcatgggctggggcttccccctgctgatctgcatcatcagcctgagcttcgccatggacagctacggcaccagcaacaactgctggctgagcctggccagcggcgccatctgggccttcgtggcccccgccctgttcgtgatcgtggtgaacatcggcatcctgatcgccgtgaccagagtgatcagccagatcagcgccgacaactacaagatccacggcgaccccagcgccttcaagctgaccgccaaggccgtggccgtgctgctgcccatcctgggcaccagctgggtgttcggcgtgctggccgtgaacggctgcgccgtggtgttccagtacatgttcgccaccctgaacagcctgcagggcctgttcatcttcctgttccactgcctgctgaacagcgaggtgagagccgccttcaagcacaagaccaaggtgtggagcctgaccagcagcagcgccagaaccagcaacgccaagcccttccacagcgacctgatgaacggcaccagacccggcatggccagcaccaagctgagcccctgggacaagagcagccacagcgcccacagagtggacctgagcgccgtgtag

SEQ ID NO: 82390 - DNA, 687 bp, Artificial Sequence
  Description of Artificial Sequence: Synthetic coding sequence
tgacacggcgtgagcgccagagacgtgctggagagcagaaccagaaagcagcacagcgaggccaccaacagcagcaacagagtgttcgtgtactgcgccttcctggacttcagcagcggcgagggcgtgtggagcaaccacggctgcgccctgaccagaggcaacctgacctacagcgtgtgcagatgcacccacctgaccaacttcgccatcctgatgcaggtggtgcccctggaggtgaacatcggcatcctgatcgccgtgaccagagtgatcagccagatcagcgccgacaactacaagatccacggcgaccccagcgccttcaagctgaccgccaaggccgtggccgtgctgctgcccatcctgggcaccagctgggtgttcggcgtgctggccgtgaacggctgcgccgtggtgttccagtacatgttcgccaccctgaacagcctgcagggcctgttcatcttcctgttccactgcctgctgaacagcgaggtgagagccgccttcaagcacaagaccaaggtgtggagcctgaccagcagcagcgccagaaccagcaacgccaagcccttccacagcgacctgatgaacggcaccagacccggcatggccagcaccaagctgagcccctgggacaagagcagccacagcgcccacagagtggacctgagcgccgtgtag

SEQ ID NO: 82391 - DNA, 2721 bp, Artificial Sequence
  Description of Artificial Sequence: Synthetic coding sequence
atggagaagctgctgagactgtgctgctggtacagctggctgctgctgttctactacaacttccaggtgagaggcgtgtacagcagaagccaggaccaccccggcttccaggtgctggccagcgccagccactactggcccctggagaacgtggacggcatccacgagctgcaggacaccaccggcgccagcagaacccacaagctgaccgtgctgcccagcagaaacgccaccttcgtgtacagcaacgacagcgcctacagcaacctgagcgccaccgtggacatcgtggagggcaaggtgaacaagggcatctacctgaaggaggagaagggcgtgaccctgctgtactacggcagatacaacagcagctgcatcagcaagcccgagcagtgcggccccgagggcgtgaccttcagcttcttctggaagacccagggcgagcagagcagacccatccccagcgcctacggcggccaggtgatcagcaacggcttcaaggtgtgcagcagcggcggcagaggcagcgtggagctgtacaccagagacaacagcatgacctgggaggccagcttcagcccccccggcccctactggacccacgtgctgttcacctggaagagcaaggagggcctgaaggtgtacgtgaacggcaccctgagcaccagcgaccccagcggcaaggtgagcagagactacggcgagagcaacgtgaacctggtgatcggcagcgagcaggaccaggccaagtgctacgagaacggcgccttcgacgagttcatcatctgggagagagccctgacccccgacgagatcgccatgtacttcaccgccgccatcggcaagcacgccctgctgagcagcaccctgcccagcctgttcatgaccagcaccgccagccccgtgatgcccaccgacgcctaccaccccatcatcaccaacctgaccgaggagagaaagaccttccagagccccggcgtgatcctgagctacctgcagaacgtgagcctgagcctgcccagcaagagcctgagcgagcagaccgccctgaacctgaccaagaccttcctgaaggccgtgggcgagatcctgctgctgcccggctggatcgccctgagcgaggacagcgccgtggtgctgagcctgatcgacaccatcgacaccgtgatgggccacgtgagcagcaacctgcacggcagcaccccccaggtgaccgtggagggcagcagcgccatggccgagttcagcgtggccaagatcctgcccaagaccgtgaacagcagccactacagattccccgcccacggccagagcttcatccagatcccccacgaggccttccacagacacgcctggagcaccgtggtgggcctgctgtaccacagcatgcactactacctgaacaacatctggcccgcccacaccaagatcgccgaggccatgcaccaccaggactgcctgctgttcgccaccagccacctgatcagcctggaggtgagccccccccccaccctgagccagaacctgagcggcagccccctgatcaccgtgcacctgaagcacagactgaccagaaagcagcacagcgaggccaccaacagcagcaacagagtgttcgtgtactgcgccttcctggacttcagcagcggcgagggcgtgtggagcaaccacggctgcgccctgaccagaggcaacctgacctacagcgtgtgcagatgcacccacctgaccaacttcgccatcctgatgcaggtggtgcccctggagctggccagaggccaccaggtggccctgagcagcatcagctacgtgggctgcagcctgagcgtgctgtgcctggtggccaccctggtgaccttcgccgtgctgagcagcgtgagcaccatcagaaaccagagataccacatccacgccaacctgagcttcgccgtgctggtggcccaggtgctgctgctgatcagcttcagactggagcccggcaccaccccctgccaggtgatggccgtgctgctgcactacttcttcctgagcgccttcgcctggatgctggtggagggcctgcacctgtacagcatggtgatcaaggtgttcggcagcgaggacagcaagcacagatactactacggcatgggctggggcttccccctgctgatctgcatcatcagcctgagcttcgccatggacagctacggcaccagcaacaactgctggctgagcctggccagcggcgccatctgggccttcgtggcccccgccctgttcgtgatcgtggtgaacatcggcatcctgatcgccgtgaccagagtgatcagccagatcagcgccgacaactacaagatccacggcgaccccagcgccttcaagctgaccgccaaggccgtggccgtgctgctgcccatcctgggcaccagctgggtgttcggcgtgctggccgtgaacggctgcgccgtggtgttccagtacatgttcgccaccctgaacagcctgcagggcctgttcatcttcctgttccactgcctgctgaacagcgaggtgagagccgccttcaagcacaagaccaaggtgtggagcctgaccagcagcagcgccagaaccagcaacgccaagcccttccacagcgacctgatgaacggcaccagacccggcatggccagcaccaagctgagcccctgggacaagagcagccacagcgcccacagagtggacctgagcgccgtgtag

SEQ ID NO: 82392 - DNA, 1275 bp, Artificial Sequence
  Description of Artificial Sequence: Synthetic coding sequence
atgacccaggccggcagaagaggccccggcacccccgagcccagacccagaacccagcccatggccagccccagactgggcaccttctgctgccccaccagagacgccgccacccagctggtgctgagcttccagcccagagccttccacgccctgtgcctgggcagcggcggcctgagactggccctgggcctgctgcagctgctgcccggcagaagacccgccggccccggcagccccgccaccagcccccccgccagcgtgagaatcctgagagccgccgccgcctgcgacctgctgggctgcctgggcatggtgatcagaagcaccgtgtggctgggcttccccaacttcgtggacagcgtgagcgacatgaaccacaccgagatctggcccgccgccttctgcgtgggcagcgccatgtggatccagctgctgtacagcgcctgcttctggtggctgttctgctacgccgtggacgcctacctggtgatcagaagaagcgccggcctgagcaccatcctgctgtaccacatcatggcctggggcctggccaccctgctgtgcgtggagggcgccgccatgctgtactaccccagcgtgagcagatgcgagagaggcctggaccacgccatcccccactacgtgaccatgtacctgcccctgctgctggtgctggtggccaaccccatcctgttccagaagaccgtgaccgccgtggccagcctgctgaagggcagacagggcatctacaccgagaacgagagaagaatgggcgccgtgatcaagatcagattcttcaagatcatgctggtgctgatcatctgctggctgagcaacatcatcaacgagagcctgctgttctacctggagatgcagaccgacatcaacggcggcagcctgaagcccgtgagaaccgccgccaagaccacctggttcatcatgggcatcctgaaccccgcccagggcttcctgctgagcctggccttctacggctggaccggctgcagcctgggcttccagagccccagaaaggagatccagtgggagagcctgaccaccagcgccgccgagggcgcccaccccagccccctgatgccccacgagaaccccgccagcggcaaggtgagccaggtgggcggccagaccagcgacgaggccctgagcatgctgagcgagggcagcgacgccagcaccatcgagatccacaccgccagcgagagctgcaacaagaacgagggcgaccccgccctgcccacccacggcgacctgtag

SEQ ID NO: 82393 - DNA, 516 bp, Artificial Sequence
  Description of Artificial Sequence: Synthetic coding sequence
atggtgatcagaagcaccgtgtggctgggcttccccaacttcgtggacagcgtgagcgacatgaaccacaccgagatctggcccgccgccttctgcgtgggcagcgccatgtggatccagctgctgtacagcgcctgcttctggtggctgttctgctacgccgtggacgcctacctggtgatcagaagaagcgccggcctgagcaccatcctgctgtaccacatcatggcctggggcctggccaccctgctgtgcgtggagggcgccgccatgctgtactaccccagcgtgagcagatgcgagagaggcctggaccacgccatcccccactacgtgaccatgtacctgcccctgctgctggtgctggtggccaaccccatcctgttccagaagaccgtgaccgccgtggccagcctgctgaagggcagacagggcatctacaccgagaacgagagaagaatgggcgccgtgatcaagatcagattcttcaagatcatgctggtgctgatcatctag

SEQ ID NO: 82394 - DNA, 864 bp, Artificial Sequence
  Description of Artificial Sequence: Synthetic coding sequence
tgaaccgccggccccgtgaccggcagcgccagcagaggccccgccagaggccccaagggcatggtgatcagaagcaccgtgtggctgggcttccccaacttcgtggacagcgtgagcgacatgaaccacaccgagatctggcccgccgccttctgcgtgggcagcgccatgtggatccagctgctgtacagcgcctgcttctggtggctgttctgctacgccgtggacgcctacctggtgatcagaagaagcgccggcctgagcaccatcctgctgtaccacatcatggcctggggcctggccaccctgctgtgcgtggagggcgccgccatgctgtactaccccagcgtgagcagatgcgagagaggcctggaccacgccatcccccactacgtgaccatgtacctgcccctgctgctggtgctggtggccaaccccatcctgttccagaagaccgtgaccgccgtggccagcctgctgaagggcagacagggcatctacaccgagaacgagagaagaatgggcgccgtgatcaagatcagattcttcaagatcatgctggtgctgatcatctgctggctgagcaacatcatcaacgagagcctgctgttctacctggagatgcagaccgacatcaacggcggcagcctgaagcccgtgagaaccgccgccaagaccacctggttcatcatgggcatcctgaaccccgcccagggcttcctgctgagcctggccttctacggctggaccggctgcagcctgggcttccagagccccagaaaggagatccagtgggagagcctgaccaccagcgccgccgagggcgcccaccccagccccctgatgccccacgagaacccctag

SEQ ID NO: 82395 - DNA, 1215 bp, Artificial Sequence
  Description of Artificial Sequence: Synthetic coding sequence
atggccagccccagactgggcaccttctgctgccccaccagagacgccgccacccagctggtgctgagcttccagcccagagccttccacgccctgtgcctgggcagcggcggcctgagactggccctgggcctgctgcagctgctgcccggcagaagacccgccggccccggcagccccgccaccagcccccccgccagcgtgagaatcctgagagccgccgccgcctgcgacctgctgggctgcctgggcatggtgatcagaagcaccgtgtggctgggcttccccaacttcgtggacagcgtgagcgacatgaaccacaccgagatctggcccgccgccttctgcgtgggcagcgccatgtggatccagctgctgtacagcgcctgcttctggtggctgttctgctacgccgtggacgcctacctggtgatcagaagaagcgccggcctgagcaccatcctgctgtaccacatcatggcctggggcctggccaccctgctgtgcgtggagggcgccgccatgctgtactaccccagcgtgagcagatgcgagagaggcctggaccacgccatcccccactacgtgaccatgtacctgcccctgctgctggtgctggtggccaaccccatcctgttccagaagaccgtgaccgccgtggccagcctgctgaagggcagacagggcatctacaccgagaacgagagaagaatgggcgccgtgatcaagatcagattcttcaagatcatgctggtgctgatcatctgctggctgagcaacatcatcaacgagagcctgctgttctacctggagatgcagaccgacatcaacggcggcagcctgaagcccgtgagaaccgccgccaagaccacctggttcatcatgggcatcctgaaccccgcccagggcttcctgctgagcctggccttctacggctggaccggctgcagcctgggcttccagagccccagaaaggagatccagtgggagagcctgaccaccagcgccgccgagggcgcccaccccagccccctgatgccccacgagaaccccgccagcggcaaggtgagccaggtgggcggccagaccagcgacgaggccctgagcatgctgagcgagggcagcgacgccagcaccatcgagatccacaccgccagcgagagctgcaacaagaacgagggcgaccccgccctgcccacccacggcgacctgtag

SEQ ID NO: 82396 - DNA, 1083 bp, Artificial Sequence
  Description of Artificial Sequence: Synthetic coding sequence
atggaccccgaggagaccagcgtgtacctggactactactacgccaccagccccaacagcgacatcagagagacccacagccacgtgccctacaccagcgtgttcctgcccgtgttctacaccgccgtgttcctgaccggcgtgctgggcaacctggtgctgatgggcgccctgcacttcaagcccggcagcagaagactgatcgacatcttcatcatcaacctggccgccagcgacttcatcttcctggtgaccctgcccctgtgggtggacaaggaggccagcctgggcctgtggagaaccggcagcttcctgtgcaagggcagcagctacatgatcagcgtgaacatgcactgcagcgtgctgctgctgacctgcatgagcgtggacagatacctggccatcgtgtggcccgtggtgagcagaaagttcagaagaaccgactgcgcctacgtggtgtgcgccagcatctggttcatcagctgcctgctgggcctgcccaccctgctgagcagagagctgaccctgatcgacgacaagccctactgcgccgagaagaaggccacccccatcaagctgatctggagcctggtggccctgatcttcaccttcttcgtgcccctgctgagcatcgtgacctgctactgctgcatcgccagaaagctgtgcgcccactaccagcagagcggcaagcacaacaagaagctgaagaagagcatcaagatcatcttcatcgtggtggccgccttcctggtgagctggctgcccttcaacaccttcaagttcctggccatcgtgagcggcctgagacaggagcactacctgcccagcgccatcctgcagctgggcatggaggtgagcggccccctggccttcgccaacagctgcgtgaaccccttcatctactacatcttcgacagctacatcagaagagccatcgtgcactgcctgtgcccctgcctgaagaactacgacttcggcagcagcaccgagaccagcgacagccacctgaccaaggccctgagcaccttcatccacgccgaggacttcgccagaagaagaaagagaagcgtgagcctgtag

SEQ ID NO: 82397 - DNA, 1830 bp, Artificial Sequence
  Description of Artificial Sequence: Synthetic coding sequence
atgagcgacgagagaagactgcccggcagcgccgtgggctggctggtgtgcggcggcctgagcctgctggccaacgcctggggcatcctgagcgtgggcgccaagcagaagaagtggaagcccctggagttcctgctgtgcaccctggccgccacccacatgctgaacgtggccgtgcccatcgccacctacagcgtggtgcagctgagaagacagagacccgacttcgagtggaacgagggcctgtgcaaggtgttcgtgagcaccttctacaccctgaccctggccacctgcttcagcgtgaccagcctgagctaccacagaatgtggatggtgtgctggcccgtgaactacagactgagcaacgccaagaagcaggccgtgcacaccgtgatgggcatctggatggtgagcttcatcctgagcgccctgcccgccgtgggctggcacgacaccagcgagagattctacacccacggctgcagattcatcgtggccgagatcggcctgggcttcggcgtgtgcttcctgctgctggtgggcggcagcgtggccatgggcgtgatctgcaccgccatcgccctgttccagaccctggccgtgcaggtgggcagacaggccgacagaagagccttcaccgtgcccaccatcgtggtggaggacgcccagggcaagagaagaagcagcatcgacggcagcgagcccgccaagaccagcctgcagaccaccggcctggtgaccaccatcgtgttcatctacgactgcctgatgggcttccccgtgctggtggtgagcttcagcagcctgagagccgacgccagcgccccctggatggccctgtgcgtgctgtggtgcagcgtggcccaggccctgctgctgcccgtgttcctgtgggcctgcgacagatacagagccgacctgaaggccgtgagagagaagtgcatggccctgatggccaacgacgaggagagcgacgacgagaccagcctggagggcggcatcagccccgacctggtgctggagagaagcctggactacggctacggcggcgacttcgtggccctggacagaatggccaagtacgagatcagcgccctggagggcggcctgccccagctgtaccccctgagacccctgcaggaggacaagatgcagtacctgcaggtgccccccaccagaagattcagccacgacgacgccgacgtgtgggccgccgtgcccctgcccgccttcctgcccagatggggcagcggcgaggacctggccgccctggcccacctggtgctgcccgccggccccgagagaagaagagccagcctgctggccttcgccgaggacgccccccccagcagagccagaagaagaagcgccgagagcctgctgagcctgagacccagcgccctggacagcggccccagaggcgccagagacagcccccccggcagccccagaagaagacccggccccggccccagaagcgccagcgccagcctgctgcccgacgccttcgccctgaccgccttcgagtgcgagccccaggccctgagaagaccccccggccccttccccgccgcccccgccgcccccgacggcgccgaccccggcgaggcccccaccccccccagcagcgcccagagaagccccggccccagacccagcgcccacagccacgccggcagcctgagacccggcctgagcgccagctggggcgagcccggcggcctgagagccgccggcggcggcggcagcaccagcagcttcctgagcagccccagcgagagcagcggctacgccaccctgcacagcgacagcctgggcagcgccagctag

SEQ ID NO: 82398 - DNA, 2445 bp, Artificial Sequence
  Description of Artificial Sequence: Synthetic coding sequence
atggagcccgagatcaactgcagcgagctgtgcgacagcttccccggccaggagctggacagaagacccctgcacgacctgtgcaagaccaccatcaccagcagccaccacagcagcaagaccatcagcagcctgagccccgtgctgctgggcatcgtgtggaccttcctgagctgcggcctgctgctgatcctgttcttcctggccttcaccatccactgcagaaagaacagaatcgtgaagatgagcagccccaacctgaacatcgtgaccctgctgggcagctgcctgacctacagcagcgcctacctgttcggcatccaggacgtgctggtgggcagcagcatggagaccctgatccagaccagactgagcatgctgtgcatcggcaccagcctggtgttcggccccatcctgggcaagagctggagactgtacaaggtgttcacccagagagtgcccgacaagagagtgatcatcaaggacctgcagctgctgggcctggtggccgccctgctgatggccgacgtgatcctgctgatgacctgggtgctgaccgaccccatccagtgcctgcagatcctgagcgtgagcatgaccgtgaccggcaaggacgtgagctgcaccagcaccagcacccacttctgcgccagcagatacagcgacgtgtggatcgccctgatctggggctgcaagggcctgctgctgctgtacggcgcctacctggccggcctgaccggccacgtgagcagcccccccgtgaaccagagcctgaccatcatggtgggcgtgaacctgctggtgctggccgccggcctgctgttcgtggtgaccagatacctgcacagctggcccaacctggtgttcggcctgaccagcggcggcatcttcgtgtgcaccaccaccatcaactgcttcatcttcatcccccagctgaagcagtggaaggccttcgaggaggagaaccagaccatcagaagaatggccaagtacttcagcacccccaacaagagcttccacacccagtacggcgaggaggagaactgccaccccagaggcgagaagagcagcatggagagactgctgaccgagaagaacgccgtgatcgagagcctgcaggagcaggtgaacaacgccaaggagaagatcgtgagactgatgagcgccgagtgcacctacgacctgcccgagggcgccgccccccccgccagcagccccaacaaggacgtgcaggccgtggccagcgtgcacaccctggccgccgcccagggccccagcggccacctgagcgacttccagaacgaccccggcatggccgccagagacagccagtgcaccagcggccccagcagctacgcccagagcctggagggccccggcaaggacagcagcttcagccccggcaaggaggagaagatcagcgacagcaaggacttcagcgaccacctggacagcggctgcagccagaagccctggaccgagcagagcctgggccccgagagaggcgaccaggtgcccatgaaccccagccagagcctgctgcccgagagaggcggcagcgacccccagagacagagacacctggagaacagcgaggagccccccgagagaagaagcagagtgagcagcgtgatcagagagaagctgcaggaggtgctgcaggacctgggcctgggccccgaggccagcctgagcaccgcccccagctgccaccagcagacctggaagaacagcgccgccttcagcccccagaagatgcccctgagcaaggagctgggcttcagcccctacatggtgagaagaagaagagccgcccagagagccagaagccacttccccggcagcgcccccagcagcgtgggccacagagccaacagaaccgtgcccggcgcccacagcagactgcacgtgcagaacggcgacagccccagcctggccccccagaccaccgacagcagagtgagaagacccagcagcagaaagcccagcctgcccagcgacccccaggacagacccggcaccctggagggcagcaagcagagccagaccgagcccgagggcgccagaggcagcaaggccgccttcctgagacagcccagcggcagcggcagagcccccagccccgccgccccctgcctgagcaaggccagccccgacctgcccgagcagtggcagctgtggccccccgtgcccagcggctgcgccagcctgagcagccagcacagctacttcgacaccgagagcagcagcagcgacgagttcttctgcagatgccacagaccctactgcgagatctgcttccagagcagcagcgacagcagcgacagcggcaccagcgacaccgaccccgagcccaccggcggcctggccagctgggagaagctgtgggccagaagcaagcccatcgtgaacttcaaggacgacctgaagcccaccctggtgtag

SEQ ID NO: 82399 - DNA, 2445 bp, Artificial Sequence; identical to SEQ ID NO: 82398
  Description of Artificial Sequence: Synthetic coding sequence

SEQ ID NO: 82400 - DNA, 2433 bp, Artificial Sequence
  Description of Artificial Sequence: Synthetic coding sequence
atggagcccgagatcaactgcagcgagctgtgcgacagcttccccggccaggagctggacagaagacccctgcacgacctgtgcaagaccaccatcaccagcagccaccacagcagcaagaccatcagcagcctgagccccgtgctgctgggcatcgtgtggaccttcctgagctgcggcctgctgctgatcctgttcttcctggccttcaccatccactgcagaaagaacagaatcgtgaagatgagcagccccaacctgaacatcgtgaccctgctgggcagctgcctgacctacagcagcgcctacctgttcggcatccaggacgtgctggtgggcagcagcatggagaccctgatccagaccagactgagcatgctgtgcatcggcaccagcctggtgttcggccccatcctgggcaagagctggagactgtacaaggtgttcacccagagagtgcccgacaagagagtgatcatcaaggacctgcagctgctgggcctggtggccgccctgctgatggccgacgtgatcctgctgatgacctgggtgctgaccgaccccatccagtgcctgcagatcctgagcgtgaccggcaaggacgtgagctgcaccagcaccagcacccacttctgcgccagcagatacagcgacgtgtggatcgccctgatctggggctgcaagggcctgctgctgctgtacggcgcctacctggccggcctgaccggccacgtgagcagcccccccgtgaaccagagcctgaccatcatggtgggcgtgaacctgctggtgctggccgccggcctgctgttcgtggtgaccagatacctgcacagctggcccaacctggtgttcggcctgaccagcggcggcatcttcgtgtgcaccaccaccatcaactgcttcatcttcatcccccagctgaagcagtggaaggccttcgaggaggagaaccagaccatcagaagaatggccaagtacttcagcacccccaacaagagcttccacacccagtacggcgaggaggagaactgccaccccagaggcgagaagagcagcatggagagactgctgaccgagaagaacgccgtgatcgagagcctgcaggagcaggtgaacaacgccaaggagaagatcgtgagactgatgagcgccgagtgcacctacgacctgcccgagggcgccgccccccccgccagcagccccaacaaggacgtgcaggccgtggccagcgtgcacaccctggccgccgcccagggccccagcggccacctgagcgacttccagaacgaccccggcatggccgccagagacagccagtgcaccagcggccccagcagctacgcccagagcctggagggccccggcaaggacagcagcttcagccccggcaaggaggagaagatcagcgacagcaaggacttcagcgaccacctggacagcggctgcagccagaagccctggaccgagcagagcctgggccccgagagaggcgaccaggtgcccatgaaccccagccagagcctgctgcccgagagaggcggcagcgacccccagagacagagacacctggagaacagcgaggagccccccgagagaagaagcagagtgagcagcgtgatcagagagaagctgcaggaggtgctgcaggacctgggcctgggccccgaggccagcctgagcaccgcccccagctgccaccagcagacctggaagaacagcgccgccttcagcccccagaagatgcccctgagcaaggagctgggcttcagcccctacatggtgagaagaagaagagccgcccagagagccagaagccacttccccggcagcgcccccagcagcgtgggccacagagccaacagaaccgtgcccggcgcccacagcagactgcacgtgcagaacggcgacagccccagcctggccccccagaccaccgacagcagagtgagaagacccagcagcagaaagcccagcctgcccagcgacccccaggacagacccggcaccctggagggcagcaagcagagccagaccgagcccgagggcgccagaggcagcaaggccgccttcctgagacagcccagcggcagcggcagagcccccagccccgccgccccctgcctgagcaaggccagccccgacctgcccgagcagtggcagctgtggccccccgtgcccagcggctgcgccagcctgagcagccagcacagctacttcgacaccgagagcagcagcagcgacgagttcttctgcagatgccacagaccctactgcgagatctgcttccagagcagcagcgacagcagcgacagcggcaccagcgacaccgaccccgagcccaccggcggcctggccagctgggagaagctgtgggccagaagcaagcccatcgtgaacttcaaggacgacctgaagcccaccctggtgtag

SEQ ID NO: 82401 - DNA, 1590 bp, Artificial Sequence
  Description of Artificial Sequence: Synthetic coding sequence
atgagcctgaacagcagcctgagctgcagaaaggagctgagcaacctgaccgaggaggagggcggcgagggcggcgtgatcatcacccagttcatcgccatcatcgtgatcaccatcttcgtgtgcctgggcaacctggtgatcgtggtgaccctgtacaagaagagctacctgctgaccctgagcaacaagttcgtgttcagcctgaccctgagcaacttcctgctgagcgtgctggtgctgcccttcgtggtgaccagcagcatcagaagagagtggatcttcggcgtggtgtggtgcaacttcagcgccctgctgtacctgctgatcagcagcgccagcatgctgaccctgggcgtgatcgccatcgacagatactacgccgtgctgtaccccatggtgtaccccatgaagatcaccggcaacagagccgtgatggccctggtgtacatctggctgcacagcctgatcggctgcctgccccccctgttcggctggagcagcgtggagttcgacgagttcaagtggatgtgcgtggccgcctggcacagagagcccggctacaccgccttctggcagatctggtgcgccctgttccccttcctggtgatgctggtgtgctacggcttcatcttcagagtggccagagtgaaggccagaaaggtgcactgcggcaccgtggtgatcgtggaggaggacgcccagagaaccggcagaaagaacagcagcaccagcaccagcagcagcggcagcagaagaaacgccttccagggcgtggtgtacagcgccaaccagtgcaaggccctgatcaccatcctggtggtgctgggcgccttcatggtgacctggggcccctacatggtggtgatcgccagcgaggccctgtggggcaagagcagcgtgagccccagcctggagacctgggccacctggctgagcttcgccagcgccgtgtgccaccccctgatctacggcctgtggaacaagaccgtgagaaaggagctgctgggcatgtgcttcggcgacagatactacagagagcccttcgtgcagagacagagaaccagcagactgttcagcatcagcaacagaatcaccgacctgggcctgagcccccacctgaccgccctgatggccggcggccagcccctgggccacagcagcagcaccggcgacaccggcttcagctgcagccaggacagcggcaccgacatgatgctgctggaggactacaccagcgacgacaacccccccagccactgcacctgcccccccaagagaagaagcagcgtgaccttcgaggacgaggtggagcagatcaaggaggccgccaagaacagcatcctgcacgtgaaggccgaggtgcacaagagcctggacagctacgccgccagcctggccaaggccatcgaggccgaggccaagatcaacctgttcggcgaggaggccctgcccggcgtgctggtgaccgccagaaccgtgcccggcggcggcttcggcggcagaagaggcagcagaaccctggtgagccagagactgcagctgcagagcatcgaggagggcgacgtgctggccgccgagcagagatag

SEQ ID NO: 82402 - DNA, 1590 bp, Artificial Sequence; identical to SEQ ID NO: 82401
  Description of Artificial Sequence: Synthetic coding sequence

SEQ ID NO: 82403 - DNA, 1590 bp, Artificial Sequence; identical to SEQ ID NO: 82401
  Description of Artificial Sequence: Synthetic coding sequence

SEQ ID NO: 82404 - DNA, 1590 bp, Artificial Sequence; identical to SEQ ID NO: 82401
  Description of Artificial Sequence: Synthetic coding sequence

SEQ ID NO: 82405 - DNA, 1650 bp, Artificial Sequence
  Description of Artificial Sequence: Synthetic coding sequence
atgagcgccagaggcgtggtgcagcacgccctgcccacccccagaagaggcgccctgaccatgagcctgaacagcagcctgagctgcagaaaggagctgagcaacctgaccgaggaggagggcggcgagggcggcgtgatcatcacccagttcatcgccatcatcgtgatcaccatcttcgtgtgcctgggcaacctggtgatcgtggtgaccctgtacaagaagagctacctgctgaccctgagcaacaagttcgtgttcagcctgaccctgagcaacttcctgctgagcgtgctggtgctgcccttcgtggtgaccagcagcatcagaagagagtggatcttcggcgtggtgtggtgcaacttcagcgccctgctgtacctgctgatcagcagcgccagcatgctgaccctgggcgtgatcgccatcgacagatactacgccgtgctgtaccccatggtgtaccccatgaagatcaccggcaacagagccgtgatggccctggtgtacatctggctgcacagcctgatcggctgcctgccccccctgttcggctggagcagcgtggagttcgacgagttcaagtggatgtgcgtggccgcctggcacagagagcccggctacaccgccttctggcagatctggtgcgccctgttccccttcctggtgatgctggtgtgctacggcttcatcttcagagtggccagagtgaaggccagaaaggtgcactgcggcaccgtggtgatcgtggaggaggacgcccagagaaccggcagaaagaacagcagcaccagcaccagcagcagcggcagcagaagaaacgccttccagggcgtggtgtacagcgccaaccagtgcaaggccctgatcaccatcctggtggtgctgggcgccttcatggtgacctggggcccctacatggtggtgatcgccagcgaggccctgtggggcaagagcagcgtgagccccagcctggagacctgggccacctggctgagcttcgccagcgccgtgtgccaccccctgatctacggcctgtggaacaagaccgtgagaaaggagctgctgggcatgtgcttcggcgacagatactacagagagcccttcgtgcagagacagagaaccagcagactgttcagcatcagcaacagaatcaccgacctgggcctgagcccccacctgaccgccctgatggccggcggccagcccctgggccacagcagcagcaccggcgacaccggcttcagctgcagccaggacagcggcaccgacatgatgctgctggaggactacaccagcgacgacaacccccccagccactgcacctgcccccccaagagaagaagcagcgtgaccttcgaggacgaggtggagcagatcaaggaggccgccaagaacagcatcctgcacgtgaaggccgaggtgcacaagagcctggacagctacgccgccagcctggccaaggccatcgaggccgaggccaagatcaacctgttcggcgaggaggccctgcccggcgtgctggtgaccgccagaaccgtgcccggcggcggcttcggcggcagaagaggcagcagaaccctggtgagccagagactgcagctgcagagcatcgaggagggcgacgtgctggccgccgagcagagatag

SEQ ID NO: 82406 - DNA, 1356 bp, Artificial Sequence
  Description of Artificial Sequence: Synthetic coding sequence
atgggcggcagaagatgcgtgcccggcaccctgcccatgagagccgccccccccggcgccaagagactgcacgtgcccctgagagccaagggcgtgggcagaagcggccacgcccccagactggagagcgtgagaaccagctactacgccgtgctgtaccccatggtgtaccccatgaagatcaccggcaacagagccgtgatggccctggtgtacatctggctgcacagcctgatcggctgcctgccccccctgttcggctggagcagcgtggagttcgacgagttcaagtggatgtgcgtggccgcctggcacagagagcccggctacaccgccttctggcagatctggtgcgccctgttccccttcctggtgatgctggtgtgctacggcttcatcttcagagtggccagagtgaaggccagaaaggtgcactgcggcaccgtggtgatcgtggaggaggacgcccagagaaccggcagaaagaacagcagcaccagcaccagcagcagcggcagcagaagaaacgccttccagggcgtggtgtacagcgccaaccagtgcaaggccctgatcaccatcctggtggtgctgggcgccttcatggtgacctggggcccctacatggtggtgatcgccagcgaggccctgtggggcaagagcagcgtgagccccagcctggagacctgggccacctggctgagcttcgccagcgccgtgtgccaccccctgatctacggcctgtggaacaagaccgtgagaaaggagctgctgggcatgtgcttcggcgacagatactacagagagcccttcgtgcagagacagagaaccagcagactgttcagcatcagcaacagaatcaccgacctgggcctgagcccccacctgaccgccctgatggccggcggccagcccctgggccacagcagcagcaccggcgacaccggcttcagctgcagccaggacagcggcaccgacatgatgctgctggaggactacaccagcgacgacaacccccccagccactgcacctgcccccccaagagaagaagcagcgtgaccttcgaggacgaggtggagcagatcaaggaggccgccaagaacagcatcctgcacgtgaaggccgaggtgcacaagagcctggacagctacgccgccagcctggccaaggccatcgaggccgaggccaagatcaacctgttcggcgaggaggccctgcccggcgtgctggtgaccgccagaaccgtgcccggcggcggcttcggcggcagaagaggcagcagaaccctggtgagccagagactgcagctgcagagcatcgaggagggcgacgtgctggccgccgagcagagatag

SEQ ID NO: 82407 - DNA, 1248 bp, Artificial Sequence
  Description of Artificial Sequence: Synthetic coding sequence
atgctggtgcccgtgggctggatgaacgagagctactacgccgtgctgtaccccatggtgtaccccatgaagatcaccggcaacagagccgtgatggccctggtgtacatctggctgcacagcctgatcggctgcctgccccccctgttcggctggagcagcgtggagttcgacgagttcaagtggatgtgcgtggccgcctggcacagagagcccggctacaccgccttctggcagatctggtgcgccctgttccccttcctggtgatgctggtgtgctacggcttcatcttcagagtggccagagtgaaggccagaaaggtgcactgcggcaccgtggtgatcgtggaggaggacgcccagagaaccggcagaaagaacagcagcaccagcaccagcagcagcggcagcagaagaaacgccttccagggcgtggtgtacagcgccaaccagtgcaaggccctgatcaccatcctggtggtgctgggcgccttcatggtgacctggggcccctacatggtggtgatcgccagcgaggccctgtggggcaagagcagcgtgagccccagcctggagacctgggccacctggctgagcttcgccagcgccgtgtgccaccccctgatctacggcctgtggaacaagaccgtgagaaaggagctgctgggcatgtgcttcggcgacagatactacagagagcccttcgtgcagagacagagaaccagcagactgttcagcatcagcaacagaatcaccgacctgggcctgagcccccacctgaccgccctgatggccggcggccagcccctgggccacagcagcagcaccggcgacaccggcttcagctgcagccaggacagcggcaccgacatgatgctgctggaggactacaccagcgacgacaacccccccagccactgcacctgcccccccaagagaagaagcagcgtgaccttcgaggacgaggtggagcagatcaaggaggccgccaagaacagcatcctgcacgtgaaggccgaggtgcacaagagcctggacagctacgccgccagcctggccaaggccatcgaggccgaggccaagatcaacctgttcggcgaggaggccctgcccggcgtgctggtgaccgccagaaccgtgcccggcggcggcttcggcggcagaagaggcagcagaaccctggtgagccagagactgcagctgcagagcatcgaggagggcgacgtgctggccgccgagcagagatag

SEQ ID NO: 82408 - DNA, 1104 bp, Artificial Sequence
  Description of Artificial Sequence: Synthetic coding sequence
atgagcaagagaagctggtgggccggcagcagaaagccccccagagagatgctgaagctgagcggcagcgacagcagccagagcatgaacggcctggaggtggccccccccggcctgatcaccaacttcagcctggccaccgccgagcagtgcggccaggagacccccctggagaacatgctgttcgccagcttctacctgctggacttcatcctggccctggtgggcaacaccctggccctgtggctgttcatcagagaccacaagagcggcacccccgccaacgtgttcctgatgcacctggccgtggccgacctgagctgcgtgctggtgctgcccaccagactggtgtaccacttcagcggcaaccactggcccttcggcgagatcgcctgcagactgaccggcttcctgttctacctgaacatgtacgccagcatctacttcctgacctgcatcagcgccgacagattcctggccatcgtgcaccccgtgaagagcctgaagctgagaagacccctgtacgcccacctggcctgcgccttcctgtgggtggtggtggccgtggccatggcccccctgctggtgagcccccagaccgtgcagaccaaccacaccgtggtgtgcctgcagctgtacagagagaaggccagccaccacgccctggtgagcctggccgtggccttcaccttccccttcatcaccaccgtgacctgctacctgctgatcatcagaagcctgagacagggcctgagagtggagaagagactgaagaccaaggccgtgagaatgatcgccatcgtgctggccatcttcctggtgtgcttcgtgccctaccacgtgaacagaagcgtgtacgtgctgcactacagaagccacggcgccagctgcgccacccagagaatcctggccctggccaacagaatcaccagctgcctgaccagcctgaacggcgccctggaccccatcatgtacttcttcgtggccgagaagttcagacacgccctgtgcaacctgctgtgcggcaagagactgaagggccccccccccagcttcgagggcaagaccaacgagagcagcctgagcgccaagagcgagctgtag

SEQ ID NO: 82409 - DNA, 312 bp, Artificial Sequence
  Description of Artificial Sequence: Synthetic coding sequence
atgaacggcctggaggtggccccccccggcctgatcaccaacttcagcctggccaccgccgagcagtgcggccaggagacccccctggagaacatgctgttcgccagcttctacctgcccctgcccagacagcccagaatgtgcaccgtgaccggcctgaccgccggcagcaccgccagaagcaagcagcacctggaggtggtgttcgccgtgctgcccgccttcaagctgcagagaggcagaagagagagaaccagcaagccccccatcatccccatgagcagccccggcccctgctgggtgagaacctag

SEQ ID NO: 82410 - DNA, 1104 bp, Artificial Sequence; identical to SEQ ID NO: 82408
  Description of Artificial Sequence: Synthetic coding sequence

SEQ ID NO: 82411 - DNA, 411 bp, Artificial Sequence
  Description of Artificial Sequence: Synthetic coding sequence
atgagcaagagaagctggtgggccggcagcagaaagccccccagagagatgctgaagctgagcggcagcgacagcagccagagcatgaacggcctggaggtggccccccccggcctgatcaccaacttcagcctggccaccgccgagcagtgcggccaggagacccccctggagaacatgctgttcgccagcttctacctgctggacttcatcctggccctggtgggcaacaccctggccctgtggctgttcatcagagaccacaagagcggcacccccgccaacgtgttcctgatgcacctggccgtggccgacctgagctgcgtgctggtgctgcccaccagactggtgtaccacttcagcggcaaccactggcccttcggcgagatcgcctgcagactgaccggctag

SEQ ID NO: 82412 - DNA, 1104 bp, Artificial Sequence; identical to SEQ ID NO: 82408
  Description of Artificial Sequence: Synthetic coding sequence

SEQ ID NO: 82413 - DNA, 1338 bp, Artificial Sequence
  Description of Artificial Sequence: Synthetic coding sequence
atggccgcccccacccccgccagacccgtgctgacccacctgctggtggccctgttcggcatgggcagctgggccgccgtgaacggcatctgggtggagctgcccgtggtggtgaaggagctgcccgagggctggagcctgcccagctacgtgagcgtgctggtggccctgggcaacctgggcctgctggtggtgaccctgtggagaagactggcccccggcaaggacgagcaggtgcccatcagagtggtgcaggtgctgggcatggtgggcaccgccctgctggccagcctgtggcaccacgtggcccccgtggccggccagctgcacagcgtggccttcctggccctggccttcgtgctggccctggcctgctgcgccagcaacgtgaccttcctgcccttcctgagccacctgccccccagattcctgagaagcttcttcctgggccagggcctgagcgccctgctgccctgcgtgctggccctggtgcagggcgtgggcagactggagtgcccccccgcccccatcaacggcacccccggcccccccctggacttcctggagagattccccgccagcaccttcttctgggccctgaccgccctgctggtggccagcgccgccgccttccagggcctgctgctgctgctgccccccccccccagcgtgcccaccggcgagctgggcagcggcctgcaggtgggcgcccccggcgccgaggaggaggtggaggagagcagccccctgcaggagccccccagccaggccgccggcaccacccccggccccgaccccaaggcctaccagctgctgagcgccagaagcgcctgcctgctgggcctgctggccgccaccaacgccctgaccaacggcgtgctgcccgccgtgcagagcttcagctgcctgccctacggcagactggcctaccacctggccgtggtgctgggcagcgccgccaaccccctggcctgcttcctggccatgggcgtgctgtgcagaagcctggccggcctgggcggcctgagcctgctgggcgtgttctgcggcggctacctgatggccctggccgtgctgagcccctgcccccccctggtgggcaccagcgccggcgtggtgctggtggtgctgagctgggtgctgtgcctgggcgtgttcagctacgtgaaggtggccgccagcagcctgctgcacggcggcggcagacccgccctgctggccgccggcgtggccatccaggtgggcagcctgctgggcgccgtggccatgttcccccccaccagcatctaccacgtgttccacagcagaaaggactgcgccgacccctgcgacagctag

SEQ ID NO: 82414 - DNA, 1338 bp, Artificial Sequence; identical to SEQ ID NO: 82413
  Description of Artificial Sequence: Synthetic coding sequence

SEQ ID NO: 82415 - DNA, 1338 bp, Artificial Sequence; identical to SEQ ID NO: 82413
  Description of Artificial Sequence: Synthetic coding sequence

SEQ ID NO: 82416 - DNA, 1338 bp, Artificial Sequence; identical to SEQ ID NO: 82413
  Description of Artificial Sequence: Synthetic coding sequence

SEQ ID NO: 82417 - DNA, 1338 bp, Artificial Sequence; identical to SEQ ID NO: 82413
  Description of Artificial Sequence: Synthetic coding sequence

SEQ ID NO: 82418 - DNA, 1074 bp, Artificial Sequence
  Description of Artificial Sequence: Synthetic coding sequence
atggtgggcaccgccctgctggccagcctgtggcaccacgtggcccccgtggccggccagctgcacagcgtggccttcctggccctggccttcgtgctggccctggcctgctgcgccagcaacgtgaccttcctgcccttcctgagccacctgccccccagattcctgagaagcttcttcctgggccagggcctgagcgccctgctgccctgcgtgctggccctggtgcagggcgtgggcagactggagtgcccccccgcccccatcaacggcacccccggcccccccctggacttcctggagagattccccgccagcaccttcttctgggccctgaccgccctgctggtggccagcgccgccgccttccagggcctgctgctgctgctgccccccccccccagcgtgcccaccggcgagctgggcagcggcctgcaggtgggcgcccccggcgccgaggaggaggtggaggagagcagccccctgcaggagccccccagccaggccgccggcaccacccccggccccgaccccaaggcctaccagctgctgagcgccagaagcgcctgcctgctgggcctgctggccgccaccaacgccctgaccaacggcgtgctgcccgccgtgcagagcttcagctgcctgccctacggcagactggcctaccacctggccgtggtgctgggcagcgccgccaaccccctggcctgcttcctggccatgggcgtgctgtgcagaagcctggccggcctgggcggcctgagcctgctgggcgtgttctgcggcggctacctgatggccctggccgtgctgagcccctgcccccccctggtgggcaccagcgccggcgtggtgctggtggtgctgagctgggtgctgtgcctgggcgtgttcagctacgtgaaggtggccgccagcagcctgctgcacggcggcggcagacccgccctgctggccgccggcgtggccatccaggtgggcagcctgctgggcgccgtggccatgttcccccccaccagcatctaccacgtgttccacagcagaaaggactgcgccgacccctgcgacagctag

SEQ ID NO: 82419 - DNA, 1347 bp, Artificial Sequence
  Description of Artificial Sequence: Synthetic coding sequence
atggccgcccccaccctgggcagactggtgctgacccacctgctggtggccctgttcggcatgggcagctgggccgccgtgaacggcatctgggtggagctgcccgtggtggtgaaggacctgcccgagggctggagcctgcccagctacctgagcgtggtggtggccctgggcaacctgggcctgctggtggtgaccctgtggagacagctggcccccggcaagggcgagcaggtgcccatccaggtggtgcaggtgctgagcgtggtgggcaccgccctgctggcccccctgtggcaccacgtggcccccgtggccggccagctgcacagcgtggccttcctgaccctggccctggtgctggccatggcctgctgcaccagcaacgtgaccttcctgcccttcctgagccacctgcccccccccttcctgagaagcttcttcctgggccagggcctgagcgccctgctgccctgcgtgctggccctggtgcagggcgtgggcagactggagtgcccccccgcccccaccaacggcaccagcggcccccccctggacttccccgagagattccccgccagcaccttcttctgggccctgaccgccctgctggtgaccagcgccgccgccttcagaggcctgctgctgctgctgcccagcctgcccagcgtgaccaccggcggcagcggccccgagctgcagctgggcagccccggcgccgaggaggaggagaaggaggaggaggaggccctgcccctgcaggagccccccagccaggccgccggcaccatccccggccccgaccccgaggcccaccagctgttcagcgcccacggcgccttcctgctgggcctgatggccttcaccagcgccgtgaccaacggcgtgctgcccagcgtgcagagcttcagctgcctgccctacggcagactggcctaccacctggccgtggtgctgggcagcgccgccaaccccctggcctgcttcctggccatgggcgtgctgtgcagaagcctggccggcctggtgggcctgagcctgctgggcatgctgttcggcgcctacctgatggccctggccatcctgagcccctgcccccccctggtgggcaccaccgccggcgtggtgctggtggtgctgagctgggtgctgtgcctgtgcgtgttcagctacgtgaaggtggccgccagcagcctgctgcacggcggcggcagacccgccctgctggccgccggcgtggccatccaggtgggcagcctgctgggcgccggcgccatgttcccccccaccagcatctaccacgtgttccagagcagaaaggactgcgtggacccctgcggcccctag

SEQ ID NO: 82420 - DNA, 1347 bp, Artificial Sequence; identical to SEQ ID NO: 82419
  Description of Artificial Sequence: Synthetic coding sequence

SEQ ID NO: 82421 - DNA, 1053 bp, Artificial Sequence
  Description of Artificial Sequence: Synthetic coding sequence
atggccgcccccaccctgggcagactggtgctgacccacctgctggtggccctgttcggcatgggcagctgggccgccgtgaacggcatctgggtggagctgcccgtggtggtgaaggacctgcccgagggctggagcctgcccagctacctgagcgtggtggtggccctgggcaacctgggcctgctggtggtgaccctgtggagacagctggcccccggcaagggcgagcaggtgcccatccaggtggtgcaggtgctgagcgtggtgggcaccgccctgctggcccccctgtggcaccacgtggcccccgtggccggccagctgcacagcgtggccttcctgaccctggccctggtgctggccatggcctgctgcaccagcaacgtgaccttcctgcccttcctgagccacctgcccccccccttcctgagaagcttcttcctgggccagggcctgagcgccctgctgccctgcgtgctggccctggtgcagggcgtgggcagactggagtgcccccccgcccccaccaacggcaccagcggcccccccctggacttccccgagagattccccgccagcaccttcttctgggccctgaccgccctgctggtgaccagcgccgccgccttcagaggcctgctgctgctgctgcccagcctgcccagcgtgaccaccggcggcagcggccccgagctgcagctgggcagccccggcgccgaggaggaggagaaggaggaggaggaggccctgcccctgcaggagccccccagccaggccgccggcaccatccccggccccgaccccgaggcccaccagctgttcagcgcccacggcgccttcctgctgggcctgatggccttcaccagcgccgtgaccaacggcgtgctgcccagcgtgcagagcttcagctgcctgccctacggcagactggcctaccacctggccgtggtgctgggcagcgccgccaaccccctggcctgcttcctggccatgggcgtgctgtgcagatgctgcagaggctgctgcgtgtgcgtgtgcagccacatgtag

SEQ ID NO: 82422 - DNA, 1413 bp, Artificial Sequence
  Description of Artificial Sequence: Synthetic coding sequence
atgcccgcccccctgctgctgatcagcagaaccctgggcaacttcatggtgctgtggagcacctgcagaaccaccgtgttcaagagcgtgaccaacagattcatcaagaacctggcctgcagcggcatctgcgccagcctggtgtgcgtgcccttcgacatcatcctgagcaccagcccccactgctgctggtggatctacaccatgctgttctgcaaggtggtgaagttcctgcacaaggtgttctgcagcgtgaccatcctgagcttccccgccatcgccctggacagatactacagcgtgctgtaccccctggagagaaagatcagcgacgccaagagcagagagctggtgatgtacatctgggcccacgccgtggtggccagcgtgcccgtgttcgccgtgaccaacgtggccgacatctacgccaccagcacctgcaccgaggtgtggagcaacagcctgggccacctggtgtacgtgctggtgtacaacatcaccaccgtgatcgtgcccgtggtggtggtgttcctgttcctgatcctgatcagaagagccctgagcgccagccagaagaagaaggtgatcatcgccgccctgagaaccccccagaacaccatcagcatcccctacgccagccagagagaggccgagctgcacgccaccctgctgagcatggtgatggtgttcatcctgtgcagcgtgccctacgccaccctggtggtgtaccagaccgtgctgaacgtgcccgacaccagcgtgttcctgctgctgaccgccgtgtggctgcccaaggtgagcctgctggccaaccccgtgctgttcctgaccgtgaacaagagcgtgagaaagtgcctgatcggcaccctggtgcagctgcaccacagatacagcagaagaaacgtggtgagcaccggcagcggcatggccgaggccagcctggagcccagcatcagaagcggcagccagctgctggagatgttccacatcggccagcagcagatcttcaagcccaccgaggacgaggaggagagcgaggccaagtacatcggcagcgccgacttccaggccaaggagatcttcagcacctgcctggagggcgagcagggcccccagttcgcccccagcgccccccccctgagcaccgtggacagcgtgagccaggtggcccccgccgcccccgtggagcccgagaccttccccgacaagtacagcctgcagttcggcttcggccccttcgagctgcccccccagtggctgagcgagaccagaaacagcaagaagagactgctgccccccctgggcaacacccccgaggagctgatccagaccaaggtgcccaaggtgggcagagtggagagaaagatgagcagaaacaacaaggtgagcatcttccccaaggtggacagctag

SEQ ID NO: 82423 - DNA, 1548 bp, Artificial Sequence
  Description of Artificial Sequence: Synthetic coding sequence
atgggccacaacggcagctggatcagccccaacgccagcgagccccacaacgccagcggcgccgaggccgccggcgtgaacagaagcgccctgggcgagttcggcgaggcccagctgtacagacagttcaccaccaccgtgcaggtggtgatcttcatcggcagcctgctgggcaacttcatggtgctgtggagcacctgcagaaccaccgtgttcaagagcgtgaccaacagattcatcaagaacctggcctgcagcggcatctgcgccagcctggtgtgcgtgcccttcgacatcatcctgagcaccagcccccactgctgctggtggatctacaccatgctgttctgcaaggtggtgaagttcctgcacaaggtgttctgcagcgtgaccatcctgagcttccccgccatcgccctggacagatactacagcgtgctgtaccccctggagagaaagatcagcgacgccaagagcagagagctggtgatgtacatctgggcccacgccgtggtggccagcgtgcccgtgttcgccgtgaccaacgtggccgacatctacgccaccagcacctgcaccgaggtgtggagcaacagcctgggccacctggtgtacgtgctggtgtacaacatcaccaccgtgatcgtgcccgtggtggtggtgttcctgttcctgatcctgatcagaagagccctgagcgccagccagaagaagaaggtgatcatcgccgccctgagaaccccccagaacaccatcagcatcccctacgccagccagagagaggccgagctgcacgccaccctgctgagcatggtgatggtgttcatcctgtgcagcgtgccctacgccaccctggtggtgtaccagaccgtgctgaacgtgcccgacaccagcgtgttcctgctgctgaccgccgtgtggctgcccaaggtgagcctgctggccaaccccgtgctgttcctgaccgtgaacaagagcgtgagaaagtgcctgatcggcaccctggtgcagctgcaccacagatacagcagaagaaacgtggtgagcaccggcagcggcatggccgaggccagcctggagcccagcatcagaagcggcagccagctgctggagatgttccacatcggccagcagcagatcttcaagcccaccgaggacgaggaggagagcgaggccaagtacatcggcagcgccgacttccaggccaaggagatcttcagcacctgcctggagggcgagcagggcccccagttcgcccccagcgccccccccctgagcaccgtggacagcgtgagccaggtggcccccgccgcccccgtggagcccgagaccttccccgacaagtacagcctgcagttcggcttcggccccttcgagctgcccccccagtggctgagcgagaccagaaacagcaagaagagactgctgccccccctgggcaacacccccgaggagctgatccagaccaaggtgcccaaggtgggcagagtggagagaaagatgagcagaaacaacaaggtgagcatcttccccaaggtggacagctag

SEQ ID NO: 82424 - DNA, 1548 bp, Artificial Sequence; identical to SEQ ID NO: 82423
  Description of Artificial Sequence: Synthetic coding sequence

SEQ ID NO: 82425 - DNA, 996 bp, Artificial Sequence
  Description of Artificial Sequence: Synthetic coding sequence
atgatcaccctgaacaaccaggaccagcccgtgcccttcaacagcagccaccccgacgagtacaagatcgccgccctggtgttctacagctgcatcttcatcatcggcctgttcgtgaacatcaccgccctgtgggtgttcagctgcaccaccaagaagagaaccaccgtgaccatctacatgatgaacgtggccctggtggacctgatcttcatcatgaccctgcccttcagaatgttctactacgccaaggacgagtggcccttcggcgagtacttctgccagatcctgggcgccctgaccgtgttctaccccagcatcgccctgtggctgctggccttcatcagcgccgacagatacatggccatcgtgcagcccaagtacgccaaggagctgaagaacacctgcaaggccgtgctggcctgcgtgggcgtgtggatcatgaccctgaccaccaccacccccctgctgctgctgtacaaggaccccgacaaggacagcacccccgccacctgcctgaagatcagcgacatcatctacctgaaggccgtgaacgtgctgaacctgaccagactgaccttcttcttcctgatccccctgttcatcatgatcggctgctacctggtgatcatccacaacctgctgcacggcagaaccagcaagctgaagcccaaggtgaaggagaagagcatcagaatcatcatcaccctgctggtgcaggtgctggtgtgcttcatgcccttccacatctgcttcgccttcctgatgctgggcaccggcgagaacagctacaacccctggggcgccttcaccaccttcctgatgaacctgagcacctgcctggacgtgatcctgtactacatcgtgagcaagcagttccaggccagagtgatcagcgtgatgctgtacagaaactacctgagaagcatgagaagaaagagcttcagaagcggcagcctgagaagcctgagcaacatcaacagcgagatgctgtag

SEQ ID NO: 82426 - DNA, 996 bp, Artificial Sequence; identical to SEQ ID NO: 82425
  Description of Artificial Sequence: Synthetic coding sequence

SEQ ID NO: 82427 - DNA, 996 bp, Artificial Sequence; identical to SEQ ID NO: 82425
  Description of Artificial Sequence: Synthetic coding sequence

SEQ ID NO: 82428 - DNA, 297 bp, Artificial Sequence
  Description of Artificial Sequence: Synthetic coding sequence
atgatcaccctgaacaaccaggaccagcccgtgcccttcaacagcagccaccccgacgagtacaagatcgccgccctggtgttctacagctgcatcttcatcatcggcctgttcgtgaacatcaccgccctgtgggtgttcagctgcaccaccaagaagagaaccaccgtgaccatctacatgatgaacgtggccctggtggacctgatcttcatcatgaccctgcccttcagaatgttctactacgccaaggacgagtggcccttcggcgagtacttctgccagatcctgggctag

SEQ ID NO: 82429 - DNA, 1086 bp, Artificial Sequence
  Description of Artificial Sequence: Synthetic coding sequence
atggacatccagatggccaacaacttcaccccccccagcgccaccccccagggcaacgactgcgacctgtacgcccaccacagcaccgccagaatcgtgatgcccctgcactacagcctggtgttcatcatcggcctggtgggcaacctgctggccctggtggtgatcgtgcagaacagaaagaagatcaacagcaccaccctgtacagcaccaacctggtgatcagcgacatcctgttcaccaccgccctgcccaccagaatcgcctactacgccatgggcttcgactggagaatcggcgacgccctgtgcagaatcaccgccctggtgttctacatcaacacctacgccggcgtgaacttcatgacctgcctgagcatcgacagattcatcgccgtggtgcaccccctgagatacaacaagatcaagagaatcgagcacgccaagggcgtgtgcatcttcgtgtggatcctggtgttcgcccagaccctgcccctgctgatcaaccccatgagcaagcaggaggccgagagaatcacctgcatggagtaccccaacttcgaggagaccaagagcctgccctggatcctgctgggcgcctgcttcatcggctacgtgctgcccctgatcatcatcctgatctgctacagccagatctgctgcaagctgttcagaaccgccaagcagaaccccctgaccgagaagagcggcgtgaacaagaaggccctgaacaccatcatcctgatcatcgtggtgttcgtgctgtgcttcaccccctaccacgtggccatcatccagcacatgatcaagaagctgagattcagcaacttcctggagtgcagccagagacacagcttccagatcagcctgcacttcaccgtgtgcctgatgaacttcaactgctgcatggaccccttcatctacttcttcgcctgcaagggctacaagagaaaggtgatgagaatgctgaagagacaggtgagcgtgagcatcagcagcgccgtgaagagcgcccccgaggagaacagcagagagatgaccgagacccagatgatgatccacagcaagagcagcaacggcaagtag

SEQ ID NO: 82430 - DNA, 1248 bp, Artificial Sequence
  Description of Artificial Sequence: Synthetic coding sequence
atggtgttcgcccacagaatggacaacagcaagccccacctgatcatccccaccctgctggtgcccctgcagaacagaagctgcaccgagaccgccacccccctgcccagccagtacctgatggagctgagcgaggagcacagctggatgagcaaccagaccgacctgcactacgtgctgaagcccggcgaggtggccaccgccagcatcttcttcggcatcctgtggctgttcagcatcttcggcaacagcctggtgtgcctggtgatccacagaagcagaagaacccagagcaccaccaactacttcgtggtgagcatggcctgcgccgacctgctgatcagcgtggccagcacccccttcgtgctgctgcagttcaccaccggcagatggaccctgggcagcgccacctgcaaggtggtgagatacttccagtacctgacccccggcgtgcagatctacgtgctgctgagcatctgcatcgacagattctacaccatcgtgtaccccctgagcttcaaggtgagcagagagaaggccaagaagatgatcgccgccagctgggtgttcgacgccggcttcgtgacccccgtgctgttcttctacggcagcaactgggacagccactgcaactacttcctgcccagcagctgggagggcaccgcctacaccgtgatccacttcctggtgggcttcgtgatccccagcgtgctgatcatcctgttctaccagaaggtgatcaagtacatctggagaatcggcaccgacggcagaaccgtgagaagaaccatgaacatcgtgcccagaaccaaggtgaagaccatcaagatgttcctgatcctgaacctgctgttcctgctgagctggctgcccttccacgtggcccagctgtggcacccccacgagcaggactacaagaagagcagcctggtgttcaccgccatcacctggatcagcttcagcagcagcgccagcaagcccaccctgtacagcatctacaacgccaacttcagaagaggcatgaaggagaccttctgcatgagcagcatgaagtgctacagaagcaacgcctacaccatcaccaccagcagcagaatggccaagaagaactacgtgggcatcagcgagatccccagcatggccaagaccatcaccaaggacagcatctacgacagcttcgacagagaggccaaggagaagaagctggcctggcccatcaacagcaacccccccaacaccttcgtgtag

SEQ ID NO: 82431 - DNA, 1248 bp, Artificial Sequence; identical to SEQ ID NO: 82430
  Description of Artificial Sequence: Synthetic coding sequence

SEQ ID NO: 82432 - DNA, 180 bp, Artificial Sequence
  Description of Artificial Sequence: Synthetic coding sequence
atggtgttcgcccacagaatggacaacagcaagccccacctgatcatccccaccctgctggtgcccctgcagaacagaagctgcaccgagaccgccacccccctgcccagccagtacctgatggagctgagcgaggagcacagctggatgagcaaccagaccgacctgcactacgtgtag

SEQ ID NO: 82433 - DNA, 1077 bp, Artificial Sequence
  Description of Artificial Sequence: Synthetic coding sequence
atgcccagcgtgagccccgccggccccagcgccggcgccgtgcccaacgccaccgccgtgaccaccgtgagaaccaacgccagcggcctggaggtgcccctgttccacctgttcgccagactggacgaggagctgcacggcaccttccccggcctgtggctggccctgatggccgtgcacggcgccatcttcctggccggcctggtgctgaacggcctggccctgtacgtgttctgctgcagaaccagagccaagacccccagcgtgatctacaccatcaacctggtggtgaccgacctgctggtgggcctgagcctgcccaccagattcgccgtgtactacggcgccagaggctgcctgagatgcgccttcccccacgtgctgggctacttcctgaacatgcactgcagcatcctgttcctgacctgcatctgcgtggacagatacctggccatcgtgagacccgagggcagcagaagatgcagacagcccgcctgcgccagagccgtgtgcgccttcgtgtggctggccgccggcgccgtgaccctgagcgtgctgggcgtgaccggcagcagaccctgctgcagagtgttcgccctgaccgtgctggagttcctgctgcccctgctggtgatcagcgtgttcaccggcagaatcatgtgcgccctgagcagacccggcctgctgcaccagggcagacagagaagagtgagagccatgcagctgctgctgaccgtgctgatcatcttcctggtgtgcttcacccccttccacgccagacaggtggccgtggccctgtggcccgacatgccccaccacaccagcctggtggtgtaccacgtggccgtgaccctgagcagcctgaacagctgcatggaccccatcgtgtactgcttcgtgaccagcggcttccaggccaccgtgagaggcctgttcggccagcacggcgagagagagcccagcagcggcgacgtggtgagcatgcacagaagcagcaagggcagcggcagacaccacatcctgagcgccggcccccacgccctgacccaggccctggccaacggccccgaggcctag

SEQ ID NO: 82434 - DNA, 1050 bp, Artificial Sequence
  Description of Artificial Sequence: Synthetic coding sequence
atgaacagcaccctggacggcaaccagagcagccaccccttctgcctgctggccttcggctacctggagaccgtgaacttctgcctgctggaggtgctgatcatcgtgttcctgaccgtgctgatcatcagcggcaacatcatcgtgatcttcgtgttccactgcgcccccctgctgaaccaccacaccaccagctacttcatccagaccatggcctacgccgacctgttcgtgggcgtgagctgcgtggtgcccagcctgagcctgctgcaccaccccctgcccgtggaggagagcctgacctgccagatcttcggcttcgtggtgagcgtgctgaagagcgtgagcatggccagcctggcctgcatcagcatcgacagatacatcgccatcaccaagcccctgacctacaacaccctggtgaccccctggagactgagactgtgcatcttcctgatctggctgtacagcaccctggtgttcctgcccagcttcttccactggggcaagcccggctaccacggcgacgtgttccagtggtgcgccgagagctggcacaccgacagctacttcaccctgttcatcgtgatgatgctgtacgcccccgccgccctgatcgtgtgcttcacctacttcaacatcttcagaatctgccagcagcacaccaaggacatcagcgagagacaggccagattcagcagccagagcggcgagaccggcgaggtgcaggcctgccccgacaagagatacgccatggtgctgttcagaatcaccagcgtgttctacatcctgtggctgccctacatcatctacttcctgctggagagcagcaccggccacagcaacagattcgccagcttcctgaccacctggctggccatcagcaacagcttctgcaactgcgtgatctacagcctgagcaacagcgtgttccagagaggcctgaagagactgagcggcgccatgtgcaccagctgcgccagccagaccaccgccaacgacccctacaccgtgagaagcaagggccccctgaacggctgccacatctag

SEQ ID NO: 82435 - DNA, 753 bp, Artificial Sequence
  Description of Artificial Sequence: Synthetic coding sequence
atgaacagcaccctggacggcaaccagagcagccaccccttctgcctgctggccttcggctacctggagaccgtgaacttctgcctgctggaggtgctgatcatcgtgttcctgaccgtgctgatcatcagcggcaacatcatcgtgatcttcgtgttccactgcgcccccctgctgaaccaccacaccaccagctacttcatccagaccatggcctacgccgacctgttcgtgggcgtgagctgcgtggtgcccagcctgagcctgctgcaccaccccctgcccgtggaggagagcctgacctgccagatcttcggcttcgtggtgagcgtgctgaagagcgtgagcatggccagcctggcctgcatcagcatcgacagatacatcgccatcaccaagcccctgacctacaacaccctggtgaccccctggagactgagactgtgcatcttcctgatctggctgtacagcaccctggtgttcctgcccagcttcttccactggggcaagcccggctaccacggcgacgtgttccagtggtgcgccgagagctggcacaccgacagctacttcaccctgttcatcgtgatgatgctgtacgcccccgccgccctgatcgtgtgcttcacctacttcaacatcttcagaatctgccagcagcacaccaaggacatcagcgagagacaggccagattcagcagccagagcggcgagaccggcgaggtgcaggcctgccccgtgagcaaccactag

SEQ ID NO: 82436 - DNA, 1302 bp, Artificial Sequence
  Description of Artificial Sequence: Synthetic coding sequence
atgtgcttcagccccatcctggagatcaacatgcagagcgagagcaacatcaccgtgagagacgacatcgacgacatcaacaccaacatgtaccagcccctgagctaccccctgagcttccaggtgagcctgaccggcttcctgatgctggagatcgtgctgggcctgggcagcaacctgaccgtgctggtgctgtactgcatgaagagcaacctgatcaacagcgtgagcaacatcatcaccatgaacctgcacgtgctggacgtgatcatctgcgtgggctgcatccccctgaccatcgtgatcctgctgctgagcctggagagcaacaccgccctgatctgctgcttccacgaggcctgcgtgagcttcgccagcgtgagcaccgccatcaacgtgttcgccatcaccctggacagatacgacatcagcgtgaagcccgccaacagaatcctgaccatgggcagagccgtgatgctgatgatcagcatctggatcttcagcttcttcagcttcctgatccccttcatcgaggtgaacttcttcagcctgcagagcggcaacacctgggagaacaagaccctgctgtgcgtgagcaccaacgagtactacaccgagctgggcatgtactaccacctgctggtgcagatccccatcttcttcttcaccgtggtggtgatgctgatcacctacaccaagatcctgcaggccctgaacatcagaatcggcaccagattcagcaccggccagaagaagaaggccagaaagaagaagaccatcagcctgaccacccagcacgaggccaccgacatgagccagagcagcggcggcagaaacgtggtgttcggcgtgagaaccagcgtgagcgtgatcatcgccctgagaagagccgtgaagagacacagagagagaagagagagacagaagagagtgttcagaatgagcctgctgatcatcagcaccttcctgctgtgctggacccccatcagcgtgctgaacaccaccatcctgtgcctgggccccagcgacctgctggtgaagctgagactgtgcttcctggtgatggcctacggcaccaccatcttccaccccctgctgtacgccttcaccagacagaagttccagaaggtgctgaagagcaagatgaagaagagagtggtgagcatcgtggaggccgaccccctgcccaacaacgccgtgatccacaacagctggatcgaccccaagagaaacaagaagatcaccttcgaggacagcgagatcagagagaagtgcctggtgccccaggtggtgaccgactag

SEQ ID NO: 82437 - DNA, 1086 bp, Artificial Sequence
  Description of Artificial Sequence: Synthetic coding sequence
atggcccccaccgagccctggagccccagccccggcagcgccccctgggactacagcggcctggacggcctggaggagctggagctgtgccccgccggcgacctgccctacggctacgtgtacatccccgccctgtacctggccgccttcgccgtgggcctgctgggcaacgccttcgtggtgtggctgctggccggcagaagaggccccagaagactggtggacaccttcgtgctgcacctggccgccgccgacctgggcttcgtgctgaccctgcccctgtgggccgccgccgccgccctgggcggcagatggcccttcggcgacggcctgtgcaagctgagcagcttcgccctggccggcaccagatgcgccggcgccctgctgctggccggcatgagcgtggacagatacctggccgtggtgaagctgctggaggccagacccctgagaacccccagatgcgccctggccagctgctgcggcgtgtgggccgtggccctgctggccggcctgcccagcctggtgtacagaggcctgcagcccctgcccggcggccaggacagccagtgcggcgaggagcccagccacgccttccagggcctgagcctgctgctgctgctgctgaccttcgtgctgcccctggtggtgaccctgttctgctactgcagaatcagcagaagactgagaagacccccccacgtgggcagagccagaagaaacagcctgagaatcatcttcgccatcgagagcaccttcgtgggcagctggctgcccttcagcgccctgagagccgtgttccacctggccagactgggcgccctgcccctgccctgccccctgctgctggccctgagatggggcctgaccatcgccacctgcctggccttcgtgaacagctgcgccaaccccctgatctacctgctgctggacagaagcttcagagccagagccctggacggcgcctgcggcagaaccggcagactggccagaagaatcagcagcgccagcagcctgagcagagacgacagcagcgtgttcagatgcagagcccaggccgccaacaccgccagcgccagctggtag

SEQ ID NO: 82438 - DNA, 1014 bp, Artificial Sequence
  Description of Artificial Sequence: Synthetic coding sequence
atgaacagctgggacgccggcctggccggcctgctggtgggcaccatgggcgtgagcctgctgagcaacgccctggtgctgctgtgcctgctgcacagcgccgacatcagaagacaggcccccgccctgttcaccctgaacctgacctgcggcaacctgctgtgcaccgtggtgaacatgcccctgaccctggccggcgtggtggcccagagacagcccgccggcgacagactgtgcagactggccgccttcctggacaccttcctggccgccaacagcatgctgagcatggccgccctgagcatcgacagatgggtggccgtggtgttccccctgagctacagagccaagatgagactgagagacgccgccctgatggtggcctacacctggctgcacgccctgaccttccccgccgccgccctggccctgagctggctgggcttccaccagctgtacgccagctgcaccctgtgcagcagaagacccgacgagagactgagattcgccgtgttcaccggcgccttccacgccctgagcttcctgctgagcttcgtggtgctgtgctgcacctacctgaaggtgctgaaggtggccagattccactgcaagagaatcgacgtgatcaccatgcagaccctggtgctgctggtggacctgcaccccagcgtgagagagagatgcctggaggagcagaagagaagaagacagagagccaccaagaagatcagcaccttcatcggcaccttcctggtgtgcttcgccccctacgtgatcaccagactggtggagctgttcagcaccgtgcccatcggcagccactggggcgtgctgagcaagtgcctggcctacagcaaggccgccagcgaccccttcgtgtacagcctgctgagacaccagtacagaaagagctgcaaggagatcctgaacagactgctgcacagaagaagcatccacagcagcggcctgaccggcgacagccacagccagaacatcctgcccgtgagcgagtag

SEQ ID NO: 82439 - DNA, 1128 bp, Artificial Sequence
  Description of Artificial Sequence: Synthetic coding sequence
atggccaacgccagcgagcccggcggcagcggcggcggcgaggccgccgccctgggcctgaagctggccaccctgagcctgctgctgtgcgtgagcctggccggcaacgtgctgttcgccctgctgatcgtgagagagagaagcctgcacagagccccctactacctgctgctggacctgtgcctggccgacggcctgagagccctggcctgcctgcccgccgtgatgctggccgccagaagagccgccgccgccgccggcgccccccccggcgccctgggctgcaagctgctggccttcctggccgccctgttctgcttccacgccgccttcctgctgctgggcgtgggcgtgaccagatacctggccatcgcccaccacagattctacgccgagagactggccggctggccctgcgccgccatgctggtgtgcgccgcctgggccctggccctggccgccgccttcccccccgtgctggacggcggcggcgacgacgaggacgccccctgcgccctggagcagagacccgacggcgcccccggcgccctgggcttcctgctgctgctggccgtggtggtgggcgccacccacctggtgtacctgagactgctgttcttcatccacgacagaagaaagatgagacccgccagactggtgcccgccgtgagccacgactggaccttccacggccccggcgccaccggccaggccgccgccaactggaccgccggcttcggcagaggccccaccccccccgccctggtgggcatcagacccgccggccccggcagaggcgccagaagactgctggtgctggaggagttcaagaccgagaagagactgtgcaagatgttctacgccgtgaccctgctgttcctgctgctgtggggcccctacgtggtggccagctacctgagagtgctggtgagacccggcgccgtgccccaggcctacctgaccgccagcgtgtggctgaccttcgcccaggccggcatcaaccccgtggtgtgcttcctgttcaacagagagctgagagactgcttcagagcccagttcccctgctgccagagccccagaaccacccaggccacccacccctgcgacctgaagggcatcggcctgtag

SEQ ID NO: 82440 - DNA, 993 bp, Artificial Sequence
  Description of Artificial Sequence: Synthetic coding sequence
atgatgtggggcgccggcagccccctggcctggctgagcgccggcagcggcaacgtgaacgtgagcagcgtgggccccgccgagggccccaccggccccgccgcccccctgcccagccccaaggcctgggacgtggtgctgtgcatcagcggcaccctggtgagctgcgagaacgccctggtggtggccatcatcgtgggcacccccgccttcagagcccccatgttcctgctggtgggcagcctggccgtggccgacctgctggccggcctgggcctggtgctgcacttcgccgccgtgttctgcatcggcagcgccgagatgagcctggtgctggtgggcgtgctggccatggccttcaccgccagcatcggcagcctgctggccatcaccgtggacagatacctgagcctgtacaacgccctgacctactacagcgagaccaccgtgaccagaacctacgtgatgctggccctggtgtggggcggcgccctgggcctgggcctgctgcccgtgctggcctggaactgcctggacggcctgaccacctgcggcgtggtgtaccccctgagcaagaaccacctggtggtgctggccatcgccttcttcatggtgttcggcatcatgctgcagctgtacgcccagatctgcagaatcgtgtgcagacacgcccagcagatcgccctgcagagacacctgctgcccgccagccactacgtggccaccagaaagggcatcgccaccctggccgtggtgctgggcgccttcgccgcctgctggctgcccttcaccgtgtactgcctgctgggcgacgcccacagcccccccctgtacacctacctgaccctgctgcccgccacctacaacagcatgatcaaccccatcatctacgccttcagaaaccaggacgtgcagaaggtgctgtgggccgtgtgctgctgctgcagcagcagcaagatccccttcagaagcagaagccccagcgacgtgtag

SEQ ID NO: 82441 - DNA, 960 bp, Artificial Sequence
  Description of Artificial Sequence: Synthetic coding sequence
atgcccttccccaactgcagcgcccccagcaccgtggtggccaccgccgtgggcgtgctgctgggcctggagtgcggcctgggcctgctgggcaacgccgtggccctgtggaccttcctgttcagagtgagagtgtggaagccctacgccgtgtacctgctgaacctggccctggccgacctgctgctggccgcctgcctgcccttcctggccgccttctacctgagcctgcaggcctggcacctgggcagagtgggctgctgggccctgcacttcctgctggacctgagcagaagcgtgggcatggccttcctggccgccgtggccctggacagatacctgagagtggtgcaccccagactgaaggtgaacctgctgagcccccaggccgccctgggcgtgagcggcctggtgtggctgctgatggtggccctgacctgccccggcctgctgatcagcgaggccgcccagaacagcaccagatgccacagcttctacagcagagccgacggcagcttcagcatcatctggcaggaggccctgagctgcctgcagttcgtgctgcccttcggcctgatcgtgttctgcaacgccggcatcatcagagccctgcagaagagactgagagagcccgagaagcagcccaagctgcagagagcccaggccctggtgaccctggtggtggtgctgttcgccctgtgcttcctgccctgcttcctggccagagtgctgatgcacatcttccagaacctgggcagctgcagagccctgtgcgccgtggcccacaccagcgacgtgaccggcagcctgacctacctgcacagcgtgctgaaccccgtggtgtactgcttcagcagccccaccttcagaagcagctacagaagagtgttccacaccctgagaggcaagggccaggccgccgagccccccgacttcaaccccagagacagctacagctag

SEQ ID NO: 82442 - DNA, 1071 bp, Artificial Sequence
  Description of Artificial Sequence: Synthetic coding sequence
atgaacggcgtgagcgagggcaccagaggctgcagcgacagacagcccggcgtgctgaccagagacagaagctgcagcagaaagatgaacagcagcggctgcctgagcgaggaggtgggcagcctgagacccctgaccgtggtgatcctgagcgccagcatcgtggtgggcgtgctgggcaacggcctggtgctgtggatgaccgtgttcagaatggccagaaccgtgagcaccgtgtgcttcttccacctggccctggccgacttcatgctgagcctgagcctgcccatcgccatgtactacatcgtgagcagacagtggctgctgggcgagtgggcctgcaagctgtacatcaccttcgtgttcctgagctacttcgccagcaactgcctgctggtgttcatcagcgtggacagatgcatcagcgtgctgtaccccgtgtgggccctgaaccacagaaccgtgcagagagccagctggctggccttcggcgtgtggctgctggccgccgccctgtgcagcgcccacctgaagttcagaaccaccagaaagtggaacggctgcacccactgctacctggccttcaacagcgacaacgagaccgcccagatctggatcgagggcgtggtggagggccacatcatcggcaccatcggccacttcctgctgggcttcctgggccccctggccatcatcggcacctgcgcccacctgatcagagccaagctgctgagagagggctgggtgcacgccaacagacccaagagactgctgctggtgctggtgagcgccttcttcatcttctggagccccttcaacgtggtgctgctggtgcacctgtggagaagagtgatgctgaaggagatctaccaccccagaatgctgctgatcctgcaggccagcttcgccctgggctgcgtgaacagcagcctgaaccccttcctgtacgtgttcgtgggcagagacttccaggagaagttcttccagagcctgaccagcgccctggccagagccttcggcgaggaggagttcctgagcagctgccccagaggcaacgcccccagagagtag

SEQ ID NO: 82443 - DNA, 1146 bp, Artificial Sequence
  Description of Artificial Sequence: Synthetic coding sequence
atgagaagccacaccatcaccatgaccaccaccagcgtgagcagctggccctacagcagccacagaatgagattcatcaccaaccacagcgaccagcccccccagaacttcagcgccacccccaacgtgaccacctgccccatggacgagaagctgctgagcaccgtgctgaccaccagctacagcgtgatcttcatcgtgggcctggtgggcaacatcatcgccctgtacgtgttcctgggcatccacagaaagagaaacagcatccagatctacctgctgaacgtggccatcgccgacctgctgctgatcttctgcctgcccttcagaatcatgtaccacatcaaccagaacaagtggaccctgggcgtgatcctgtgcaaggtggtgggcaccctgttctacatgaacatgtacatcagcatcatcctgctgggcttcatcagcctggacagatacatcaagatcaacagaagcatccagcagagaaaggccatcaccaccaagcagagcatctacgtgtgctgcatcgtgtggatgctggccctgggcggcttcctgaccatgatcatcctgaccctgaagaagggcggccacaacagcaccatgtgcttccactacagagacaagcacaacgccaagggcgaggccatcttcaacttcatcctggtggtgatgttctggctgatcttcctgctgatcatcctgagctacatcaagatcggcaagaacctgctgagaatcagcaagagaagaagcaagttccccaacagcggcaagtacgccaccaccgccagaaacagcttcatcgtgctgatcatcttcaccatctgcttcgtgccctaccacgccttcagattcatctacatcagcagccagctgaacgtgagcagctgctactggaaggagatcgtgcacaagaccaacgagatcatgctggtgctgagcagcttcaacagctgcctggaccccgtgatgtacttcctgatgagcagcaacatcagaaagatcatgtgccagctgctgttcagaagattccagggcgagcccagcagaagcgagagcaccagcgagttcaagcccggctacagcctgcacgacaccagcgtggccgtgaagatccagagcagcagcaagagcacctag

SEQ ID NO: 82444 - DNA, 1146 bp, Artificial Sequence; identical to SEQ ID NO: 82443
  Description of Artificial Sequence: Synthetic coding sequence

SEQ ID NO: 82445 - DNA, 1005 bp, Artificial Sequence
  Description of Artificial Sequence: Synthetic coding sequence
atggacgagaagctgctgagcaccgtgctgaccaccagctacagcgtgatcttcatcgtgggcctggtgggcaacatcatcgccctgtacgtgttcctgggcatccacagaaagagaaacagcatccagatctacctgctgaacgtggccatcgccgacctgctgctgatcttctgcctgcccttcagaatcatgtaccacatcaaccagaacaagtggaccctgggcgtgatcctgtgcaaggtggtgggcaccctgttctacatgaacatgtacatcagcatcatcctgctgggcttcatcagcctggacagatacatcaagatcaacagaagcatccagcagagaaaggccatcaccaccaagcagagcatctacgtgtgctgcatcgtgtggatgctggccctgggcggcttcctgaccatgatcatcctgaccctgaagaagggcggccacaacagcaccatgtgcttccactacagagacaagcacaacgccaagggcgaggccatcttcaacttcatcctggtggtgatgttctggctgatcttcctgctgatcatcctgagctacatcaagatcggcaagaacctgctgagaatcagcaagagaagaagcaagttccccaacagcggcaagtacgccaccaccgccagaaacagcttcatcgtgctgatcatcttcaccatctgcttcgtgccctaccacgccttcagattcatctacatcagcagccagctgaacgtgagcagctgctactggaaggagatcgtgcacaagaccaacgagatcatgctggtgctgagcagcttcaacagctgcctggaccccgtgatgtacttcctgatgagcagcaacatcagaaagatcatgtgccagctgctgttcagaagattccagggcgagcccagcagaagcgagagcaccagcgagttcaagcccggctacagcctgcacgacaccagcgtggccgtgaagatccagagcagcagcaagagcacctag

SEQ ID NO: 82446 - DNA, 930 bp, Artificial Sequence
  Description of Artificial Sequence: Synthetic coding sequence
atgaacggcacctacaacacctgcggcagcagcgacctgacctggccccccgccatcaagctgggcttctacgcctacctgggcgtgctgctggtgctgggcctgctgctgaacagcctggccctgtgggtgttctgctgcagaatgcagcagtggaccgagaccagaatctacatgaccaacctggccgtggccgacctgtgcctgctgtgcaccctgcccttcgtgctgcacagcctgagagacaccagcgacacccccctgtgccagctgagccagggcatctacctgaccaacagatacatgagcatcagcctggtgaccgccatcgccgtggacagatacgtggccgtgagacaccccctgagagccagaggcctgagaagccccagacaggccgccgccgtgtgcgccgtgctgtgggtgctggtgatcggcagcctggtggccagatggctgctgggcatccaggagggcggcttctgcttcagaagcaccagacacaacttcaacagcatggccttccccctgctgggcttctacctgcccctggccgtggtggtgttctgcagcctgaaggtggtgaccgccctggcccagagaccccccaccgacgtgggccaggccgaggccaccagaaaggccgccagaatggtgtgggccaacctgctggtgttcgtggtgtgcttcctgcccctgcacgtgggcctgaccgtgagactggccgtgggctggaacgcctgcgccctgctggagaccatcagaagagccctgtacatcaccagcaagctgagcgacgccaactgctgcctggacgccatctgctactactacatggccaaggagttccaggaggccagcgccctggccgtggcccccagcgccaaggcccacaagagccaggacagcctgtgcgtgaccctggcctag

SEQ ID NO: 82447 - DNA, 930 bp, Artificial Sequence; identical to SEQ ID NO: 82446
  Description of Artificial Sequence: Synthetic coding sequence

SEQ ID NO: 82448 - DNA, 930 bp, Artificial Sequence; identical to SEQ ID NO: 82446
  Description of Artificial Sequence: Synthetic coding sequence

SEQ ID NO: 82449 - DNA, 930 bp, Artificial Sequence; identical to SEQ ID NO: 82446
  Description of Artificial Sequence: Synthetic coding sequence

SEQ ID NO: 82450 - DNA, 1023 bp, Artificial Sequence
  Description of Artificial Sequence: Synthetic coding sequence
atgctgagcggcagcagagccgtgcccaccccccacagaggcagcgaggagctgctgaagtacatgctgcacagcccctgcgtgagcctgaccatgaacggcacctacaacacctgcggcagcagcgacctgacctggccccccgccatcaagctgggcttctacgcctacctgggcgtgctgctggtgctgggcctgctgctgaacagcctggccctgtgggtgttctgctgcagaatgcagcagtggaccgagaccagaatctacatgaccaacctggccgtggccgacctgtgcctgctgtgcaccctgcccttcgtgctgcacagcctgagagacaccagcgacacccccctgtgccagctgagccagggcatctacctgaccaacagatacatgagcatcagcctggtgaccgccatcgccgtggacagatacgtggccgtgagacaccccctgagagccagaggcctgagaagccccagacaggccgccgccgtgtgcgccgtgctgtgggtgctggtgatcggcagcctggtggccagatggctgctgggcatccaggagggcggcttctgcttcagaagcaccagacacaacttcaacagcatggccttccccctgctgggcttctacctgcccctggccgtggtggtgttctgcagcctgaaggtggtgaccgccctggcccagagaccccccaccgacgtgggccaggccgaggccaccagaaaggccgccagaatggtgtgggccaacctgctggtgttcgtggtgtgcttcctgcccctgcacgtgggcctgaccgtgagactggccgtgggctggaacgcctgcgccctgctggagaccatcagaagagccctgtacatcaccagcaagctgagcgacgccaactgctgcctggacgccatctgctactactacatggccaaggagttccaggaggccagcgccctggccgtggcccccagcgccaaggcccacaagagccaggacagcctgtgcgtgaccctggcctag

SEQ ID NO: 82451 - DNA, 1842 bp, Artificial Sequence
  Description of Artificial Sequence: Synthetic coding sequence
atgagagcccccggcgccctgctggccagaatgagcagactgctgctgctgctgctgctgaaggtgagcgccagcagcgccctgggcgtggcccccgccagcagaaacgagacctgcctgggcgagagctgcgcccccaccgtgatccagagaagaggcagagacgcctggggccccggcaacagcgccagagacgtgctgagagccagagcccccagagaggagcagggcgccgccttcctggccggccccagctgggacctgcccgccgcccccggcagagaccccgccgccggcagaggcgccgaggccagcgccgccggcccccccggcccccccaccagaccccccggcccctggagatggaagggcgccagaggccaggagcccagcgagaccctgggcagaggcaaccccaccgccctgcagctgttcctgcagatcagcgaggaggaggagaagggccccagaggcgccggcatcagcggcagaagccaggagcagagcgtgaagaccgtgcccggcgccagcgacctgttctactggcccagaagagccggcaagctgcagggcagccaccacaagcccctgagcaagaccgccaacggcctggccggccacgagggctggaccatcgccctgcccggcagagccctggcccagaacggcagcctgggcgagggcatccacgagcccggcggccccagaagaggcaacagcaccaacagaagagtgagactgaagaaccccttctaccccctgacccaggagagctacggcgcctacgccgtgatgtgcctgagcgtggtgatcttcggcaccggcatcatcggcaacctggccgtgatgtgcatcgtgtgccacaactactacatgagaagcatcagcaacagcctgctggccaacctggccttctgggacttcctgatcatcttcttctgcctgcccctggtgatcttccacgagctgaccaagaagtggctgctggaggacttcagctgcaagatcgtgccctacatcgaggtggccagcctgggcgtgaccaccttcaccctgtgcgccctgtgcatcgacagattcagagccgccaccaacgtgcagatgtactacgagatgatcgagaactgcagcagcaccaccgccaagctggccgtgatctgggtgggcgccctgctgctggccctgcccgaggtggtgctgagacagctgagcaaggaggacctgggcttcagcggcagagcccccgccgagagatgcatcatcaagatcagccccgacctgcccgacaccatctacgtgctggccctgacctacgacagcgccagactgtggtggtacttcggctgctacttctgcctgcccaccctgttcaccatcacctgcagcctggtgaccgccagaaagatcagaaaggccgagaaggcctgcaccagaggcaacaagagacagatccagctggagagccagatgaactgcaccgtggtggccctgaccatcctgtacggcttctgcatcatccccgagaacatctgcaacatcgtgaccgcctacatggccaccggcgtgagccagcagaccatggacctgctgaacatcatcagccagttcctgctgttcttcaagagctgcgtgacccccgtgctgctgttctgcctgtgcaagcccttcagcagagccttcatggagtgctgctgctgctgctgcgaggagtgcatccagaagagcagcaccgtgaccagcgacgacaacgacaacgagtacaccaccgagctggagctgagccccttcagcaccatcagaagagagatgagcaccttcgccagcgtgggcacccactgctag

SEQ ID NO: 82452 - DNA, 1362 bp, Artificial Sequence
  Description of Artificial Sequence: Synthetic coding sequence
atggccagccccagcctgcccggcagcgactgcagccagatcatcgaccacagccacgtgcccgagttcgaggtggccacctggatcaagatcaccctgatcctggtgtacctgatcatcttcgtgatgggcctgctgggcaacagcgccaccatcagagtgacccaggtgctgcagaagaagggctacctgcagaaggaggtgaccgaccacatggtgagcctggcctgcagcgacatcctggtgttcctgatcggcatgcccatggagttctacagcatcatctggaaccccctgaccaccagcagctacaccctgagctgcaagctgcacaccttcctgttcgaggcctgcagctacgccaccctgctgcacgtgctgaccctgagcttcgagagatacatcgccatctgccaccccttcagatacaaggccgtgagcggcccctgccaggtgaagctgctgatcggcttcgtgtgggtgaccagcgccctggtggccctgcccctgctgttcgccatgggcaccgagtaccccctggtgaacgtgcccagccacagaggcctgacctgcaacagaagcagcaccagacaccacgagcagcccgagaccagcaacatgagcatctgcaccaacctgagcagcagatggaccgtgttccagagcagcatcttcggcgccttcgtggtgtacctggtggtgctgctgagcgtggccttcatgtgctggaacatgatgcaggtgctgatgaagagccagaagggcagcctggccggcggcaccagacccccccagctgagaaagagcgagagcgaggagagcagaaccgccagaagacagaccatcatcttcctgagactgatcgtggtgaccctggccgtgtgctggatgcccaaccagatcagaagaatcatggccgccgccaagcccaagcacgactggaccagaagctacttcagagcctacatgatcctgctgcccttcagcgagaccttcttctacctgagcagcgtgatcaaccccctgctgtacaccgtgagcagccagcagttcagaagagtgttcgtgcaggtgctgtgctgcagactgagcctgcagcacgccaaccacgagaagagactgagagtgcacgcccacagcaccaccgacagcgccagattcgtgcagagacccctgctgttcgccagcagaagacagagcagcgccagaagaaccgagaagatcttcctgagcaccttccagagcgaggccgagccccagagcaagagccagagcctgagcctggagagcctggagcccaacagcggcgccaagcccgccaacagcgccgccgagaacggcttccaggagcacgaggtgtag

SEQ ID NO: 82453 - DNA, 1089 bp, Artificial Sequence
  Description of Artificial Sequence: Synthetic coding sequence
atgggcaaccacacctgggagggctgccacgtggacagcagagtggaccacctgttcccccccagcctgtacatcttcgtgatcggcgtgggcctgcccaccaactgcctggccctgtgggccgcctacagacaggtgcagcagagaaacgagctgggcgtgtacctgatgaacctgagcatcgccgacctgctgtacatctgcaccctgcccctgtgggtggactacttcctgcaccacgacaactggatccacggccccggcagctgcaagctgttcggcttcatcttctacaccaacatctacatcagcatcgccttcctgtgctgcatcagcgtggacagatacctggccgtggcccaccccctgagattcgccagactgagaagagtgaagaccgccgtggccgtgagcagcgtggtgtgggccaccgagctgggcgccaacagcgcccccctgttccacgacgagctgttcagagacagatacaaccacaccttctgcttcgagaagttccccatggagggctgggtggcctggatgaacctgtacagagtgttcgtgggcttcctgttcccctgggccctgatgctgctgagctacagaggcatcctgagagccgtgagaggcagcgtgagcaccgagagacaggagaaggccaagatcaagagactggccctgagcctgatcgccatcgtgctggtgtgcttcgccccctaccacgtgctgctgctgagcagaagcgccatctacctgggcagaccctgggactgcggcttcgaggagagagtgttcagcgcctaccacagcagcctggccttcaccagcctgaactgcgtggccgaccccatcctgtactgcctggtgaacgagggcgccagaagcgacgtggccaaggccctgcacaacctgctgagattcctggccagcgacaagccccaggagatggccaacgccagcctgaccctggagacccccctgaccagcaagagaaacagcaccgccaaggccatgaccggcagctgggccgccaccccccccagccagggcgaccaggtgcagctgaagatgctgccccccgcccagtag

SEQ ID NO: 82454 - DNA, 1041 bp, Artificial Sequence
  Description of Artificial Sequence: Synthetic coding sequence
atggacaccggccccgaccagagctacttcagcggcaaccactggttcgtgttcagcgtgtacctgctgaccttcctggtgggcctgcccctgaacctgctggccctggtggtgttcgtgggcaagctgagatgcagacccgtggccgtggacgtgctgctgctgaacctgaccgccagcgacctgctgctgctgctgttcctgcccttcagaatggtggaggccgccaacggcatgcactggcccctgcccttcatcctgtgccccctgagcggcttcatcttcttcaccaccatctacctgaccgccctgttcctggccgccgtgagcatcgagagattcctgagcgtggcccaccccctgtggtacaagaccagacccagactgggccaggccggcctggtgagcgtggcctgctggctgctggccagcgcccactgcagcgtggtgtacgtgatcgagttcagcggcgacatcagccacagccagggcaccaacggcacctgctacctggagttctggaaggaccagctggccatcctgctgcccgtgagactggagatggccgtggtgctgttcgtggtgcccctgatcatcaccagctactgctacagcagactggtgtggatcctgggcagaggcggcagccacagaagacagagaagagtggccggcctggtggccgccaccctgctgaacttcctggtgtgcttcggcccctacaacgtgagccacgtggtgggctacatctgcggcgagagccccgtgtggagaatctacgtgaccctgctgagcaccctgaacagctgcgtggaccccttcgtgtactacttcagcagcagcggcttccaggccgacttccacgagctgctgagaagactgtgcggcctgtggggccagtggcagcaggagagcagcatggagctgaaggagcagaagggcggcgaggagcagagagccgacagacccgccgagagaaagaccagcgagcacagccagggctgcggcaccggcggccaggtggcctgcgccgagaactag

SEQ ID NO: 82455 - DNA, 1119 bp, Artificial Sequence
  Description of Artificial Sequence: Synthetic coding sequence
atggcctgcaacagcaccagcctggaggcctacacctacctgctgctgaacaccagcaacgccagcgacagcggcagcacccagctgcccgcccccctgagaatcagcctggccatcgtgatgctgctgatgaccgtggtgggcttcctgggcaacaccgtggtgtgcatcatcgtgtaccagagacccgccatgagaagcgccatcaacctgctgctggccaccctggccttcagcgacatcatgctgagcctgtgctgcatgcccttcaccgccgtgaccctgatcaccgtgagatggcacttcggcgaccacttctgcagactgagcgccaccctgtactggttcttcgtgctggagggcgtggccatcctgctgatcatcagcgtggacagattcctgatcatcgtgcagagacaggacaagctgaaccccagaagagccaaggtgatcatcgccgtgagctgggtgctgagcttctgcatcgccggccccagcctgaccggctggaccctggtggaggtgcccgccagagccccccagtgcgtgctgggctacaccgagctgcccgccgacagagcctacgtggtgaccctggtggtggccgtgttcttcgcccccttcggcgtgatgctgtgcgcctacatgtgcatcctgaacaccgtgagaaagaacgccgtgagagtgcacaaccagagcgacagcctggacctgagacagctgaccagagccggcctgagaagactgcagagacagcagcaggtgagcgtggacctgagcttcaagaccaaggccttcaccaccatcctgatcctgttcgtgggcttcagcctgtgctggctgccccacagcgtgtacagcctgctgagcgtgttcagccagagattctactgcggcagcagcttctacgccaccagcacctgcgtgctgtggctgagctacctgaagagcgtgttcaaccccatcgtgtactgctggagaatcaagaagttcagagaggcctgcatcgagctgctgccccagaccttccagatcctgcccaaggtgcccgagagaatcagaagaagaatccagcccagcaccgtgtacgtgtgcaacgagaaccagagcgccgtgtag

SEQ ID NO: 82456 - DNA, 837 bp, Artificial Sequence
  Description of Artificial Sequence: Synthetic coding sequence
atgagcgcccccggcagccccgaccaggcctacgacttcctgctgaagttcctgctggtgggcgacagagacgtgggcaagagcgagatcctggagagcctgcaggacggcaccgccgagagcccctacagccacctgggcggcatcgactacaagaccaccaccatcctgctggacggccagagagtgaagctgaagctgtgggacaccagcggccagggcagattctgcaccatcttcagaagctacagcagaggcgcccagggcgtgatcctggtgtacgacatcgccaacagatggagcttcgagggcatggacagatggatcaagaagatcgaggagcacgcccccggcgtgcccaagatcctggtgggcaacagactgcacctggccttcaagagacaggtgcccagagagcaggcccaggcctacgccgagagactgggcgtgaccttcttcgaggtgagccccctgtgcaacttcaacatcatcgagagcttcaccgagctggccagaatcgtgctgctgagacacagactgaactggctgggcagacccagcaaggtgctgagcctgcaggacctgtgctgcagaaccatcgtgagctgcacccccgtgcacctggtggacaagctgcccctgcccatcgccctgagaagccacctgaagagcttcagcatggccaagggcctgaacgccagaatgatgagaggcctgagctacagcctgaccaccagcagcacccacaagagaagcagcctgtgcaaggtgaagatcgtgtgccccccccagagcccccccaagaactgcaccagaaacagctgcaagatcagctag

SEQ ID NO: 82457 - DNA, 585 bp, Artificial Sequence
  Description of Artificial Sequence: Synthetic coding sequence
atggtgatcctggccgtgaccaagaacaagaagctgagaaacagcggcaacatcttcgtggtgagcctgagcgtggccgacatgctggtggccatctacccctaccccctgatgctgcacgccatgagcatcggcggctgggacctgagccagctgcagtgccagatggtgggcttcatcaccggcctgagcgtggtgggcagcatcttcaacatcgtggccatcgccatcaacagatactgctacatctgccacagcctgcagtacgagagaatcttcagcgtgagaaacacctgcatctacctggtgatcacctggatcatgaccgtgctggccgtgctgcccaacatgtacatcggcaccatcgagtacgaccccagaacctacacctgcatcttcaactacctgaacaaccccgtgttcaccgtgaccatcgtgtgcatccacttcgtgctgcccctgctgatcgtgggcttctgctacgtgagaatctggaccaaggtgctggccgccagagaccccgccggccagaaccccgacaaccagctggccgagcccaccagcaccgccgccagcaccctgtag

SEQ ID NO: 82458 - DNA, 1086 bp, Artificial Sequence
  Description of Artificial Sequence: Synthetic coding sequence
atgaacgagagcagatggaccgagtggagaatcctgaacatgagcagcggcatcgtgaacgtgagcgagagacacagctgccccctgggcttcggccactacagcgtggtggacgtgtgcatcttcgagaccgtggtgatcgtgctgctgaccttcctgatcatcgccggcaacctgaccgtgatcttcgtgttccactgcgcccccctgctgcaccactacaccaccagctacttcatccagaccatggcctacgccgacctgttcgtgggcgtgagctgcctggtgcccaccctgagcctgctgcactacagcaccggcgtgcacgagagcctgacctgccaggtgttcggctacatcatcagcgtgctgaagagcgtgagcatggcctgcctggcctgcatcagcgtggacagatacctggccatcaccaagcccctgagctacaaccagctggtgaccccctgcagactgagaatctgcatcatcctgatctggatctacagctgcctgatcttcctgcccagcttcttcggctggggcaagcccggctaccacggcgacatcttcgagtggtgcgccaccagctggctgaccagcgcctacttcaccggcttcatcgtgtgcctgctgtacgcccccgccgccttcgtggtgtgcttcacctacttccacatcttcaagatctgcagacagcacaccaaggagatcaacgacagaagagccagattccccagccacgaggtggacagcagcagagagaccggccacagccccgacagaagatacgccatggtgctgttcagaatcaccagcgtgttctacatgctgtggctgccctacatcatctacttcctgctggagagcagcagagtgctggacaaccccaccctgagcttcctgaccacctggctggccatcagcaacagcttctgcaactgcgtgatctacagcctgagcaacagcgtgttcagactgggcctgagaagactgagcgagaccatgtgcaccagctgcatgtgcgtgaaggaccaggaggcccaggagcccaagcccagaaagagagccaacagctgcagcatctag

SEQ ID NO: 82459 - DNA, 960 bp, Artificial Sequence
  Description of Artificial Sequence: Synthetic coding sequence
atgagccagcagaacaccagcggcgactgcctgttcgacggcgtgaacgagctgatgaagaccctgcagttcgccgtgcacatccccaccttcgtgctgggcctgctgctgaacctgctggccatccacggcttcagcaccttcctgaagaacagatggcccgactacgccgccaccagcatctacatgatcaacctggccgtgttcgacctgctgctggtgctgagcctgcccttcaagatggtgctgagccaggtgcagagccccttccccagcctgtgcaccctggtggagtgcctgtacttcgtgagcatgtacggcagcgtgttcaccatctgcttcatcagcatggacagattcctggccatcagataccccctgctggtgagccacctgagaagccccagaaagatcttcggcatctgctgcaccatctgggtgctggtgtggaccggcagcatccccatctacagcttccacggcaaggtggagaagtacatgtgcttccacaacatgagcgacgacacctggagcgccaaggtgttcttccccctggaggtgttcggcttcctgctgcccatgggcatcatgggcttctgctgcagcagaagcatccacatcctgctgggcagaagagaccacacccaggactgggtgcagcagaaggcctgcatctacagcatcgccgccagcctggccgtgttcgtggtgagcttcctgcccgtgcacctgggcttcttcctgcagttcctggtgagaaacagcttcatcgtggagtgcagagccaagcagagcatcagcttcttcctgcagctgagcatgtgcttcagcaacgtgaactgctgcctggacgtgttctgctactacttcgtgatcaaggagttcagaatgaacatcagagcccacagacccagcagagtgcagctggtgctgcaggacaccaccatcagcagaggctag

SEQ ID NO: 82460 - DNA, 960 bp, Artificial Sequence; identical to SEQ ID NO: 82459
  Description of Artificial Sequence: Synthetic coding sequence

SEQ ID NO: 82461 - DNA, 729 bp, Artificial Sequence
  Description of Artificial Sequence: Synthetic coding sequence
atgagccagcagaacaccagcggcgactgcctgttcgacggcgtgaacgagctgatgaagaccctgcagttcgccgtgcacatccccaccttcgtgctgggcctgctgctgaacctgctggccatccacggcttcagcaccttcctgaagaacagatggcccgactacgccgccaccagcatctacatgatcaacctggccgtgttcgacctgctgctggtgctgagcctgcccttcaagatggtgctgagccaggtgcagagccccttccccagcctgtgcaccctggtggagtgcctgtacttcgtgagcatgtacggcagcgtgttcaccatctgcttcatcagcatggacagattcctggccatcagataccccctgctggtgagccacctgagaagccccagaaagatcttcggcatctgctgcaccatctgggtgctggtgtggaccggcagcatccccatctacagcttccacggcaaggtggagaagtacatgtgcttccacaacatgagcgacgacacctggagcgccaaggtgttcttccccctggaggtgttcggcttcctgctgcccatgggcatcatgggcttctgctgcagcagaagcatccacatcctgctgggcagaagagaccacacccaggactgggtgcagcagaaggcctgcatctacagcatcgccgccagcctggccgtgttcgtggtgagcttcctgcccgtgtag

SEQ ID NO: 82462 - DNA, 960 bp, Artificial Sequence; identical to SEQ ID NO: 82459
  Description of Artificial Sequence: Synthetic coding sequence

SEQ ID NO: 82463 - DNA, 1572 bp, Artificial Sequence
  Description of Artificial Sequence: Synthetic coding sequence
atgaccccccagagcctgctgcagaccaccctgttcctgctgagcctgctgttcctggtgcagggcgcccacggcagaggccacagagaggacttcagattctgcagccagcagctgcagagcctggagagcaagctgaccagcgtgagattcatgggcgacatggtgagcttcgaggaggacagaatcaacgccaccgtgtggaagctgcagcccaccgccggcctgcaggacctgcacatccacagcagacaggaggaggagcagagcgagatcatggagtacagcgtgctgctgcccagaaccctgttccagagaaccaagggcagaagcggcgaggccgagaagagactgctgctggtggacttcagcagccaggccctgttccaggacaagaacagcagccaggtgctgggcgagaaggtgctgggcatcgtggtgcagaacaccaaggtggccaacctgaccgagcccgtggtgctgaccttccagcaccagctgcagcccaagaacgtgaccctgcagtgcgtgttctgggtggaggaccccaccctgagcagccccggccactggagcagcgccggctgcgagaccgtgagaagagagacccagaccagctgcttctgcaaccacctgacctacttcgccgtgctgatggtgagcagcgtggaggtggacgccgtgcacaagcactacctgagcctgctgagctacgtgggctgcgtggtgagcgccctggcctgcctggtgaccatcgccgcctacctgtgcagcagagtgcccctgccctgcagaagaaagcccagagactacaccatcaaggtgcacatgaacctgctgctggccgtgttcctgctggacaccagcttcctgctgagcgagcccgtggccctgaccggcagcgaggccggctgcagagccagcgccatcttcctgcacttcagcctgctgacctgcctgagctggatgggcctggagggctacaacctgtacagactggtggtggaggtgttcggcacctacgtgcccggctacctgctgaagctgagcgccatgggctggggcttccccatcttcctggtgaccctggtggccctggtggacgtggacaactacggccccatcatcctggccgtgcacagaacccccgagggcgtgatctaccccagcatgtgctggatcagagacagcctggtgagctacatcaccaacctgggcctgttcagcctggtgttcctgttcaacatggccatgctggccaccatggtggtgcagatcctgagactgagaccccacacccagaagtggagccacgtgctgaccctgctgggcctgagcctggtgctgggcctgccctgggccctgatcttcttcagcttcgccagcggcaccttccagctggtggtgctgtacctgttcagcatcatcaccagcttccagggcttcctgatcttcatctggtactggagcatgagactgcaggccagaggcggccccagccccctgaagagcaacagcgacagcgccagactgcccatcagcagcggcagcaccagcagcagcagaatctag

SEQ ID NO: 82464 - DNA, 2082 bp, Artificial Sequence
  Description of Artificial Sequence: Synthetic coding sequence
atgaccccccagagcctgctgcagaccaccctgttcctgctgagcctgctgttcctggtgcagggcgcccacggcagaggccacagagaggacttcagattctgcagccagagaaaccagacccacagaagcagcctgcactacaagcccacccccgacctgagaatcagcatcgagaacagcgaggaggccctgaccgtgcacgcccccttccccgccgcccaccccgccagcagaagcttccccgaccccagaggcctgtaccacttctgcctgtactggaacagacacgccggcagactgcacctgctgtacggcaagagagacttcctgctgagcgacaaggccagcagcctgctgtgcttccagcaccaggaggagagcctggcccagggcccccccctgctggccaccagcgtgaccagctggtggagcccccagaacatcagcctgcccagcgccgccagcttcaccttcagcttccacagccccccccacaccgccgcccacaacgccagcgtggacatgtgcgagctgaagagagacctgcagctgctgagccagttcctgaagcacccccagaaggccagcagaagacccagcgccgcccccgccagccagcagctgcagagcctggagagcaagctgaccagcgtgagattcatgggcgacatggtgagcttcgaggaggacagaatcaacgccaccgtgtggaagctgcagcccaccgccggcctgcaggacctgcacatccacagcagacaggaggaggagcagagcgagatcatggagtacagcgtgctgctgcccagaaccctgttccagagaaccaagggcagaagcggcgaggccgagaagagactgctgctggtggacttcagcagccaggccctgttccaggacaagaacagcagccaggtgctgggcgagaaggtgctgggcatcgtggtgcagaacaccaaggtggccaacctgaccgagcccgtggtgctgaccttccagcaccagctgcagcccaagaacgtgaccctgcagtgcgtgttctgggtggaggaccccaccctgagcagccccggccactggagcagcgccggctgcgagaccgtgagaagagagacccagaccagctgcttctgcaaccacctgacctacttcgccgtgctgatggtgagcagcgtggaggtggacgccgtgcacaagcactacctgagcctgctgagctacgtgggctgcgtggtgagcgccctggcctgcctggtgaccatcgccgcctacctgtgcagcagagtgcccctgccctgcagaagaaagcccagagactacaccatcaaggtgcacatgaacctgctgctggccgtgttcctgctggacaccagcttcctgctgagcgagcccgtggccctgaccggcagcgaggccggctgcagagccagcgccatcttcctgcacttcagcctgctgacctgcctgagctggatgggcctggagggctacaacctgtacagactggtggtggaggtgttcggcacctacgtgcccggctacctgctgaagctgagcgccatgggctggggcttccccatcttcctggtgaccctggtggccctggtggacgtggacaactacggccccatcatcctggccgtgcacagaacccccgagggcgtgatctaccccagcatgtgctggatcagagacagcctggtgagctacatcaccaacctgggcctgttcagcctggtgttcctgttcaacatggccatgctggccaccatggtggtgcagatcctgagactgagaccccacacccagaagtggagccacgtgctgaccctgctgggcctgagcctggtgctgggcctgccctgggccctgatcttcttcagcttcgccagcggcaccttccagctggtggtgctgtacctgttcagcatcatcaccagcttccagggcttcctgatcttcatctggtactggagcatgagactgcaggccagaggcggccccagccccctgaagagcaacagcgacagcgccagactgcccatcagcagcggcagcaccagcagcagcagaatctag

SEQ ID NO: 82465 - DNA, 2082 bp, Artificial Sequence; identical to SEQ ID NO: 82464
  Description of Artificial Sequence: Synthetic coding sequence

SEQ ID NO: 82466 - DNA, 2064 bp, Artificial Sequence
  Description of Artificial Sequence: Synthetic coding sequence
atgaccccccagagcctgctgcagaccaccctgttcctgctgagcctgctgttcctggtgcagggcgcccacggcagaggccacagagaggacttcagattctgcagccagagaaaccagacccacagaagcagcctgcactacaagcccacccccgacctgagaatcagcatcgagaacagcgaggaggccctgaccgtgcacgcccccttccccgccgcccaccccgccagcagaagcttccccgaccccagaggcctgtaccacttctgcctgtactggaacagacacgccggcagactgcacctgctgtacggcaagagagacttcctgctgagcgacaaggccagcagcctgctgtgcttccagcaccaggaggagagcctggcccagggcccccccctgctggccaccagcgtgaccagctggtggagcccccagaacatcagcctgcccagcgccgccagcttcaccttcagcttccacagccccccccacaccgccgcccacaacgccagcgtggacatgtgcgagctgaagagagacctgcagctgctgagccagttcctgaagcacccccagaaggccagcagaagacccagcgccgcccccgccagccagcagctgcagagcctggagagcaagctgaccagcgtgagattcatgggcgacatggtgagcttcgaggaggacagaatcaacgccaccgtgtggaagctgcagcccaccgccggcctgcaggacctgcacatccacagcagacaggaggaggagcagagcgagatcatggagtacagcgtgctgctgcccagaaccctgttccagagaaccaagggcagaagcggcgaggccgagaagagactgctgctggtggacttcagcagccaggccctgttccaggacaagaacagcagccaggtgctgggcgagaaggtgctgggcatcgtggtgcagaacaccaaggtggccaacctgaccgagcccgtggtgctgaccttccagcaccagctgcagcccaagaacgtgaccctgcagtgcgtgttctgggtggaggaccccaccctgagcagccccggccactggagcagcgccggctgcgagaccgtgagaagagagacccagaccagctgcttctgcaaccacctgacctacttcgccgtgctgatggtgagcagcgtggaggtggacgccgtgcacaagcactacctgagcctgctgagctacgtgggctgcgtggtgagcgccctggcctgcctggtgaccatcgccgcctacctgtgcagcagaagaaagcccagagactacaccatcaaggtgcacatgaacctgctgctggccgtgttcctgctggacaccagcttcctgctgagcgagcccgtggccctgaccggcagcgaggccggctgcagagccagcgccatcttcctgcacttcagcctgctgacctgcctgagctggatgggcctggagggctacaacctgtacagactggtggtggaggtgttcggcacctacgtgcccggctacctgctgaagctgagcgccatgggctggggcttccccatcttcctggtgaccctggtggccctggtggacgtggacaactacggccccatcatcctggccgtgcacagaacccccgagggcgtgatctaccccagcatgtgctggatcagagacagcctggtgagctacatcaccaacctgggcctgttcagcctggtgttcctgttcaacatggccatgctggccaccatggtggtgcagatcctgagactgagaccccacacccagaagtggagccacgtgctgaccctgctgggcctgagcctggtgctgggcctgccctgggccctgatcttcttcagcttcgccagcggcaccttccagctggtggtgctgtacctgttcagcatcatcaccagcttccagggcttcctgatcttcatctggtactggagcatgagactgcaggccagaggcggccccagccccctgaagagcaacagcgacagcgccagactgcccatcagcagcggcagcaccagcagcagcagaatctag

SEQ ID NO: 82467 - DNA, 2082 bp, Artificial Sequence; identical to SEQ ID NO: 82464
  Description of Artificial Sequence: Synthetic coding sequence

SEQ ID NO: 82468 - DNA, 2064 bp, Artificial Sequence; identical to SEQ ID NO: 82466
  Description of Artificial Sequence: Synthetic coding sequence

SEQ ID NO: 82469 - DNA, 2064 bp, Artificial Sequence; identical to SEQ ID NO: 82466
  Description of Artificial Sequence: Synthetic coding sequence

SEQ ID NO: 82470 - DNA, 1539 bp, Artificial Sequence
  Description of Artificial Sequence: Synthetic coding sequence
atgtgcgagctgaagagagacctgcagctgctgagccagttcctgaagcacccccagaaggccagcagaagacccagcgccgcccccgccagccagcagctgcagagcctggagagcaagctgaccagcgtgagattcatgggcgacatggtgagcttcgaggaggacagaatcaacgccaccgtgtggaagctgcagcccaccgccggcctgcaggacctgcacatccacagcagacaggaggaggagcagagcgagatcatggagtacagcgtgctgctgcccagaaccctgttccagagaaccaagggcagaagcggcgaggccgagaagagactgctgctggtggacttcagcagccaggccctgttccaggacaagaacagcagccaggtgctgggcgagaaggtgctgggcatcgtggtgcagaacaccaaggtggccaacctgaccgagcccgtggtgctgaccttccagcaccagctgcagcccaagaacgtgaccctgcagtgcgtgttctgggtggaggaccccaccctgagcagccccggccactggagcagcgccggctgcgagaccgtgagaagagagacccagaccagctgcttctgcaaccacctgacctacttcgccgtgctgatggtgagcagcgtggaggtggacgccgtgcacaagcactacctgagcctgctgagctacgtgggctgcgtggtgagcgccctggcctgcctggtgaccatcgccgcctacctgtgcagcagaagaaagcccagagactacaccatcaaggtgcacatgaacctgctgctggccgtgttcctgctggacaccagcttcctgctgagcgagcccgtggccctgaccggcagcgaggccggctgcagagccagcgccatcttcctgcacttcagcctgctgacctgcctgagctggatgggcctggagggctacaacctgtacagactggtggtggaggtgttcggcacctacgtgcccggctacctgctgaagctgagcgccatgggctggggcttccccatcttcctggtgaccctggtggccctggtggacgtggacaactacggccccatcatcctggccgtgcacagaacccccgagggcgtgatctaccccagcatgtgctggatcagagacagcctggtgagctacatcaccaacctgggcctgttcagcctggtgttcctgttcaacatggccatgctggccaccatggtggtgcagatcctgagactgagaccccacacccagaagtggagccacgtgctgaccctgctgggcctgagcctggtgctgggcctgccctgggccctgatcttcttcagcttcgccagcggcaccttccagctggtggtgctgtacctgttcagcatcatcaccagcttccagggcttcctgatcttcatctggtactggagcatgagactgcaggccagaggcggccccagccccctgaagagcaacagcgacagcgccagactgcccatcagcagcggcagcaccagcagcagcagaatctag

SEQ ID NO: 82471 - DNA, 2064 bp, Artificial Sequence; identical to SEQ ID NO: 82466
  Description of Artificial Sequence: Synthetic coding sequence

SEQ ID NO: 82472 - DNA, 2064 bp, Artificial Sequence; identical to SEQ ID NO: 82466
  Description of Artificial Sequence: Synthetic coding sequence

SEQ ID NO: 82473 - DNA, 1089 bp, Artificial Sequence
  Description of Artificial Sequence: Synthetic coding sequence
atgaacgccagcgccgccagcctgaacgacagccaggtggtggtggtggccgccgagggcgccgccgccgccgccaccgccgccggcggccccgacaccggcgagtggggcccccccgccgccgccgccctgggcgccggcggcggcgccaacggcagcctggagctgagcagccagctgagcgccggcccccccggcctgctgctgcccgccgtgaacccctgggacgtgctgctgtgcgtgagcggcaccgtgatcgccggcgagaacgccctggtggtggccctgatcgccagcacccccgccctgagaacccccatgttcgtgctggtgggcagcctggccaccgccgacctgctggccggctgcggcctgatcctgcacttcgtgttccagtacctggtgcccagcgagaccgtgagcctgctgaccgtgggcttcctggtggccagcttcgccgccagcgtgagcagcctgctggccatcaccgtggacagatacctgagcctgtacaacgccctgacctactacagcagaagaaccctgctgggcgtgcacctgctgctggccgccacctggaccgtgagcctgggcctgggcctgctgcccgtgctgggctggaactgcctggccgagagagccgcctgcagcgtggtgagacccctggccagaagccacgtggccctgctgagcgccgccttcttcatggtgttcggcatcatgctgcacctgtacgtgagaatctgccaggtggtgtggagacacgcccaccagatcgccctgcagcagcactgcctggcccccccccacctggccgccaccagaaagggcgtgggcaccctggccgtggtgctgggcaccttcggcgccagctggctgcccttcgccatctactgcgtggtgggcagccacgaggaccccgccgtgtacacctacgccaccctgctgcccgccacctacaacagcatgatcaaccccatcatctacgccttcagaaaccaggagatccagagagccctgtggctgctgctgtgcggctgcttccagagcaaggtgcccttcagaagcagaagccccagcgaggtgtag

SEQ ID NO: 82474 - DNA, 1134 bp, Artificial Sequence
  Description of Artificial Sequence: Synthetic coding sequence
atgaccctgctggcctggtgcaccagaggcgccaaccccgccgccatgaacgccagcgccgccagcctgaacgacagccaggtggtggtggtggccgccgagggcgccgccgccgccgccaccgccgccggcggccccgacaccggcgagtggggcccccccgccgccgccgccctgggcgccggcggcggcgccaacggcagcctggagctgagcagccagctgagcgccggcccccccggcctgctgctgcccgccgtgaacccctgggacgtgctgctgtgcgtgagcggcaccgtgatcgccggcgagaacgccctggtggtggccctgatcgccagcacccccgccctgagaacccccatgttcgtgctggtgggcagcctggccaccgccgacctgctggccggctgcggcctgatcctgcacttcgtgttccagtacctggtgcccagcgagaccgtgagcctgctgaccgtgggcttcctggtggccagcttcgccgccagcgtgagcagcctgctggccatcaccgtggacagatacctgagcctgtacaacgccctgacctactacagcagaagaaccctgctgggcgtgcacctgctgctggccgccacctggaccgtgagcctgggcctgggcctgctgcccgtgctgggctggaactgcctggccgagagagccgcctgcagcgtggtgagacccctggccagaagccacgtggccctgctgagcgccgccttcttcatggtgttcggcatcatgctgcacctgtacgtgagaatctgccaggtggtgtggagacacgcccaccagatcgccctgcagcagcactgcctggcccccccccacctggccgccaccagaaagggcgtgggcaccctggccgtggtgctgggcaccttcggcgccagctggctgcccttcgccatctactgcgtggtgggcagccacgaggaccccgccgtgtacacctacgccaccctgctgcccgccacctacaacagcatgatcaaccccatcatctacgccttcagaaaccaggagatccagagagccctgtggctgctgctgtgcggctgcttccagagcaaggtgcccttcagaagcagaagccccagcgaggtgtag

SEQ ID NO: 82475 - DNA, 1023 bp, Artificial Sequence
  Description of Artificial Sequence: Synthetic coding sequence
atgaacgccagcgccgccagcctgaacgacagccaggtggtggtggtggccgccgagggcgccgccgccgccgccaccgccgccggcggccccgacaccggcgagtggggcccccccgccgccgccgccctgggcgccggcggcggcgccaacggcagcctggagctgagcagccagctgagcgccggcccccccggcctgctgctgcccgccgtgaacccctgggacgtgctgctgtgcgtgagcggcaccgtgatcgccggcgagaacgccctggtggtggccctgatcgccagcacccccgccctgagaacccccatgttcgtgctggtgggcagcctggccaccgccgacctgctggccggctgcggcctgatcctgcacttcgtgttccagtacctggtgcccagcgagaccgtgagcctgctgaccgtgggcttcctggtggccagcttcgccgccagcgtgagcagcctgctggccatcaccgtggacagatacctgagcctgtacaacgccctgacctactacagcagaagaaccctgctgggcgtgcacctgctgctggccgccacctggaccgtgagcctgggcctgggcctgctgcccgtgctgggctggaactgcctggccgagagagccgcctgcagcgtggtgagacccctggccagaagccacgtggccctgctgagcgccgccttcttcatggtgttcggcatcatgctgcacctgtacgtgagaatctgccaggtggtgtggagacacgcccaccagatcgccctgcagcagcactgcctggcccccccccacctggccgccaccagaaagggcgtgggcaccctggccgtggtgctgggcaccttcggcgccagctggctgcccttcgccacctacaacagcatgatcaaccccatcatctacgccttcagaaaccaggagatccagagagccctgtggctgctgctgtgcggctgcttccagagcaaggtgcccttcagaagcagaagccccagcgaggtgtag

SEQ ID NO: 82476 - DNA, 1740 bp, Artificial Sequence
  Description of Artificial Sequence: Synthetic coding sequence
aaccccagactgaccgtgctggagagagtggagggctacggcgagcaggagtggcagaagggcgacggcaagggcagaggcgagggccacagcgagagcggcgtgctgagcggcagcggcagctgcaccagccacgtgagctgcttcctggccgtgaccaaggccgaccccgccgccaccagcggccagaagggcgacgagctgctgatcctgcagctgcccggcctggccctgtgcacccagaccaacctgcccaagagactgcagtgggaggtgccccccaccaagcccggcagcctgggcctgggcagccccagccagggcagatggaccagaatgggcgacggcccccaggaggtgccctgggtgcccagcttcggccccatggagagcagccccatcccccagagcagcggcaacagcagcaccctgggcagagtgccccagacccccggccccagcaccgccagcggcgtgcccgaggtgggcctgagagacgtggccagcgagagcgtggccctgttcttcatgctgctgctggacctgaccgccgtggccggcaacgccgccgtgatggccgtgatcgccaagacccccgccctgagaaagttcgtgttcgtgttccacctgtgcctggtggacctgctggccgccctgaccctgatgcccctggccatgctgagcagcagcgccctgttcgaccacgccctgttcggcgaggtggcctgcagactgtacctgttcctgagcgtgtgcttcgtgagcctggccatcctgagcgtgagcgccatcaacgtggagagatactactacgtggtgcaccccatgagatacgaggtgagaatgaccctgggcctggtggccagcgtgctggtgggcgtgtgggtgaaggccctggccatggccagcgtgcccgtgctgggcagagtgagctgggaggagggcgcccccagcgtgccccccggctgcagcctgcagtggagccacagcgcctactgccagctgttcgtggtggtgttcgccgtgctgtacttcctgctgcccctgctgctgatcctggtggtgtactgcagcatgttcagagtggccagagtggccgccatgcagcacggccccctgcccacctggatggagacccccagacagagaagcgagagcctgagcagcagaagcaccatggtgaccagcagcggcgccccccagaccaccccccacagaaccttcggcggcggcaaggccgccgtggtgctgctggccgtgggcggccagttcctgctgtgctggctgccctacttcagcttccacctgtacgtggccctgagcgcccagcccatcagcaccggccaggtggagagcgtggtgacctggatcggctacttctgcttcaccagcaaccccttcttctacggctgcctgaacagacagatcagaggcgagctgagcaagcagttcgtgtgcttcttcaagcccgcccccgaggaggagctgagactgcccagcagagagggcagcatcgaggagaacttcctgcagttcctgcagggcaccggctgccccagcgagagctgggtgagcagacccctgcccagccccaagcaggagccccccgccgtggacttcagaatccccggccagatcgccgaggagaccagcgagttcctggagcagcagctgaccagcgacatcatcatgagcgacagctacctgagacccgccgccagccccagactggagagctag

SEQ ID NO: 82477 - DNA, 1356 bp, Artificial Sequence
  Description of Artificial Sequence: Synthetic coding sequence
atggagagcagccccatcccccagagcagcggcaacagcagcaccctgggcagagtgccccagacccccggccccagcaccgccagcggcgtgcccgaggtgggcctgagagacgtggccagcgagagcgtggccctgttcttcatgctgctgctggacctgaccgccgtggccggcaacgccgccgtgatggccgtgatcgccaagacccccgccctgagaaagttcgtgttcgtgttccacctgtgcctggtggacctgctggccgccctgaccctgatgcccctggccatgctgagcagcagcgccctgttcgaccacgccctgttcggcgaggtggcctgcagactgtacctgttcctgagcgtgtgcttcgtgagcctggccatcctgagcgtgagcgccatcaacgtggagagatactactacgtggtgcaccccatgagatacgaggtgagaatgaccctgggcctggtggccagcgtgctggtgggcgtgtgggtgaaggccctggccatggccagcgtgcccgtgctgggcagagtgagctgggaggagggcgcccccagcgtgccccccggctgcagcctgcagtggagccacagcgcctactgccagctgttcgtggtggtgttcgccgtgctgtacttcctgctgcccctgctgctgatcctggtggtgtactgcagcatgttcagagtggccagagtggccgccatgcagcacggccccctgcccacctggatggagacccccagacagagaagcgagagcctgagcagcagaagcaccatggtgaccagcagcggcgccccccagaccaccccccacagaaccttcggcggcggcaaggccgccgtggtgctgctggccgtgggcggccagttcctgctgtgctggctgccctacttcagcttccacctgtacgtggccctgagcgcccagcccatcagcaccggccaggtggagagcgtggtgacctggatcggctacttctgcttcaccagcaaccccttcttctacggctgcctgaacagacagatcagaggcgagctgagcaagcagttcgtgtgcttcttcaagcccgcccccgaggaggagctgagactgcccagcagagagggcagcatcgaggagaacttcctgcagttcctgcagggcaccggctgccccagcgagagctgggtgagcagacccctgcccagccccaagcaggagccccccgccgtggacttcagaatccccggccagatcgccgaggagaccagcgagttcctggagcagcagctgaccagcgacatcatcatgagcgacagctacctgagacccgccgccagccccagactggagagctag

SEQ ID NO: 82478 - DNA, 1356 bp, Artificial Sequence; identical to SEQ ID NO: 82477
  Description of Artificial Sequence: Synthetic coding sequence

SEQ ID NO: 82479 - DNA, 1356 bp, Artificial Sequence; identical to SEQ ID NO: 82477
  Description of Artificial Sequence: Synthetic coding sequence

SEQ ID NO: 82480 - DNA, 1107 bp, Artificial Sequence
  Description of Artificial Sequence: Synthetic coding sequence
atggccaacagcaccggcctgaacgccagcgaggtggccggcagcctgggcctgatcctggccgccgtggtggaggtgggcgccctgctgggcaacggcgccctgctggtggtggtgctgagaacccccggcctgagagacgccctgtacctggcccacctgtgcgtggtggacctgctggccgccgccagcatcatgcccctgggcctgctggccgcccccccccccggcctgggcagagtgagactgggccccgccccctgcagagccgccagattcctgagcgccgccctgctgcccgcctgcaccctgggcgtggccgccctgggcctggccagatacagactgatcgtgcaccccctgagacccggcagcagacccccccccgtgctggtgctgaccgccgtgtgggccgccgccggcctgctgggcgccctgagcctgctgggcaccccccccgcccccccccccgcccccgccagatgcagcgtgctggccggcggcctgggccccttcagacccctgtgggccctgctggccttcgccctgcccgccctgctgctgctgggcgcctacggcggcatcttcgtggtggccagaagagccgccctgagaccccccagacccgccagaggcagcagactgcacagcgacagcctggacagcagactgagcatcctgccccccctgagacccagactgcccggcggcaaggccgccctggcccccgccctggccgtgggccagttcgccgcctgctggctgccctacggctgcgcctgcctggcccccgccgccagagccgccgaggccgaggccgccgtgacctgggtggcctacagcgccttcgccgcccaccccttcctgtacggcctgctgcagagacccgtgagactggccctgggcagactgagcagaagagccctgcccggccccgtgagagcctgcaccccccaggcctggcaccccagagccctgctgcagtgcctgcagagaccccccgagggccccgccgtgggccccagcgaggcccccgagcagacccccgagctggccggcggcagaagccccgcctaccagggcccccccgagagcagcctgagctag

SEQ ID NO: 82481 - DNA, 1434 bp, Artificial Sequence
  Description of Artificial Sequence: Synthetic coding sequence
atggccaacatgcagggcctggtggagagactggagagagccgtgagcagactggagagcctgagcgccgagagccacagaccccccggcaactgcggcgaggtgaacggcgtgatcgccggcgtggcccccagcgtggaggccttcgacaagctgatggacagcatggtggccgagttcctgaagaacagcagaatcctggccggcgacgtggagacccacgccgagatggtgcacagcgccttccaggcccagagagccttcctgctgatggccagccagtaccagcagccccacgagaacgacgtggccgccctgctgaagcccatcagcgagaagatccaggagatccagaccttcagagagagaaacagaggcagcaacatgttcaaccacctgagcgccgtgagcgagagcatccccgccctgggctggatcgccgtgagccccaagcccggcccctacgtgaaggagatgaacgacgccgccaccttctacaccaacagagtgctgaaggactacaagcacagcgacctgagacacgtggactgggtgaagagctacctgaacatctggagcgagctgcaggcctacatcaaggagcaccacaccaccggcctgacctggagcaagaccggccccgtggccagcaccgtgagcgccttcagcgtgctgagcagcggccccggcctgccccccccccccccccccctgcccccccccggccccccccccctgttcgagaacgagggcaagaaggaggagagcagccccagcagaagcgccctgttcgcccagctgaaccagggcgaggccatcaccaagggcctgagacacgtgaccgacgaccagaagacctacaagaaccccagcctgagagcccagggcggccagacccagagccccaccaagagccacacccccagccccaccagccccaagagctaccccagccagaagcacgcccccgtgctggagctggagggcaagaagtggagagtggagtaccaggaggacagaaacgacctggtgatcagcgagaccgagctgaagcaggtggcctacatcttcaagtgcgagaagagcaccatccagatcaagggcaaggtgaacagcatcatcatcgacaactgcaagaagctgggcctggtgttcgacaacgtggtgggcatcgtggaggtgatcaacagccaggacatccagatccaggtgatgggcagagtgcccaccatcagcatcaacaagaccgagggctgccacatctacctgagcgaggacgccctggactgcgagatcgtgagcgccaagagcagcgagatgaacatcctgatcccccaggacggcgactacagagagttccccatccccgagcagttcaagaccgcctgggacggcagcaagctgatcaccgagcccgccgagatcatggcctag

SEQ ID NO: 82482 - DNA, 1260 bp, Artificial Sequence; identical to SEQ ID NO: 81358
  Description of Artificial Sequence: Synthetic coding sequence

SEQ ID NO: 82483 - DNA, 1260 bp, Artificial Sequence; identical to SEQ ID NO: 81358
  Description of Artificial Sequence: Synthetic coding sequence

SEQ ID NO: 82484 - DNA, 1332 bp, Artificial Sequence
  Description of Artificial Sequence: Synthetic coding sequence
tactgctgcagcgtgctgaagtgcctgaagaacagctgcatcagcgcctgcatcttccaccccaccgagaccatggtgttcagcgccgtgctgaccgccttccacaccggcaccagcaacaccaccttcgtggtgtacgagaacacctacatgaacatcaccctgcccccccccttccagcaccccgacctgagccccctgctgagatacagcttcgagaccatggcccccaccggcctgagcagcctgaccgtgaacagcaccgccgtgcccaccacccccgccgccttcaagagcctgaacctgcccctgcagatcaccctgagcgccatcatgatcttcatcctgttcgtgagcttcctgggcaacctggtggtgtgcctgatggtgtaccagaaggccgccatgagaagcgccatcaacatcctgctggccagcctggccttcgccgacatgctgctggccgtgctgaacatgcccttcgccctggtgaccatcctgaccaccagatggatcttcggcaagttcttctgcagagtgagcgccatgttcttctggctgttcgtgatcgagggcgtggccatcctgctgatcatcagcatcgacagattcctgatcatcgtgcagagacaggacaagctgaacccctacagagccaaggtgctgatcgccgtgagctgggccaccagcttctgcgtggccttccccctggccgtgggcaaccccgacctgcagatccccagcagagccccccagtgcgtgttcggctacaccaccaaccccggctaccaggcctacgtgatcctgatcagcctgatcagcttcttcatccccttcctggtgatcctgtacagcttcatgggcatcctgaacaccctgagacacaacgccctgagaatccacagctaccccgagggcatctgcctgagccaggccagcaagctgggcctgatgagcctgcagagacccttccagatgagcatcgacatgggcttcaagaccagagccttcaccaccatcctgatcctgttcgccgtgttcatcgtgtgctgggcccccttcaccacctacagcctggtggccaccttcagcaagcacttctactaccagcacaacttcttcgagatcagcacctggctgctgtggctgtgctacctgaagagcgccctgaaccccctgatctactactggagaatcaagaagttccacgacgcctgcctggacatgatgcccaagagcttcaagttcctgccccagctgcccggccacaccaagagaagaatcagacccagcgccgtgtacgtgtgcggcgagcacagaaccgtggtgtag

SEQ ID NO: 82485 - DNA, 2697 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgaggtggagaccaccagcctgaacgacgtgaccctgagcctgctgcccagcaacgagaccggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82486 - DNA, 3006 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgacgaggagaccggcgcctgcagcgacgtgaccctgagcctgctgcccagcaacgagaccgagaagaccaagatcaccatcgtgaagaccttcaacgccagcggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82487 - DNA, 3012 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgccaagctgagcgtggtgagcttcgcccccagcagcaacggcacccccgaggtggagaccaccagcctgaacgacgtgaccctgagcctgctgcccagcaacgagaccggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82488 - DNA, 2964 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgaggtggagaccaccagcctgaacgacgtgaccctgagcctgctgcccagcaacgagaccggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82489 - DNA, 3045 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgccaagctgagcgtggtgagcttcgcccccagcagcaacgaggtggagaccaccagcctgaacgacgtgaccctgagcctgctgcccagcaacgagaccgagaagaccaagatcaccatcgtgaagaccttcaacgccagcggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82490 - DNA, 2988 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgccaagctgagcgtggtgagcttcgcccccagcagcaacggcacccccgacgtgaccctgagcctgctgcccagcaacgagaccggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82491 - DNA, 3054 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgccaagctgagcgtggtgagcttcgcccccagcagcaacggcacccccgaggtggagaccaccagcctgaacgacgtgaccctgagcctgctgcccagcaacgagaccgagaagaccaagatcaccatcgtgaagaccttcaacgccagcggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82492 - DNA, 2901 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgccaagctgagcgtggtgagcttcgcccccagcagcaacggcacccccgaggtggagaccaccagcctgaacgacgtgaccctgagcctgctgcccagcaacgagaccgagaagaccaagatcaccatcgtgaagaccttcaacgccagcggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82493 - DNA, 2982 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgacgtgaccctgagcctgctgcccagcaacgagaccgagaagaccaagatcaccatcgtgaagaccttcaacgccagcggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82494 - DNA, 3006 bp, Artificial Sequence
  Description of Artificial Sequence: Synthetic coding sequence
atggtgttcagcgtgagacagtgcggccacgtgggcagaaccgaggaggtgctgctgaccttcaagatcttcctggtgatcatctgcctgcacgtggtgctggtgaccagcctggaggaggacaccgacaacagcagcctgagccccccccccgaggtggagaccaccagcctgaacgacgtgaccctgagcctgctgcccagcaacgagaccgagaagaccaagatcaccatcgtgaagaccttcaacgccagcggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagcaccctgaactgcaccttcaccatcaagctgaacaacaccatgaacgcctgcgccgtgatcgccgccctggagagagtgaagatcagacccatggagcactgctgctgcagcgtgagaatcccctgccccagcagccccgaggagctggagaagctgcagtgcgacctgcaggaccccatcgtgtgcctggccgaccaccccagaggcccccccttcagcagcagccagagcatccccgtggtgcccagagccaccgtgctgagccaggtgcccaaggccaccagcttcgccgagccccccgactacagccccgtgacccacaacgtgcccagccccatcggcgagatccagcccctgagcccccagcccagcgcccccatcgccagcagccccgccatcgacatgcccccccagagcgagaccatcagcagccccatgccccagacccacgtgagcggcacccccccccccgtgaaggccagcttcagcagccccaccgtgagcgcccccgccaacgtgaacaccaccagcgccccccccgtgcagaccgacatcgtgaacaccagcagcatcagcgacctggagaaccaggtgctgcagatggagaaggccctgagcctgggcagcctggagcccaacctggccggcgagatgatcaaccaggtgagcagactgctgcacagcccccccgacatgctggcccccctggcccagagactgctgaaggtggtggacgacatcggcctgcagctgaacttcagcaacaccaccatcagcctgaccagccccagcctggccctggccgtgatcagagtgaacgccagcagcttcaacaccaccaccttcgtggcccaggaccccgccaacctgcaggtgagcctggagacccaggcccccgagaacagcatcggcaccatcaccctgcccagcagcctgatgaacaacctgcccgcccacgacatggagctggccagcagagtgcagttcaacttcttcgagacccccgccctgttccaggaccccagcctggagaacctgagcctgatcagctacgtgatcagcagcagcgtggccaacctgaccgtgagaaacctgaccagaaacgtgaccgtgaccctgaagcacatcaaccccagccaggacgagctgaccgtgagatgcgtgttctgggacctgggcagaaacggcggcagaggcggctggagcgacaacggctgcagcgtgaaggacagaagactgaacgagaccatctgcacctgcagccacctgaccagcttcggcgtgctgctggacctgagcagaaccagcgtgctgcccgcccagatgatggccctgaccttcatcacctacatcggctgcggcctgagcagcatcttcctgagcgtgaccctggtgacctacatcgccttcgagaagatcagaagagactaccccagcaagatcctgatccagctgtgcgccgccctgctgctgctgaacctggtgttcctgctggacagctggatcgccctgtacaagatgcagggcctgtgcatcagcgtggccgtgttcctgcactacttcctgctggtgagcttcacctggatgggcctggaggccttccacatgtacctggccctggtgaaggtgttcaacacctacatcagaaagtacatcctgaagttctgcatcgtgggctggggcgtgcccgccgtggtggtgaccatcatcctgaccatcagccccgacaactacggcctgggcagctacggcaagttccccaacggcagccccgacgacttctgctggatcaacaacaacgccgtgttctacatcaccgtggtgggctacttctgcgtgatcttcctgctgaacgtgagcatgttcatcgtggtgctggtgcagctgtgcagaatcaagaagaagaagcagctgggcgcccagagaaagaccagcatccaggacctgagaagcatcgccggcctgaccttcctgctgggcatcacctggggcttcgccttcttcgcctggggccccgtgaacgtgaccttcatgtacctgttcgccatcttcaacaccctgcagggcttcttcatcttcatcttctactgcgtggccaaggagaacgtgagaaagcagtggagaagatacctgtgctgcggcaagctgagactggccgagaacagcgactggagcaagaccgccaccaacggcctgaagaagcagaccgtgaaccagggcgtgagcagcagcagcaacagcctgcagagcagcagcaacagcaccaacagcaccaccctgctggtgaacaacgactgcagcgtgcacgccagcggcaacggcaacgccagcaccgagagaaacggcgtgagcttcagcgtgcagaacggcgacgtgtgcctgcacgacttcaccggcaagcagcacatgttcaacgagaaggaggacagctgcaacggcaagggcagaatggccctgagaagaaccagcaagagaggcagcctgcacttcatcgagcagatgtag

SEQ ID NO: 82495 - DNA, 354 bp, Artificial Sequence
  Description of Artificial Sequence: Synthetic coding sequence
atcctgctgaccatgcagcacatcaacaccggcatcgacatgctgaaccagctgggctgcgtgttcttcgccggcgtgaagccccagagaaacatctgcaacctgagcagcatctgcaacgacagcgccttcttcagaggcgagatcatgttccagtacgacaaggagagcaccgtgccccagaaccagcacatcaccaacggcaccctgaccggcgtgctgagcctgagcgagctgaagagaagcgagctgaacaagaccctgcagaccctgagcgagacctacttcatcatgtgcgccaccgccgaggcccagagacacatcaagctgtacatccacaacaagaccgagtag

SEQ ID NO: 82496 - DNA, 1014 bp, Artificial Sequence
  Description of Artificial Sequence: Synthetic coding sequence
atgaacagcacctgcatcgaggagcagcacgacctggaccactacctgttccccatcgtgtacatcttcgtgatcatcgtgagcatccccgccaacatcggcagcctgtgcgtgagcttcctgcaggccaagaaggagagcgagctgggcatctacctgttcagcctgagcctgagcgacctgctgtacgccctgaccctgcccctgtggatcgactacacctggaacaaggacaactggaccttcagccccgccctgtgcaagggcagcgccttcctgatgtacatgaacttctacagcagcaccgccttcctgacctgcatcgccgtggacagatacctggccgtggtgtaccccctgaagttcttcttcctgagaaccagaagattcgccctgatggtgagcctgagcatctggatcctggagaccatcttcaacgccgtgatgctgtgggaggacgagaccgtggtggagtactgcgacgccgagaagagcaacttcaccctgtgctacgacaagtaccccctggagaagtggcagatcaacctgaacctgttcagaacctgcaccggctacgccatccccctggtgaccatcctgatctgcaacagaaaggtgtaccaggccgtgagacacaacaaggccaccgagaacaaggagaagaagagaatcatcaagctgctggtgagcatcaccgtgaccttcgtgctgtgcttcacccccttccacgtgatgctgctgatcagatgcatcctggagcacgccgtgaacttcgaggaccacagcaacagcggcaagagaacctacaccatgtacagaatcaccgtggccctgaccagcctgaactgcgtggccgaccccatcctgtactgcttcgtgaccgagaccggcagatacgacatgtggaacatcctgaagttctgcaccggcagatgcaacaccagccagagacagagaaagagaatcctgagcgtgagcaccaaggacaccatggagctggaggtgctggagtag

SEQ ID NO: 82497 - DNA, 1623 bp, Artificial Sequence
  Description of Artificial Sequence: Synthetic coding sequence
atgaacagcaccggccacctgcaggacgcccccaacgccaccagcctgcacgtgccccacagccaggagggcaacagcaccagcctgcaggagggcctgcaggacctgatccacaccgccaccctggtgacctgcaccttcctgctggccgtgatcttctgcctgggcagctacggcaacttcatcgtgttcctgagcttcttcgaccccgccttcagaaagttcagaaccaacttcgacttcatgatcctgaacctgagcttctgcgacctgttcatctgcggcgtgaccgcccccatgttcaccttcgtgctgttcttcagcagcgccagcagcatccccgacgccttctgcttcaccttccacctgaccagcagcggcttcatcatcatgagcctgaagaccgtggccgtgatcgccctgcacagactgagaatggtgctgggcaagcagcccaacagaaccgccagcttcccctgcaccgtgctgctgaccctgctgctgtgggccaccagcttcaccctggccaccctggccaccctgaagaccagcaagagccacctgtgcctgcccatgagcagcctgatcgccggcaagggcaaggccatcctgagcctgtacgtggtggacttcaccttctgcgtggccgtggtgagcgtgagctacatcatgatcgcccagaccctgagaaagaacgcccaggtgagaaagtgcccccccgtgatcaccgtggacgccagcagaccccagcccttcatgggcgtgcccgtgcagggcggcggcgaccccatccagtgcgccatgcccgccctgtacagaaaccagaactacaacaagctgcagcacgtgcagaccagaggctacaccaagagccccaaccagctggtgacccccgccgccagcagactgcagctggtgagcgccatcaacctgagcaccgccaaggacagcaaggccgtggtgacctgcgtgatcatcgtgctgagcgtgctggtgtgctgcctgcccctgggcatcagcctggtgcaggtggtgctgagcagcaacggcagcttcatcctgtaccagttcgagctgttcggcttcaccctgatcttcttcaagagcggcctgaaccccttcatctacagcagaaacagcgccggcctgagaagaaaggtgctgtggtgcctgcagtacatcggcctgggcttcttctgctgcaagcagaagaccagactgagagccatgggcaagggcaacctggaggtgaacagaaacaagagcagccaccacgagaccaacagcgcctacatgctgagccccaagccccagaagaagttcgtggaccaggcctgcggccccagccacagcaaggagagcatggtgagccccaagatcagcgccggccaccagcactgcggccagagcagcagcacccccatcaacaccagaatcgagccctactacagcatctacaacagcagccccagccaggaggagagcagcccctgcaacctgcagcccgtgaacagcttcggcttcgccaacagctacatcgccatgcactaccacaccaccaacgacctggtgcaggagtacgacagcaccagcgccaagcagatccccgtgcccagcgtgtag

SEQ ID NO: 82498 - DNA, 1092 bp, Artificial Sequence
  Description of Artificial Sequence: Synthetic coding sequence
atgggccccggcgaggccctgctggccggcctgctggtgatggtgctggccgtggccctgctgagcaacgccctggtgctgctgtgctgcgcctacagcgccgagctgagaaccagagccagcggcgtgctgctggtgaacctgagcctgggccacctgctgctggccgccctggacatgcccttcaccctgctgggcgtgatgagaggcagaacccccagcgcccccggcgcctgccaggtgatcggcttcctggacaccttcctggccagcaacgccgccctgagcgtggccgccctgagcgccgaccagtggctggccgtgggcttccccctgagatacgccggcagactgagacccagatacgccggcctgctgctgggctgcgcctggggccagagcctggccttcagcggcgccgccctgggctgcagctggctgggctacagcagcgccttcgccagctgcagcctgagactgccccccgagcccgagagacccagattcgccgccttcaccgccaccctgcacgccgtgggcttcgtgctgcccctggccgtgctgtgcctgaccagcctgcaggtgcacagagtggccagaagacactgccagagaatggacaccgtgaccatgaaggccctggccctgctggccgacctgcaccccagcgtgagacagagatgcctgatccagcagaagagaagaagacacagagccaccagaaagatcggcatcgccatcgccaccttcctgatctgcttcgccccctacgtgatgaccagactggccgagctggtgcccttcgtgaccgtgaacgcccagtggggcatcctgagcaagtgcctgacctacagcaaggccgtggccgaccccttcacctacagcctgctgagaagacccttcagacaggtgctggccggcatggtgcacagactgctgaagagaacccccagacccgccagcacccacgacagcagcctggacgtggccggcatggtgcaccagctgctgaagagaacccccagacccgccagcacccacaacggcagcgtggacaccgagaacgacagctgcctgcagcagacccactag

SEQ ID NO: 82499 - DNA, 1011 bp, Artificial Sequence
  Description of Artificial Sequence: Synthetic coding sequence
atgaacaacaacaccacctgcatccagcccagcatgatcagcagcatggccctgcccatcatctacatcctgctgtgcatcgtgggcgtgttcggcaacaccctgagccagtggatcttcctgaccaagatcggcaagaagaccagcacccacatctacctgagccacctggtgaccgccaacctgctggtgtgcagcgccatgcccttcatgagcatctacttcctgaagggcttccagtgggagtaccagagcgcccagtgcagagtggtgaacttcctgggcaccctgagcatgcacgccagcatgttcgtgagcctgctgatcctgagctggatcgccatcagcagatacgccaccctgatgcagaaggacagcagccaggagaccaccagctgctacgagaagatcttctacggccacctgctgaagaagttcagacagcccaacttcgccagaaagctgtgcatctacatctggggcgtggtgctgggcatcatcatccccgtgaccgtgtactacagcgtgatcgaggccaccgagggcgaggagagcctgtgctacaacagacagatggagctgggcgccatgatcagccagatcgccggcctgatcggcaccaccttcatcggcttcagcttcctggtggtgctgaccagctactacagcttcgtgagccacctgagaaagatcagaacctgcaccagcatcatggagaaggacctgacctacagcagcgtgaagagacacctgctggtgatccagatcctgctgatcgtgtgcttcctgccctacagcatcttcaagcccatcttctacgtgctgcaccagagagacaactgccagcagctgaactacctgatcgagaccaagaacatcctgacctgcctggccagcgccagaagcagcaccgaccccatcatcttcctgctgctggacaagaccttcaagaagaccctgtacaacctgttcaccaagagcaacagcgcccacatgcagagctacggctag

SEQ ID NO: 82500 - DNA, 1272 bp, Artificial Sequence
  Description of Artificial Sequence: Synthetic coding sequence
atggtgccccacctgctgctgctgtgcctgctgcccctggtgagagccaccgagccccacgagggcagagccgacgagcagagcgccgaggccgccctggccgtgcccaacgccagccacttcttcagctggaacaactacaccttcagcgactggcagaacttcgtgggcagaagaagatacggcgccgagagccagaaccccaccgtgaaggccctgctgatcgtggcctacagcttcatcatcgtgttcagcctgttcggcaacgtgctggtgtgccacgtgatcttcaagaaccagagaatgcacagcgccaccagcctgttcatcgtgaacctggccgtggccgacatcatgatcaccctgctgaacacccccttcaccctggtgagattcgtgaacagcacctggatcttcggcaagggcatgtgccacgtgagcagattcgcccagtactgcagcctgcacgtgagcgccctgaccctgaccgccatcgccgtggacagacaccaggtgatcatgcaccccctgaagcccagaatcagcatcaccaagggcgtgatctacatcgccgtgatctggaccatggccaccttcttcagcctgccccacgccatctgccagaagctgttcaccttcaagtacagcgaggacatcgtgagaagcctgtgcctgcccgacttccccgagcccgccgacctgttctggaagtacctggacctggccaccttcatcctgctgtacatcctgcccctgctgatcatcagcgtggcctacgccagagtggccaagaagctgtggctgtgcaacatgatcggcgacgtgaccaccgagcagtacttcgccctgagaagaaagaagaagaagaccatcaagatgctgatgctggtggtggtgctgttcgccctgtgctggttccccctgaactgctacgtgctgctgctgagcagcaaggtgatcagaaccaacaacgccctgtacttcgccttccactggttcgccatgagcagcacctgctacaaccccttcatctactgctggctgaacgagaacttcagaatcgagctgaaggccctgctgagcatgtgccagagaccccccaagccccaggaggacagaccccccagccccgtgcccagcttcagagtggcctggaccgagaagaacgacggccagagagcccccctggccaacaacctgctgcccaccagccagctgcagagcggcaagaccgacctgagcagcgtggagcccatcgtgaccatgagctag

SEQ ID NO: 82501 - DNA, 1191 bp, Artificial Sequence
  Description of Artificial Sequence: Synthetic coding sequence
atgtggaacagcagcgacgccaacttcagctgctaccacgagagcgtgctgggctacagatacgtggccgtgagctggggcgtggtggtggccgtgaccggcaccgtgggcaacgtgctgaccctgctggccctggccatccagcccaagctgagaaccagattcaacctgctgatcgccaacctgaccctggccgacctgctgtactgcaccctgctgcagcccttcagcgtggacacctacctgcacctgcactggagaaccggcgccaccttctgcagagtgttcggcctgctgctgttcgccagcaacagcgtgagcatcctgaccctgtgcctgatcgccctgggcagatacctgctgatcgcccaccccaagctgttcccccaggtgttcagcgccaagggcatcgtgctggccctggtgagcacctgggtggtgggcgtggccagcttcgcccccctgtggcccatctacatcctggtgcccgtggtgtgcacctgcagcttcgacagaatcagaggcagaccctacaccaccatcctgatgggcatctacttcgtgctgggcctgagcagcgtgggcatcttctactgcctgatccacagacaggtgaagagagccgcccaggccctggaccagtacaagctgagacaggccagcatccacagcaaccacgtggccagaaccgacgaggccatgcccggcagattccaggagctggacagcagactggccagcggcggccccagcgagggcatcagcagcgagcccgtgagcgccgccaccacccagaccctggagggcgacagcagcgaggtgggcgaccagatcaacagcaagagagccaagcagatggccgagaagagcccccccgaggccagcgccaaggcccagcccatcaagggcgccagaagagcccccgacagcagcagcgagttcggcaaggtgaccagaatgtgcttcgccgtgttcctgtgcttcgccctgagctacatccccttcctgctgctgaacatcctggacgccagagtgcaggcccccagagtggtgcacatgctggccgccaacctgacctggctgaacggctgcatcaaccccgtgctgtacgccgccatgaacagacagttcagacaggcctacggcagcatcctgaagagaggccccagaagcttccacagactgcactag

SEQ ID NO: 82502 - DNA, 1191 bp, Artificial Sequence; identical to SEQ ID NO: 82501
  Description of Artificial Sequence: Synthetic coding sequence

SEQ ID NO: 82503 - DNA, 1113 bp, Artificial Sequence
  Description of Artificial Sequence: Synthetic coding sequence
atggccaactacagccacgccgccgacaacatcctgcagaacctgagccccctgaccgccttcctgaagctgaccagcctgggcttcatcatcggcgtgagcgtggtgggcaacctgctgatcagcatcctgctggtgaaggacaagaccctgcacagagccccctactacttcctgctggacctgtgctgcagcgacatcctgagaagcgccatctgcttccccttcgtgttcaacagcgtgaagaacggcagcacctggacctacggcaccctgacctgcaaggtgatcgccttcctgggcgtgctgagctgcttccacaccgccttcatgctgttctgcatcagcgtgaccagatacctggccatcgcccaccacagattctacaccaagagactgaccttctggacctgcctggccgtgatctgcatggtgtggaccctgagcgtggccatggccttcccccccgtgctggacgtgggcacctacagcttcatcagagaggaggaccagtgcaccttccagcacagaagcttcagagccaacgacagcctgggcttcatgctgctgctggccctgatcctgctggccacccagctggtgtacctgaagctgatcttcttcgtgcacgacagaagaaagatgaagcccgtgcagttcgtggccgccgtgagccagaactggaccttccacggccccggcgccagcggccaggccgccgccaactggctggccggcttcggcagaggccccaccccccccaccctgctgggcatcagacagaacgccaacaccaccggcagaagaagactgctggtgctggacgagttcaagatggagaagagaatcagcagaatgttctacatcatgaccttcctgttcctgaccctgtggggcccctacctggtggcctgctactggagagtgttcgccagaggccccgtggtgcccggcggcttcctgaccgccgccgtgtggatgagcttcgcccaggccggcatcaaccccttcgtgtgcatcttcagcaacagagagctgagaagatgcttcagcaccaccctgctgtactgcagaaagagcagactgcccagagagccctactgcgtgatctag

SEQ ID NO: 82504 - DNA, 1113 bp, Artificial Sequence; identical to SEQ ID NO: 82503
  Description of Artificial Sequence: Synthetic coding sequence

SEQ ID NO: 82505 - DNA, 216 bp, Artificial Sequence
  Description of Artificial Sequence: Synthetic coding sequence
atggccaactacagccacgccgccgacaacatcctgcagaacctgagccccctgaccgccttcctgaagctgaccagcctgggcttcatcatcggcgtgagcgtggtgggcaacctgctgatcagcatcctgctggtgaaggacaagaccctgcacagagccccctactacttcctgctggacctgtgctgcagcgacatcctgagaagcgcctag

SEQ ID NO: 82506 - DNA, 1113 bp, Artificial Sequence; identical to SEQ ID NO: 82503
  Description of Artificial Sequence: Synthetic coding sequence

SEQ ID NO: 82507 - DNA, 366 bp, Artificial Sequence
  Description of Artificial Sequence: Synthetic coding sequence
atggccaactacagccacgccgccgacaacatcctgcagaacctgagccccctgaccgccttcctgaagctgaccagcctgggcttcatcatcggcgtgagcgtggtgggcaacctgctgatcagcatcctgctggtgaaggacaagaccctgcacagagccccctactacttcctgctggacctgtgctgcagcgacatcctgagaagcgccatctgcttccccttcgtgttcaacagcgtgaagaacggcagcacctggacctacggcaccctgacctgcaaggtgatcgccttcctgggcgtgctgagctgcttccacaccgccttcatgctgttctgcatcagcgtgaccagatacctgtag

SEQ ID NO: 82508 - DNA, 1113 bp, Artificial Sequence; identical to SEQ ID NO: 82503
  Description of Artificial Sequence: Synthetic coding sequence

SEQ ID NO: 82509 - DNA, 1077 bp, Artificial Sequence
  Description of Artificial Sequence: Synthetic coding sequence
atgggcttcaacctgaccctggccaagctgcccaacaacgagctgcacggccaggagagccacaacagcggcaacagaagcgacggccccggcaagaacaccaccctgcacaacgagttcgacaccatcgtgctgcccgtgctgtacctgatcatcttcgtggccagcatcctgctgaacggcctggccgtgtggatcttcttccacatcagaaacaagaccagcttcatcttctacctgaagaacatcgtggtggccgacctgatcatgaccctgaccttccccttcagaatcgtgcacgacgccggcttcggcccctggtacttcaagttcatcctgtgcagatacaccagcgtgctgttctacgccaacatgtacaccagcatcgtgttcctgggcctgatcagcatcgacagatacctgaaggtggtgaagcccttcggcgacagcagaatgtacagcatcaccttcaccaaggtgctgagcgtgtgcgtgtgggtgatcatggccgtgctgagcctgcccaacatcatcctgaccaacggccagcccaccgaggacaacatccacgactgcagcaagctgaagagccccctgggcgtgaagtggcacaccgccgtgacctacgtgaacagctgcctgttcgtggccgtgctggtgatcctgatcggctgctacatcgccatcagcagatacatccacaagagcagcagacagttcatcagccagagcagcagaaagagaaagcacaaccagagcatcagagtggtggtggccgtgttcttcacctgcttcctgccctaccacctgtgcagaatccccttcaccttcagccacctggacagactgctggacgagagcgcccagaagatcctgtactactgcaaggagatcaccctgttcctgagcgcctgcaacgtgtgcctggaccccatcatctacttcttcatgtgcagaagcttcagcagaagactgttcaagaagagcaacatcagaaccagaagcgagagcatcagaagcctgcagagcgtgagaagaagcgaggtgagaatctactacgactacaccgacgtgtag

SEQ ID NO: 82510 - DNA, 1368 bp, Artificial Sequence
  Description of Artificial Sequence: Synthetic coding sequence
atgagcttcctgatcgacagcagcatcatgatcaccagccagatcctgttcttcggcttcggctggctgttcttcatgagacagctgttcaaggactacgagatcagacagtacgtggtgcaggtgatcttcagcgtgaccttcgccttcagctgcaccatgttcgagctgatcatcttcgagatcctgggcgtgctgaacagcagcagcagatacttccactggaagatgaacctgtgcgtgatcctgctgatcctggtgttcatggtgcccttctacatcggctacttcatcgtgagcaacatcagactgctgcacaagcagagactgctgttcagctgcctgctgtggctgaccttcatgtacttcttctggaagctgggcgaccccttccccatcctgagccccaagcacggcatcctgagcatcgagcagctgatcagcagagtgggcgtgatcggcgtgaccctgatggccctgctgagcggcttcggcgccgtgaactgcccctacacctacatgagctacttcctgagaaacgtgaccgacaccgacatcctggccctggagagaagactgctgcagaccatggacatgatcatcagcaagaagaagagaatggccatggccagaagaaccatgttccagaagggcgaggtgcacaacaagcccagcggcttctggggcatgatcaagagcgtgaccaccagcgccagcggcagcgagaacctgaccctgatccagcaggaggtggacgccctggaggagctgagcagacagctgttcctggagaccgccgacctgtacgccaccaaggagagaatcgagtacagcaagaccttcaagggcaagtacttcaacttcctgggctacttcttcagcatctactgcgtgtggaagatcttcatggccaccatcaacatcgtgttcgacagagtgggcaagaccgaccccgtgaccagaggcatcgagatcaccgtgaactacctgggcatccagttcgacgtgaagttctggagccagcacatcagcttcatcctggtgggcatcatcatcgtgaccagcatcagaggcctgctgatcaccctgaccaagttcttctacgccatcagcagcagcaagagcagcaacgtgatcgtgctgctgctggcccagatcatgggcatgtacttcgtgagcagcgtgctgctgatcagaatgagcatgcccctggagtacagaaccatcatcaccgaggtgctgggcgagctgcagttcaacttctaccacagatggttcgacgtgatcttcctggtgagcgccctgagcagcatcctgttcctgtacctggcccacaagcaggcccccgagaagcagatggccccctag

SEQ ID NO: 82511 - DNA, 1008 bp, Artificial Sequence
  Description of Artificial Sequence: Synthetic coding sequence
atgtacttcttctggaagctgggcgaccccttccccatcctgagccccaagcacggcatcctgagcatcgagcagctgatcagcagagtgggcgtgatcggcgtgaccctgatggccctgctgagcggcttcggcgccgtgaactgcccctacacctacatgagctacttcctgagaaacgtgaccgacaccgacatcctggccctggagagaagactgctgcagaccatggacatgatcatcagcaagaagaagagaatggccatggccagaagaaccatgttccagaagggcgaggtgcacaacaagcccagcggcttctggggcatgatcaagagcgtgaccaccagcgccagcggcagcgagaacctgaccctgatccagcaggaggtggacgccctggaggagctgagcagacagctgttcctggagaccgccgacctgtacgccaccaaggagagaatcgagtacagcaagaccttcaagggcaagtacttcaacttcctgggctacttcttcagcatctactgcgtgtggaagatcttcatggccaccatcaacatcgtgttcgacagagtgggcaagaccgaccccgtgaccagaggcatcgagatcaccgtgaactacctgggcatccagttcgacgtgaagttctggagccagcacatcagcttcatcctggtgggcatcatcatcgtgaccagcatcagaggcctgctgatcaccctgaccaagttcttctacgccatcagcagcagcaagagcagcaacgtgatcgtgctgctgctggcccagatcatgggcatgtacttcgtgagcagcgtgctgctgatcagaatgagcatgcccctggagtacagaaccatcatcaccgaggtgctgggcgagctgcagttcaacttctaccacagatggttcgacgtgatcttcctggtgagcgccctgagcagcatcctgttcctgtacctggcccacaagcaggcccccgagaagcagatggccccctag

SEQ ID NO: 82512 - DNA, 1368 bp, Artificial Sequence; identical to SEQ ID NO: 82510
  Description of Artificial Sequence: Synthetic coding sequence

SEQ ID NO: 82513 - DNA, 18921 bp, Artificial Sequence
  Description of Artificial Sequence: Synthetic coding sequence
atggacatcttcctggtgctgggcatgcccagcgccagcctgctggtgaacctgctgagcgccctgctgatcctgttcgtgttcggcgagaccgagatcagattcaccggccagaccgagttcgtggtgaacgagaccagcaccaccgtgatcagactgatcatcgagagaatcggcgagcccgccaacgtgaccgccatcgtgagcctgtacggcgaggacgccggcgacttcttcgacacctacgccgccgccttcatccccgccggcgagaccaacagaaccgtgtacatcgccgtgtgcgacgacgacctgcccgagcccgacgagaccttcatcttccacctgaccctgcagaagcccagcgccaacgtgaagctgggctggcccagaaccgtgaccgtgaccatcctgagcaacgacaacgccttcggcatcatcagcttcaacatgctgcccagcatcgccgtgagcgagcccaagggcagaaacgagagcatgcccctgaccctgatcagagagaagggcacctacggcatggtgatggtgaccttcgaggtggagggcggccccaacccccccgacgaggacctgagccccgtgaagggcaacatcaccttcccccccggcagagccaccgtgatctacaacctgaccgtgctggacgacgaggtgcccgagaacgacgagatcttcctgatccagctgaagagcgtggagggcggcgccgagatcaacaccagcagaaacagcatcgagatcatcatcaagaagaacgacagccccgtgagattcctgcagagcatctacctggtgcccgaggaggaccacatcctgatcatccccgtggtgagaggcaaggacaacaacggcaacctgatcggcagcgacgagtacgaggtgagcatcagctacgccgtgaccaccggcaacagcaccgcccacgcccagcagaacctggacttcatcgacctgcagcccaacaccaccgtggtgttcccccccttcatccacgagagccacctgaagttccagatcgtggacgacaccatccccgagatcgccgagagcttccacatcatgctgctgaaggacaccctgcagggcgacgccgtgctgatcagccccagcgtggtgcaggtgaccatcaagcccaacgacaagccctacggcgtgctgagcttcaacagcgtgctgttcgagagaaccgtgatcatcgacgaggacagaatcagcagatacgaggagatcaccgtggtgagaaacggcggcacccacggcaacgtgagcgccaactgggtgctgaccagaaacagcaccgaccccagccccgtgaccgccgacatcagacccagcagcggcgtgctgcacttcgcccagggccagatgctggccaccatccccctgaccgtggtggacgacgacctgcccgaggaggccgaggcctacctgctgcagatcctgccccacaccatcagaggcggcgccgaggtgagcgagcccgccgagctgctgttctacatccaggacagcgacgacgtgtacggcctgatcaccttcttccccatggagaaccagaagatcgagagcagccccggcgagagatacctgagcctgagcttcaccagactgggcggcaccaagggcgacgtgagactgctgtacagcgtgctgtacatccccgccggcgccgtggaccccctgcaggccaaggagggcatcctgaacatcagcagaagaaacgacctgatcttccccgagcagaagacccaggtgaccaccaagctgcccatcagaaacgacgccttcctgcagaacggcgcccacttcctggtgcagctggagaccgtggagctgctgaacatcatccccctgatcccccccatcagccccagattcggcgagatctgcaacatcagcctgctggtgacccccgccatcgccaacggcgagatcggcttcctgagcaacctgcccatcatcctgcacgagcccgaggacttcgccgccgaggtggtgtacatccccctgcacagagacggcaccgacggccaggccaccgtgtactggagcctgaagcccagcggcttcaacagcaaggccgtgacccccgacgacatcggccccttcaacggcagcgtgctgttcctgagcggccagagcgacaccaccatcaacatcaccatcaagggcgacgacatccccgagatgaacgagaccgtgaccctgagcctggacagagtgaacgtggagaaccaggtgctgaagagcggctacaccagcagagacctgatcatcctggagaacgacgaccccggcggcgtgttcgagttcagccccgccagcagaggcccctacgtgatcaaggagggcgagagcgtggagctgcacatcatcagaagcagaggcagcctggtgaagcagttcctgcactacagagtggagcccagagacagcaacgagttctacggcaacaccggcgtgctggagttcaagcccggcgagagagagatcgtgatcaccctgctggccagactggacggcatccccgagctggacgagcactactgggtggtgctgagcagccacggcgagagagagagcaagctgggcagcgccaccatcgtgaacatcaccatcctgaagaacgacgacccccacggcatcatcgagttcgtgagcgacggcctgatcgtgatgatcaacgagagcaagggcgacgccatctacagcgccgtgtacgacgtggtgagaaacagaggcaacttcggcgacgtgagcgtgagctgggtggtgagccccgacttcacccaggacgtgttccccgtgcagggcaccgtggtgttcggcgaccaggagttcagcaagaacatcaccatctacagcctgcccgacgagatccccgaggagatggaggagttcaccgtgatcctgctgaacggcaccggcggcgccaaggtgggcaacagaaccaccgccaccctgagaatcagaagaaacgacgaccccatctacttcgccgagcccagagtggtgagagtgcaggagggcgagaccgccaacttcaccgtgctgagaaacggcagcgtggacgtgacctgcatggtgcagtacgccaccaaggacggcaaggccaccgccagagagagagacttcatccccgtggagaagggcgagaccctgatcttcgaggtgggcagcagacagcagagcatcagcatcttcgtgaacgaggacggcatccccgagaccgacgagcccttctacatcatcctgctgaacagcaccggcgacaccgtggtgtaccagtacggcgtggccaccgtgatcatcgaggccaacgacgaccccaacggcatcttcagcctggagcccatcgacaaggccgtggaggagggcaagaccaacgccttctggatcctgagacacagaggctacttcggcagcgtgagcgtgagctggcagctgttccagaacgacagcgccctgcagcccggccaggagttctacgagaccagcggcaccgtgaacttcatggacggcgaggaggccaagcccatcatcctgcacgccttccccgacaagatccccgagttcaacgagttctacttcctgaagctggtgaacatcagcggcggcagccccggccccggcggccagctggccgagaccaacctgcaggtgaccgtgatggtgcccttcaacgacgaccccttcggcgtgttcatcctggaccccgagtgcctggagagagaggtggccgaggacgtgctgagcgaggacgacatgagctacatcaccaacttcaccatcctgagacagcagggcgtgttcggcgacgtgcagctgggctgggagatcctgagcagcgagttccccgccggcctgccccccatgatcgacttcctgctggtgggcatcttccccaccaccgtgcacctgcagcagcacatgagaagacaccacagcggcaccgacgccctgtacttcaccggcctggagggcgccttcggcaccgtgaaccccaagtaccaccccagcagaaacaacaccatcgccaacttcaccttcagcgcctgggtgatgcccaacgccaacaccaacggcttcatcatcgccaaggacgacggcaacggcagcatctactacggcgtgaagatccagaccaacgagagccacgtgaccctgagcctgcactacaagaccctgggcagcaacgccacctacatcgccaagaccaccgtgatgaagtacctggaggagagcgtgtggctgcacctgctgatcatcctggaggacggcatcatcgagttctacctggacggcaacgccatgcccagaggcatcaagagcctgaagggcgaggccatcaccgacggccccggcatcctgagaatcggcgccggcatcaacggcaacgacagattcaccggcctgatgcaggacgtgagaagctacgagagaaagctgaccctggaggagatctacgagctgcacgccatgcccgccaagagcgacctgcaccccatcagcggctacctggagttcagacagggcgagaccaacaagagcttcatcatcagcgccagagacgacaacgacgaggagggcgaggagctgttcatcctgaagctggtgagcgtgtacggcggcgccagaatcagcgaggagaacaccaccgccagactgaccatccagaagagcgacaacgccaacggcctgttcggcttcaccggcgcctgcatccccgagatcgccgaggagggcagcaccatcagctgcgtggtggagagaaccagaggcgccctggactacgtgcacgtgttctacaccatcagccagatcgagaccgacggcatcaactacctggtggacgacttcgccaacgccagcggcaccatcaccttcctgccctggcagagaagcgaggtgctgaacatctacgtgctggacgacgacatccccgagctgaacgagtacttcagagtgaccctggtgagcgccatccccggcgacggcaagctgggcagcacccccaccagcggcgccagcatcgaccccgagaaggagaccaccgacatcaccatcaaggccagcgaccacccctacggcctgctgcagttcagcaccggcctgcccccccagcccaaggacgccatgaccctgcccgccagcagcgtgccccacatcaccgtggaggaggaggacggcgagatcagactgctggtgatcagagcccagggcctgctgggcagagtgaccgccgagttcagaaccgtgagcctgaccgccttcagccccgaggactaccagaacgtggccggcaccctggagttccagcccggcgagagatacaagtacatcttcatcaacatcaccgacaacagcatccccgagctggagaagagcttcaaggtggagctgctgaacctggagggcggcgtggccgagctgttcagagtggacggcagcggcagcggcgacggcgacatggagttcttcctgcccaccatccacaagagagccagcctgggcgtggccagccagatcctggtgaccatcgccgccagcgaccacgcccacggcgtgttcgagttcagccccgagagcctgttcgtgagcggcaccgagcccgaggacggctacagcaccgtgaccctgaacgtgatcagacaccacggcaccctgagccccgtgaccctgcactggaacatcgacagcgaccccgacggcgacctggccttcaccagcggcaacatcaccttcgagatcggccagaccagcgccaacatcaccgtggagatcctgcccgacgaggaccccgagctggacaaggccttcagcgtgagcgtgctgagcgtgagcagcggcagcctgggcgcccacatcaacgccaccctgaccgtgctggccagcgacgacccctacggcatcttcatcttcagcgagaagaacagacccgtgaaggtggaggaggccacccagaacatcaccctgagcatcatcagactgaagggcctgatgggcaaggtgctggtgagctacgccaccctggacgacatggagaagcccccctacttcccccccaacctggccagagccacccagggcagagactacatccccgccagcggcttcgccctgttcggcgccaaccagagcgaggccaccatcgccatcagcatcctggacgacgacgagcccgagagaagcgagagcgtgttcatcgagctgctgaacagcaccctggtggccaaggtgcagagcagaagcatccccaacagccccagactgggccccaaggtggagaccatcgcccagctgatcatcatcgccaacgacgacgccttcggcaccctgcagctgagcgcccccatcgtgagagtggccgagaaccacgtgggccccatcatcaacgtgaccagaaccggcggcgccttcgccgacgtgagcgtgaagttcaaggccgtgcccatcaccgccatcgccggcgaggactacagcatcgccagcagcgacgtggtgctgctggagggcgagaccagcaaggccgtgcccatctacgtgatcaacgacatctaccccgagctggaggagagcttcctggtgcagctgatgaacgagaccaccggcggcgccagactgggcgccctgaccgaggccgtgatcatcatcgaggccagcgacgacccctacggcctgttcggcttccagatcaccaagctgatcgtggaggagcccgagttcaacagcgtgaaggtgaacctgcccatcatcagaaacagcggcaccctgggcaacgtgaccgtgcagtgggtggccaccatcaacggccagctggccaccggcgacctgagagtggtgagcggcaacgtgaccttcgcccccggcgagaccatccagaccctgctgctggaggtgctggccgacgacgtgcccgagatcgaggaggtgatccaggtgcagctgaccgacgccagcggcggcggcaccatcggcctggacagaatcgccaacatcatcatccccgccaacgacgacccctacggcaccgtggccttcgcccagatggtgtacagagtgcaggagcccctggagagaagcagctgcgccaacatcaccgtgagaagaagcggcggccacttcggcagactgctgctgttctacagcaccagcgacatcgacgtggtggccctggccatggaggagggccaggacctgctgagctactacgagagccccatccagggcgtgcccgaccccctgtggagaacctggatgaacgtgagcgccgtgggcgagcccctgtacacctgcgccaccctgtgcctgaaggagcaggcctgcagcgccttcagcttcttcagcgccagcgagggcccccagtgcttctggatgaccagctggatcagccccgccgtgaacaacagcgacttctggacctacagaaagaacatgaccagagtggccagcctgttcagcggccaggccgtggccggcagcgactacgagcccgtgaccagacagtgggccatcatgcaggagggcgacgagttcgccaacctgaccgtgagcatcctgcccgacgacttccccgagatggacgagagcttcctgatcagcctgctggaggtgcacctgatgaacatcagcgccagcctgaagaaccagcccaccatcggccagcccaacatcagcaccgtggtgatcgccctgaacggcgacgccttcggcgtgttcgtgatctacaacatcagccccaacaccagcgaggacggcctgttcgtggaggtgcaggagcagccccagaccctggtggagctgatgatccacagaaccggcggcagcctgggccaggtggccgtggagtggagagtggtgggcggcaccgccaccgagggcctggacttcatcggcgccggcgagatcctgaccttcgccgagggcgagaccaagaagaccgtgatcctgaccatcctggacgacagcgagcccgaggacgacgagagcatcatcgtgagcctggtgtacaccgagggcggcagcagaatcctgcccagcagcgacaccgtgagagtgaacatcctggccaacgacaacgtggccggcatcgtgagcttccagaccgccagcagaagcgtgatcggccacgagggcgagatcctgcagttccacgtgatcagaaccttccccggcagaggcaacgtgaccgtgaactggaagatcatcggccagaacctggagctgaacttcgccaacttcagcggccagctgttcttccccgagggcagcctgaacaccaccctgttcgtgcacctgctggacgacaacatccccgaggagaaggaggtgtaccaggtgatcctgtacgacgtgagaacccagggcgtgccccccgccggcatcgccctgctggacgcccagggctacgccgccgtgctgaccgtggaggccagcgacgagccccacggcgtgctgaacttcgccctgagcagcagattcgtgctgctgcaggaggccaacatcaccatccagctgttcatcaacagagagttcggcagcctgggcgccatcaacgtgacctacaccaccgtgcccggcatgctgagcctgaagaaccagaccgtgggcaacctggccgagcccgaggtggacttcgtgcccatcatcggcttcctgatcctggaggagggcgagaccgccgccgccatcaacatcaccatcctggaggacgacgtgcccgagctggaggagtacttcctggtgaacctgacctacgtgggcctgaccatggccgccagcaccagcttcccccccagactggacagcgagggcctgaccgcccaggtgatcatcgacgccaacgacggcgccagaggcgtgatcgagtggcagcagagcagattcgaggtgaacgagacccacggcagcctgaccctggtggcccagagaagcagagagcccctgggccacgtgagcctgttcgtgtacgcccagaacctggaggcccaggtgggcctggactacatcttcacccccatgatcctgcacttcgccgacggcgagagatacaagaacgtgaacatcatgatcctggacgacgacatccccgagggcgacgagaagttccagctgatcctgaccaaccccagccccggcctggagctgggcaagaacaccatcgccctgatcatcgtgctggccaacgacgacggccccggcgtgctgagcttcaacaacagcgagcacttcttcctgagagagcccaccgccctgtacgtgcaggagagcgtggccgtgctgtacatcgtgagagagcccgcccagggcctgttcggcaccgtgaccgtgcagttcatcgtgaccgaggtgaacagcagcaacgagagcaaggacctgacccccagcaagggctacatcgtgctggaggagggcgtgagattcaaggccctgcagatcagcgccatcctggacaccgagcccgagatggacgagtacttcgtgtgcaccctgttcaaccccaccggcggcgccagactgggcgtgcacgtgcagaccctgatcaccgtgctgcagaaccaggcccccctgggcctgttcagcatcagcgccgtggagaacagagccaccagcatcgacatcgaggaggccaacagaaccgtgtacctgaacgtgagcagaaccaacggcatcgacctggccgtgagcgtgcagtgggagaccgtgagcgagaccgccttcggcatgagaggcatggacgtggtgttcagcgtgttccagagcttcctggacgagagcgccagcggctggtgcttcttcaccctggagaacctgatctacggcatcatgctgagaaagagcagcgtgaccgtgtacagatggcagggcatcttcatccccgtggaggacctgaacatcgagaaccccaagacctgcgaggccttcaacatcggcttcagcccctacttcgtgatcacccacgaggagagaaacgaggagaagcccagcctgaacagcgtgttcaccttcaccagcggcttcaagctgttcctggtgcagaccatcatcatcctggagagcagccaggtgagatacttcaccagcgacagccaggactacctgatcatcgccagccagagagacgacagcgagctgacccaggtgttcagatggaacggcggcagcttcgtgctgcaccagaagctgcccgtgagaggcgtgctgaccgtggccctgttcaacaagggcggcagcgtgttcctggccatcagccaggccaacgccagactgaacagcctgctgttcagatggagcggcagcggcttcatcaacttccaggaggtgcccgtgagcggcaccaccgaggtggaggccctgagcagcgccaacgacatctacctgatcttcgccgagaacgtgttcctgggcgaccagaacagcatcgacatcttcatctgggagatgggccagagcagcttcagatacttccagagcgtggacttcgccgccgtgaacagaatccacagcttcacccccgccagcggcatcgcccacatcctgctgatcggccaggacatgagcgccctgtactgctggaacagcgagagaaaccagttcagcttcgtgctggaggtgcccagcgcctacgacgtggccagcgtgaccgtgaagagcctgaacagcagcaagaacctgatcgccctggtgggcgcccacagccacatctacgagctggcctacatcagcagccacagcgacttcatccccagcagcggcgagctgatcttcgagcccggcgagagagaggccaccatcgccgtgaacatcctggacgacaccgtgcccgagaaggaggagagcttcaaggtgcagctgaagaaccccaagggcggcgccgagatcggcatcaacgacagcgtgaccatcaccatcctgagcaacgacgacgcctacggcatcgtggccttcgcccagaacagcctgtacaagcaggtggaggagatggagcaggacagcctggtgaccctgaacgtggagagactgaagggcacctacggcagaatcaccatcgcctgggaggccgacggcagcatcagcgacatcttccccaccagcggcgtgatcctgttcaccgagggccaggtgctgagcaccatcaccctgaccatcctggccgacaacatccccgagctgagcgaggtggtgatcgtgaccctgaccagaatcaccaccgagggcgtggaggacagctacaagggcgccaccatcgaccaggacagaagcaagagcgtgatcaccaccctgcccaacgacagccccttcggcctggtgggctggagagccgccagcgtgttcatcagagtggccgagcccaaggagaacaccaccaccctgcagctgcagatcgccagagacaagggcctgctgggcgacatcgccatccacctgagagcccagcccaacttcctgctgcacgtggacaaccaggccaccgagaacgaggactacgtgctgcaggagaccatcatcatcatgaaggagaacatcaaggaggcccacgccgaggtgagcatcctgcccgacgacctgcccgagctggaggagggcttcatcgtgaccatcaccgaggtgaacctggtgaacagcgacttcagcaccggccagcccagcgtgagaagacccggcatggagatcgccgagatcatgatcgaggagaacgacgaccccagaggcatcttcatgttccacgtgaccagaggcgccggcgaggtgatcaccgcctacgaggtgcccccccccctgaacgtgctgcaggtgcccgtggtgagactggccggcagcttcggcgccgtgaacgtgtactggaaggccagccccgacagcgccggcctggaggacttcaagcccagccacggcatcctggagttcgccgacaagcaggtgaccgccatgatcgagatcaccatcatcgacgacgccgagttcgagctgaccgagaccttcaacatcagcctgatcagcgtggccggcggcggcagactgggcgacgacgtggtggtgaccgtggtgatcccccagaacgacagccccttcggcgtgttcggcttcgaggagaagaccgtgatgatcgacgagagcctgagcagcgacgaccccgacagctacgtgaccctgaccgtggtgagaagccccggcggcaagggcaccgtgagactggagtggaccatcgacgagaaggccaagcacaacctgagccccctgaacggcaccctgcacttcgacgagaccgagagccagaagaccatcgtgctgcacaccctgcaggacaccgtgctggaggaggacagaagattcaccatccagctgatcagcatcgacgaggtggagatcagccccgtgaagggcagcgccagcatcatcatcagaggcgacaagagagccagcggcgaggtgggcatcgcccccagcagcagacacatcctgatcggcgagcccagcgccaagtacaacggcaccgccatcatcagcctggtgagaggccccggcatcctgggcgaggtgaccgtgttctggagaatcttcccccccagcgtgggcgagttcgccgagaccagcggcaagctgaccatgagagacgagcagagcgccgtgatcgtggtgatccaggccctgaacgacgacatccccgaggagaagagcttctacgagttccagctgaccgccgtgagcgagggcggcgtgctgagcgagagcagcagcaccgccaacatcaccgtggtggccagcgacagcccctacggcagattcgccttcagccacgagcagctgagagtgagcgaggcccagagagtgaacatcaccatcatcagaagcagcggcgacttcggccacgtgagactgtggtacaagaccatgagcggcaccgccgaggccggcctggacttcgtgcccgccgccggcgagctgctgttcgaggccggcgagatgagaaagagcctgcacgtggagatcctggacgacgactaccccgagggccccgaggagttcagcctgaccatcaccaaggtggagctgcagggcagaggctacgacttcaccatccaggagaacggcctgcagatcgaccagccccccgagatcggcaacatcagcatcgtgagaatcatcatcatgaagaacgacaacgccgagggcatcatcgagttcgaccccaagtacaccgccttcgaggtggaggaggacgtgggcctgatcatgatccccgtggtgagactgcacggcacctacggctacgtgaccgccgacttcatcagccagagcagcagcgccagccccggcggcgtggactacatcctgcacggcagcaccgtgaccttccagcacggccagaacctgagcttcatcaacatcagcatcatcgacgacaacgagagcgagttcgaggagcccatcgagatcctgctgaccggcgccaccggcggcgccgtgctgggcagacacctggtgagcagaatcatcatcgccaagagcgacagccccttcggcgtgatcagattcctgaaccagagcaagatcagcatcgccaaccccaacagcaccatgatcctgagcctggtgctggagagaaccggcggcctgctgggcgagatccaggtgaactgggagaccgtgggccccaacagccaggaggccctgctgccccagaacagagacatcgccgaccccgtgagcggcctgttctacttcggcgagggcgagggcggcgtgagaaccatcatcctgaccatctacccccacgaggagatcgaggtggaggagaccttcatcatcaagctgcacctggtgaagggcgaggccaagctggacagcagagccaaggacgtgaccctgaccatccaggagttcggcgaccccaacggcgtggtgcagttcgcccccgagaccctgagcaagaagacctacagcgagcccctggccctggagggccccctgctgatcaccttcttcgtgagaagagtgaagggcaccttcggcgagatcatggtgtactgggagctgagcagcgagttcgacatcaccgaggacttcctgagcaccagcggcttcttcaccatcgccgacggcgagagcgaggccagcttcgacgtgcacctgctgcccgacgaggtgcccgagatcgaggaggactacgtgatccagctggtgagcgtggagggcggcgccgagctggacctggagaagagcatcacctggttcagcgtgtacgccaacgacgacccccacggcgtgttcgccctgtacagcgacagacagagcatcctgatcggccagaacctgatcagaagcatccagatcaacatcaccagactggccggcaccttcggcgacgtggccgtgggcctgagaatcagcagcgaccacaaggagcagcccatcgtgaccgagaacgccgagagacagctggtggtgaaggacggcgccacctacaaggtggacgtggtgcccatcaagaaccaggtgttcctgagcctgggcagcaacttcaccctgcagctggtgaccgtgatgctggtgggcggcagattctacggcatgcccaccatcctgcaggaggccaagagcgccgtgctgcccgtgagcgagaaggccgccaacagccaggtgggcttcgagagcaccgccttccagctgatgaacatcaccgccggcaccagccacgtgatgatcagcagaagaggcacctacggcgccctgagcgtggcctggaccaccggctacgcccccggcctggagatccccgagttcatcgtggtgggcaacatgacccccaccctgggcagcctgagcttcagccacggcgagcagagaaagggcgtgttcctgtggaccttccccagccccggctggcccgaggccttcgtgctgcacctgagcggcgtgcagagcagcgcccccggcggcgcccagctgagaagcggcttcatcgtggccgagatcgagcccatgggcgtgttccagttcagcaccagcagcagaaacatcatcgtgagcgaggacacccagatgatcagactgcacgtgcagagactgttcggcttccacagcgacctgatcaaggtgagctaccagaccaccgccggcagcgccaagcccctggaggacttcgagcccgtgcagaacggcgagctgttcttccagaagttccagaccgaggtggacttcgagatcaccatcatcaacgaccagctgagcgagatcgaggagttcttctacatcaacctgaccagcgtggagatcagaggcctgcagaagttcgacgtgaactggagccccagactgaacctggacttcagcgtggccgtgatcaccatcctggacaacgacgacctggccggcatggacatcagcttccccgagaccaccgtggccgtggccgtggacaccaccctgatccccgtggagaccgagagcaccacctacctgagcaccagcaagaccaccaccatcctgcagcccaccaacgtggtggccatcgtgaccgaggccaccggcgtgagcgccatccccgagaagctggtgaccctgcacggcacccccgccgtgagcgagaagcccgacgtggccaccgtgaccgccaacgtgagcatccacggcaccttcagcctgggccccagcatcgtgtacatcgaggaggagatgaagaacggcaccttcaacaccgccgaggtgctgatcagaagaaccggcggcttcaccggcaacgtgagcatcaccgtgaagaccttcggcgagagatgcgcccagatggagcccaacgccctgcccttcagaggcatctacggcatcagcaacctgacctgggccgtggaggaggaggacttcgaggagcagaccctgaccctgatcttcctggacggcgagagagagagaaaggtgagcgtgcagatcctggacgacgacgagcccgagggccaggagttcttctacgtgttcctgaccaacccccagggcggcgcccagatcgtggaggagaaggacgacaccggcttcgccgccttcgccatggtgatcatcaccggcagcgacctgcacaacggcatcatcggcttcagcgaggagagccagagcggcctggagctgagagagggcgccgtgatgagaagactgcacctgatcgtgaccagacagcccaacagagccttcgaggacgtgaaggtgttctggagagtgaccctgaacaagaccgtggtggtgctgcagaaggacggcgtgaacctggtggaggagctgcagagcgtgagcggcaccaccacctgcaccatgggccagaccaagtgcttcatcagcatcgagctgaagcccgagaaggtgccccaggtggaggtgtacttcttcgtggagctgtacgaggccaccgccggcgccgccatcaacaacagcgccagattcgcccagatcaagatcctggagagcgacgagagccagagcctggtgtacttcagcgtgggcagcagactggccgtggcccacaagaaggccaccctgatcagcctgcaggtggccagagacagcggcaccggcctgatgatgagcgtgaacttcagcacccaggagctgagaagcgccgagaccatcggcagaaccatcatcagccccgccatcagcggcaaggacttcgtgatcaccgagggcaccctggtgttcgagcccggccagagaagcaccgtgctggacgtgatcctgacccccgagaccggcagcctgaacagcttccccaagagattccagatcgtgctgttcgaccccaagggcggcgccagaatcgacaaggtgtacggcaccgccaacatcaccctggtgagcgacgccgacagccaggccatctggggcctggccgaccagctgcaccagcccgtgaacgacgacatcctgaacagagtgctgcacaccatcagcatgaaggtggccaccgagaacaccgacgagcagctgagcgccatgatgcacctgatcgagaagatcaccaccgagggcaagatccaggccttcagcgtggccagcagaaccctgttctacgagatcctgtgcagcctgatcaaccccaagagaaaggacaccagaggcttcagccacttcgccgaggtgaccgagaacttcgccttcagcctgctgaccaacgtgacctgcggcagccccggcgagaagagcaagaccatcctggacagctgcccctacctgagcatcctggccctgcactggtacccccagcagatcaacggccacaagttcgagggcaaggagggcgactacatcagaatccccgagagactgctggacgtgcaggacgccgagatcatggccggcaagagcacctgcaagctggtgcagttcaccgagtacagcagccagcagtggttcatcagcggcaacaacctgcccaccctgaagaacaaggtgctgagcctgagcgtgaagggccagagcagccagctgctgaccaacgacaacgaggtgctgtacagaatctacgccgccgagcccagaatcatcccccagaccagcctgtgcctgctgtggaaccaggccgccgccagctggctgagcgacagccagttctgcaaggtggtggaggagaccgccgactacgtggagtgcgcctgcagccacatgagcgtgtacgccgtgtacgccagaaccgacaacctgagcagctacaacgaggccttcttcaccagcggcttcatctgcatcagcggcctgtgcctggccgtgctgagccacatcttctgcgccagatacagcatgttcgccgccaagctgctgacccacatgatggccgccagcctgggcacccagatcctgttcctggccagcgcctacgccagcccccagctggccgaggagagctgcagcgccatggccgccgtgacccactacctgtacctgtgccagttcagctggatgctgatccagagcgtgaacttctggtacgtgctggtgatgaacgacgagcacaccgagagaagatacctgctgttcttcctgctgagctggggcctgcccgccttcgtggtgatcctgctgatcgtgatcctgaagggcatctaccaccagagcatgagccagatctacggcctgatccacggcgacctgtgcttcatccccaacgtgtacgccgccctgttcaccgccgccctggtgcccctgacctgcctggtggtggtgttcgtggtgttcatccacgcctaccaggtgaagccccagtggaaggcctacgacgacgtgttcagaggcagaaccaacgccgccgagatccccctgatcctgtacctgttcgccctgatcagcgtgacctggctgtggggcggcctgcacatggcctacagacacttctggatgctggtgctgttcgtgatcttcaacagcctgcagggcctgtacgtgttcatggtgtacttcatcctgcacaaccagatgtgctgccccatgaaggccagctacaccgtggagatgaacggccaccccggccccagcaccgccttcttcacccccggcagcggcatgccccccgccggcggcgagatcagcaagagcacccagaacctgatcggcgccatggaggaggtgccccccgactgggagagagccagcttccagcagggcagccaggccagccccgacctgaagcccagcccccagaacggcgccaccttccccagcagcggcggctacggccagggcagcctgatcgccgacgaggagagccaggagttcgacgacctgatcttcgccctgaagaccggcgccggcctgagcgtgagcgacaacgagagcggccagggcagccaggagggcggcaccctgaccgacagccagatcgtggagctgagaagaatccccatcgccgacacccacctgtag

SEQ ID NO: 82514 - DNA, 6921 bp, Artificial Sequence
  Description of Artificial Sequence: Synthetic coding sequence
gtggacgtgttcatgttcctgggcatgcccagcgccagcctgctggtgaacctgctgagcgccctgctgatcctgttcgtgttcggcgagaccgagatcagattcaccggccagaccgagttcgtggtgaacgagaccagcaccaccgtgatcagactgatcatcgagagaatcggcgagcccgccaacgtgaccgccatcgtgagcctgtacggcgaggacgccggcgacttcttcgacacctacgccgccgccttcatccccgccggcgagaccaacagaaccgtgtacatcgccgtgtgcgacgacgacctgcccgagcccgacgagaccttcatcttccacctgaccctgcagaagcccagcgccaacgtgaagctgggctggcccagaaccgtgaccgtgaccatcctgagcaacgacaacgccttcggcatcatcagcttcaacatgctgcccagcatcgccgtgagcgagcccaagggcagaaacgagagcatgcccctgaccctgatcagagagaagggcacctacggcatggtgatggtgaccttcgaggtggagggcggccccaacccccccgacgaggacctgagccccgtgaagggcaacatcaccttcccccccggcagagccaccgtgatctacaacctgaccgtgctggacgacgaggtgcccgagaacgacgagatcttcctgatccagctgaagagcgtggagggcggcgccgagatcaacaccagcagaaacagcatcgagatcatcatcaagaagaacgacagccccgtgagattcctgcagagcatctacctggtgcccgaggaggaccacatcctgatcatccccgtggtgagaggcaaggacaacaacggcaacctgatcggcagcgacgagtacgaggtgagcatcagctacgccgtgaccaccggcaacagcaccgcccacgcccagcagaacctggacttcatcgacctgcagcccaacaccaccgtggtgttcccccccttcatccacgagagccacctgaagttccagatcgtggacgacaccatccccgagatcgccgagagcttccacatcatgctgctgaaggacaccctgcagggcgacgccgtgctgatcagccccagcgtggtgcaggtgaccatcaagcccaacgacaagccctacggcgtgctgagcttcaacagcgtgctgttcgagagaaccgtgatcatcgacgaggacagaatcagcagatacgaggagatcaccgtggtgagaaacggcggcacccacggcaacgtgagcgccaactgggtgctgaccagaaacagcaccgaccccagccccgtgaccgccgacatcagacccagcagcggcgtgctgcacttcgcccagggccagatgctggccaccatccccctgaccgtggtggacgacgacctgcccgaggaggccgaggcctacctgctgcagatcctgccccacaccatcagaggcggcgccgaggtgagcgagcccgccgagctgctgttctacatccaggacagcgacgacgtgtacggcctgatcaccttcttccccatggagaaccagaagatcgagagcagccccggcgagagatacctgagcctgagcttcaccagactgggcggcaccaagggcgacgtgagactgctgtacagcgtgctgtacatccccgccggcgccgtggaccccctgcaggccaaggagggcatcctgaacatcagcagaagaaacgacctgatcttccccgagcagaagacccaggtgaccaccaagctgcccatcagaaacgacgccttcctgcagaacggcgcccacttcctggtgcagctggagaccgtggagctgctgaacatcatccccctgatcccccccatcagccccagattcggcgagatctgcaacatcagcctgctggtgacccccgccatcgccaacggcgagatcggcttcctgagcaacctgcccatcatcctgcacgagcccgaggacttcgccgccgaggtggtgtacatccccctgcacagagacggcaccgacggccaggccaccgtgtactggagcctgaagcccagcggcttcaacagcaaggccgtgacccccgacgacatcggccccttcaacggcagcgtgctgttcctgagcggccagagcgacaccaccatcaacatcaccatcaagggcgacgacatccccgagatgaacgagaccgtgaccctgagcctggacagagtgaacgtggagaaccaggtgctgaagagcggctacaccagcagagacctgatcatcctggagaacgacgaccccggcggcgtgttcgagttcagccccgccagcagaggcccctacgtgatcaaggagggcgagagcgtggagctgcacatcatcagaagcagaggcagcctggtgaagcagttcctgcactacagagtggagcccagagacagcaacgagttctacggcaacaccggcgtgctggagttcaagcccggcgagagagagatcgtgatcaccctgctggccagactggacggcatccccgagctggacgagcactactgggtggtgctgagcagccacggcgagagagagagcaagctgggcagcgccaccatcgtgaacatcaccatcctgaagaacgacgacccccacggcatcatcgagttcgtgagcgacggcctgatcgtgatgatcaacgagagcaagggcgacgccatctacagcgccgtgtacgacgtggtgagaaacagaggcaacttcggcgacgtgagcgtgagctgggtggtgagccccgacttcacccaggacgtgttccccgtgcagggcaccgtggtgttcggcgaccaggagttcagcaagaacatcaccatctacagcctgcccgacgagatccccgaggagatggaggagttcaccgtgatcctgctgaacggcaccggcggcgccaaggtgggcaacagaaccaccgccaccctgagaatcagaagaaacgacgaccccatctacttcgccgagcccagagtggtgagagtgcaggagggcgagaccgccaacttcaccgtgctgagaaacggcagcgtggacgtgacctgcatggtgcagtacgccaccaaggacggcaaggccaccgccagagagagagacttcatccccgtggagaagggcgagaccctgatcttcgaggtgggcagcagacagcagagcatcagcatcttcgtgaacgaggacggcatccccgagaccgacgagcccttctacatcatcctgctgaacagcaccggcgacaccgtggtgtaccagtacggcgtggccaccgtgatcatcgaggccaacgacgaccccaacggcatcttcagcctggagcccatcgacaaggccgtggaggagggcaagaccaacgccttctggatcctgagacacagaggctacttcggcagcgtgagcgtgagctggcagctgttccagaacgacagcgccctgcagcccggccaggagttctacgagaccagcggcaccgtgaacttcatggacggcgaggaggccaagcccatcatcctgcacgccttccccgacaagatccccgagttcaacgagttctacttcctgaagctggtgaacatcagcggcggcagccccggccccggcggccagctggccgagaccaacctgcaggtgaccgtgatggtgcccttcaacgacgaccccttcggcgtgttcatcctggaccccgagtgcctggagagagaggtggccgaggacgtgctgagcgaggacgacatgagctacatcaccaacttcaccatcctgagacagcagggcgtgttcggcgacgtgcagctgggctgggagatcctgagcagcgagttccccgccggcctgccccccatgatcgacttcctgctggtgggcatcttccccaccaccgtgcacctgcagcagcacatgagaagacaccacagcggcaccgacgccctgtacttcaccggcctggagggcgccttcggcaccgtgaaccccaagtaccaccccagcagaaacaacaccatcgccaacttcaccttcagcgcctgggtgatgcccaacgccaacaccaacggcttcatcatcgccaaggacgacggcaacggcagcatctactacggcgtgaagatccagaccaacgagagccacgtgaccctgagcctgcactacaagaccctgggcagcaacgccacctacatcgccaagaccaccgtgatgaagtacctggaggagagcgtgtggctgcacctgctgatcatcctggaggacggcatcatcgagttctacctggacggcaacgccatgcccagaggcatcaagagcctgaagggcgaggccatcaccgacggccccggcatcctgagaatcggcgccggcatcaacggcaacgacagattcaccggcctgatgcaggacgtgagaagctacgagagaaagctgaccctggaggagatctacgagctgcacgccatgcccgccaagagcgacctgcaccccatcagcggctacctggagttcagacagggcgagaccaacaagagcttcatcatcagcgccagagacgacaacgacgaggagggcgaggagctgttcatcctgaagctggtgagcgtgtacggcggcgccagaatcagcgaggagaacaccaccgccagactgaccatccagaagagcgacaacgccaacggcctgttcggcttcaccggcgcctgcatccccgagatcgccgaggagggcagcaccatcagctgcgtggtggagagaaccagaggcgccctggactacgtgcacgtgttctacaccatcagccagatcgagaccgacggcatcaactacctggtggacgacttcgccaacgccagcggcaccatcaccttcctgccctggcagagaagcgaggtgctgaacatctacgtgctggacgacgacatccccgagctgaacgagtacttcagagtgaccctggtgagcgccatccccggcgacggcaagctgggcagcacccccaccagcggcgccagcatcgaccccgagaaggagaccaccgacatcaccatcaaggccagcgaccacccctacggcctgctgcagttcagcaccggcctgcccccccagcccaaggacgccatgaccctgcccgccagcagcgtgccccacatcaccgtggaggaggaggacggcgagatcagactgctggtgatcagagcccagggcctgctgggcagagtgaccgccgagttcagaaccgtgagcctgaccgccttcagccccgaggactaccagaacgtggccggcaccctggagttccagcccggcgagagatacaagtacatcttcatcaacatcaccgacaacagcatccccgagctggagaagagcttcaaggtggagctgctgaacctggagggcggcgtggccgagctgttcagagtggacggcagcggcagcggcgacggcgacatggagttcttcctgcccaccatccacaagagagccagcctgggcgtggccagccagatcctggtgaccatcgccgccagcgaccacgcccacggcgtgttcgagttcagccccgagagcctgttcgtgagcggcaccgagcccgaggacggctacagcaccgtgaccctgaacgtgatcagacaccacggcaccctgagccccgtgaccctgcactggaacatcgacagcgaccccgacggcgacctggccttcaccagcggcaacatcaccttcgagatcggccagaccagcgccaacatcaccgtggagatcctgcccgacgaggaccccgagctggacaaggccttcagcgtgagcgtgctgagcgtgagcagcggcagcctgggcgcccacatcaacgccaccctgaccgtgctggccagcgacgacccctacggcatcttcatcttcagcgagaagaacagacccgtgaaggtggaggaggccacccagaacatcaccctgagcatcatcagactgaagggcctgatgggcaaggtgctggtgagctacgccaccctggacgacatggagaagcccccctacttcccccccaacctggccagagccacccagggcagagactacatccccgccagcggcttcgccctgttcggcgccaaccagagcgaggccaccatcgccatcagcatcctggacgacgacgagcccgagagaagcgagagcgtgttcatcgagctgctgaacagcaccctggtggccaaggtgcagagcagaagcatccccaacagccccagactgggccccaaggtggagaccatcgcccagctgatcatcatcgccaacgacgacgccttcggcaccctgcagctgagcgcccccatcgtgagagtggccgagaaccacgtgggccccatcatcaacgtgaccagaaccggcggcgccttcgccgacgtgagcgtgaagttcaaggccgtgcccatcaccgccatcgccggcgaggactacagcatcgccagcagcgacgtggtgctgctggagggcgagaccagcaaggccgtgcccatctacgtgatcaacgacatctaccccgagctggaggagagcttcctggtgcagctgatgaacgagaccaccggcggcgccagactgggcgccctgaccgaggccgtgatcatcatcgaggccagcgacgacccctacggcctgttcggcttccagatcaccaagctgatcgtggaggagcccgagttcaacagcgtgaaggtgaacctgcccatcatcagaaacagcggcaccctgggcaacgtgaccgtgcagtgggtggccaccatcaacggccagctggccaccggcgacctgagagtggtgagcggcaacgtgaccttcgcccccggcatgagcagctaccccagcgccaccaactag

SEQ ID NO: 82515 - DNA, 18921 bp, Artificial Sequence
  Description of Artificial Sequence: Synthetic coding sequence
atgagcgtgttcctgggccccggcatgcccagcgccagcctgctggtgaacctgctgagcgccctgctgatcctgttcgtgttcggcgagaccgagatcagattcaccggccagaccgagttcgtggtgaacgagaccagcaccaccgtgatcagactgatcatcgagagaatcggcgagcccgccaacgtgaccgccatcgtgagcctgtacggcgaggacgccggcgacttcttcgacacctacgccgccgccttcatccccgccggcgagaccaacagaaccgtgtacatcgccgtgtgcgacgacgacctgcccgagcccgacgagaccttcatcttccacctgaccctgcagaagcccagcgccaacgtgaagctgggctggcccagaaccgtgaccgtgaccatcctgagcaacgacaacgccttcggcatcatcagcttcaacatgctgcccagcatcgccgtgagcgagcccaagggcagaaacgagagcatgcccctgaccctgatcagagagaagggcacctacggcatggtgatggtgaccttcgaggtggagggcggccccaacccccccgacgaggacctgagccccgtgaagggcaacatcaccttcccccccggcagagccaccgtgatctacaacctgaccgtgctggacgacgaggtgcccgagaacgacgagatcttcctgatccagctgaagagcgtggagggcggcgccgagatcaacaccagcagaaacagcatcgagatcatcatcaagaagaacgacagccccgtgagattcctgcagagcatctacctggtgcccgaggaggaccacatcctgatcatccccgtggtgagaggcaaggacaacaacggcaacctgatcggcagcgacgagtacgaggtgagcatcagctacgccgtgaccaccggcaacagcaccgcccacgcccagcagaacctggacttcatcgacctgcagcccaacaccaccgtggtgttcccccccttcatccacgagagccacctgaagttccagatcgtggacgacaccatccccgagatcgccgagagcttccacatcatgctgctgaaggacaccctgcagggcgacgccgtgctgatcagccccagcgtggtgcaggtgaccatcaagcccaacgacaagccctacggcgtgctgagcttcaacagcgtgctgttcgagagaaccgtgatcatcgacgaggacagaatcagcagatacgaggagatcaccgtggtgagaaacggcggcacccacggcaacgtgagcgccaactgggtgctgaccagaaacagcaccgaccccagccccgtgaccgccgacatcagacccagcagcggcgtgctgcacttcgcccagggccagatgctggccaccatccccctgaccgtggtggacgacgacctgcccgaggaggccgaggcctacctgctgcagatcctgccccacaccatcagaggcggcgccgaggtgagcgagcccgccgagctgctgttctacatccaggacagcgacgacgtgtacggcctgatcaccttcttccccatggagaaccagaagatcgagagcagccccggcgagagatacctgagcctgagcttcaccagactgggcggcaccaagggcgacgtgagactgctgtacagcgtgctgtacatccccgccggcgccgtggaccccctgcaggccaaggagggcatcctgaacatcagcagaagaaacgacctgatcttccccgagcagaagacccaggtgaccaccaagctgcccatcagaaacgacgccttcctgcagaacggcgcccacttcctggtgcagctggagaccgtggagctgctgaacatcatccccctgatcccccccatcagccccagattcggcgagatctgcaacatcagcctgctggtgacccccgccatcgccaacggcgagatcggcttcctgagcaacctgcccatcatcctgcacgagcccgaggacttcgccgccgaggtggtgtacatccccctgcacagagacggcaccgacggccaggccaccgtgtactggagcctgaagcccagcggcttcaacagcaaggccgtgacccccgacgacatcggccccttcaacggcagcgtgctgttcctgagcggccagagcgacaccaccatcaacatcaccatcaagggcgacgacatccccgagatgaacgagaccgtgaccctgagcctggacagagtgaacgtggagaaccaggtgctgaagagcggctacaccagcagagacctgatcatcctggagaacgacgaccccggcggcgtgttcgagttcagccccgccagcagaggcccctacgtgatcaaggagggcgagagcgtggagctgcacatcatcagaagcagaggcagcctggtgaagcagttcctgcactacagagtggagcccagagacagcaacgagttctacggcaacaccggcgtgctggagttcaagcccggcgagagagagatcgtgatcaccctgctggccagactggacggcatccccgagctggacgagcactactgggtggtgctgagcagccacggcgagagagagagcaagctgggcagcgccaccatcgtgaacatcaccatcctgaagaacgacgacccccacggcatcatcgagttcgtgagcgacggcctgatcgtgatgatcaacgagagcaagggcgacgccatctacagcgccgtgtacgacgtggtgagaaacagaggcaacttcggcgacgtgagcgtgagctgggtggtgagccccgacttcacccaggacgtgttccccgtgcagggcaccgtggtgttcggcgaccaggagttcagcaagaacatcaccatctacagcctgcccgacgagatccccgaggagatggaggagttcaccgtgatcctgctgaacggcaccggcggcgccaaggtgggcaacagaaccaccgccaccctgagaatcagaagaaacgacgaccccatctacttcgccgagcccagagtggtgagagtgcaggagggcgagaccgccaacttcaccgtgctgagaaacggcagcgtggacgtgacctgcatggtgcagtacgccaccaaggacggcaaggccaccgccagagagagagacttcatccccgtggagaagggcgagaccctgatcttcgaggtgggcagcagacagcagagcatcagcatcttcgtgaacgaggacggcatccccgagaccgacgagcccttctacatcatcctgctgaacagcaccggcgacaccgtggtgtaccagtacggcgtggccaccgtgatcatcgaggccaacgacgaccccaacggcatcttcagcctggagcccatcgacaaggccgtggaggagggcaagaccaacgccttctggatcctgagacacagaggctacttcggcagcgtgagcgtgagctggcagctgttccagaacgacagcgccctgcagcccggccaggagttctacgagaccagcggcaccgtgaacttcatggacggcgaggaggccaagcccatcatcctgcacgccttccccgacaagatccccgagttcaacgagttctacttcctgaagctggtgaacatcagcggcggcagccccggccccggcggccagctggccgagaccaacctgcaggtgaccgtgatggtgcccttcaacgacgaccccttcggcgtgttcatcctggaccccgagtgcctggagagagaggtggccgaggacgtgctgagcgaggacgacatgagctacatcaccaacttcaccatcctgagacagcagggcgtgttcggcgacgtgcagctgggctgggagatcctgagcagcgagttccccgccggcctgccccccatgatcgacttcctgctggtgggcatcttccccaccaccgtgcacctgcagcagcacatgagaagacaccacagcggcaccgacgccctgtacttcaccggcctggagggcgccttcggcaccgtgaaccccaagtaccaccccagcagaaacaacaccatcgccaacttcaccttcagcgcctgggtgatgcccaacgccaacaccaacggcttcatcatcgccaaggacgacggcaacggcagcatctactacggcgtgaagatccagaccaacgagagccacgtgaccctgagcctgcactacaagaccctgggcagcaacgccacctacatcgccaagaccaccgtgatgaagtacctggaggagagcgtgtggctgcacctgctgatcatcctggaggacggcatcatcgagttctacctggacggcaacgccatgcccagaggcatcaagagcctgaagggcgaggccatcaccgacggccccggcatcctgagaatcggcgccggcatcaacggcaacgacagattcaccggcctgatgcaggacgtgagaagctacgagagaaagctgaccctggaggagatctacgagctgcacgccatgcccgccaagagcgacctgcaccccatcagcggctacctggagttcagacagggcgagaccaacaagagcttcatcatcagcgccagagacgacaacgacgaggagggcgaggagctgttcatcctgaagctggtgagcgtgtacggcggcgccagaatcagcgaggagaacaccaccgccagactgaccatccagaagagcgacaacgccaacggcctgttcggcttcaccggcgcctgcatccccgagatcgccgaggagggcagcaccatcagctgcgtggtggagagaaccagaggcgccctggactacgtgcacgtgttctacaccatcagccagatcgagaccgacggcatcaactacctggtggacgacttcgccaacgccagcggcaccatcaccttcctgccctggcagagaagcgaggtgctgaacatctacgtgctggacgacgacatccccgagctgaacgagtacttcagagtgaccctggtgagcgccatccccggcgacggcaagctgggcagcacccccaccagcggcgccagcatcgaccccgagaaggagaccaccgacatcaccatcaaggccagcgaccacccctacggcctgctgcagttcagcaccggcctgcccccccagcccaaggacgccatgaccctgcccgccagcagcgtgccccacatcaccgtggaggaggaggacggcgagatcagactgctggtgatcagagcccagggcctgctgggcagagtgaccgccgagttcagaaccgtgagcctgaccgccttcagccccgaggactaccagaacgtggccggcaccctggagttccagcccggcgagagatacaagtacatcttcatcaacatcaccgacaacagcatccccgagctggagaagagcttcaaggtggagctgctgaacctggagggcggcgtggccgagctgttcagagtggacggcagcggcagcggcgacggcgacatggagttcttcctgcccaccatccacaagagagccagcctgggcgtggccagccagatcctggtgaccatcgccgccagcgaccacgcccacggcgtgttcgagttcagccccgagagcctgttcgtgagcggcaccgagcccgaggacggctacagcaccgtgaccctgaacgtgatcagacaccacggcaccctgagccccgtgaccctgcactggaacatcgacagcgaccccgacggcgacctggccttcaccagcggcaacatcaccttcgagatcggccagaccagcgccaacatcaccgtggagatcctgcccgacgaggaccccgagctggacaaggccttcagcgtgagcgtgctgagcgtgagcagcggcagcctgggcgcccacatcaacgccaccctgaccgtgctggccagcgacgacccctacggcatcttcatcttcagcgagaagaacagacccgtgaaggtggaggaggccacccagaacatcaccctgagcatcatcagactgaagggcctgatgggcaaggtgctggtgagctacgccaccctggacgacatggagaagcccccctacttcccccccaacctggccagagccacccagggcagagactacatccccgccagcggcttcgccctgttcggcgccaaccagagcgaggccaccatcgccatcagcatcctggacgacgacgagcccgagagaagcgagagcgtgttcatcgagctgctgaacagcaccctggtggccaaggtgcagagcagaagcatccccaacagccccagactgggccccaaggtggagaccatcgcccagctgatcatcatcgccaacgacgacgccttcggcaccctgcagctgagcgcccccatcgtgagagtggccgagaaccacgtgggccccatcatcaacgtgaccagaaccggcggcgccttcgccgacgtgagcgtgaagttcaaggccgtgcccatcaccgccatcgccggcgaggactacagcatcgccagcagcgacgtggtgctgctggagggcgagaccagcaaggccgtgcccatctacgtgatcaacgacatctaccccgagctggaggagagcttcctggtgcagctgatgaacgagaccaccggcggcgccagactgggcgccctgaccgaggccgtgatcatcatcgaggccagcgacgacccctacggcctgttcggcttccagatcaccaagctgatcgtggaggagcccgagttcaacagcgtgaaggtgaacctgcccatcatcagaaacagcggcaccctgggcaacgtgaccgtgcagtgggtggccaccatcaacggccagctggccaccggcgacctgagagtggtgagcggcaacgtgaccttcgcccccggcgagaccatccagaccctgctgctggaggtgctggccgacgacgtgcccgagatcgaggaggtgatccaggtgcagctgaccgacgccagcggcggcggcaccatcggcctggacagaatcgccaacatcatcatccccgccaacgacgacccctacggcaccgtggccttcgcccagatggtgtacagagtgcaggagcccctggagagaagcagctgcgccaacatcaccgtgagaagaagcggcggccacttcggcagactgctgctgttctacagcaccagcgacatcgacgtggtggccctggccatggaggagggccaggacctgctgagctactacgagagccccatccagggcgtgcccgaccccctgtggagaacctggatgaacgtgagcgccgtgggcgagcccctgtacacctgcgccaccctgtgcctgaaggagcaggcctgcagcgccttcagcttcttcagcgccagcgagggcccccagtgcttctggatgaccagctggatcagccccgccgtgaacaacagcgacttctggacctacagaaagaacatgaccagagtggccagcctgttcagcggccaggccgtggccggcagcgactacgagcccgtgaccagacagtgggccatcatgcaggagggcgacgagttcgccaacctgaccgtgagcatcctgcccgacgacttccccgagatggacgagagcttcctgatcagcctgctggaggtgcacctgatgaacatcagcgccagcctgaagaaccagcccaccatcggccagcccaacatcagcaccgtggtgatcgccctgaacggcgacgccttcggcgtgttcgtgatctacaacatcagccccaacaccagcgaggacggcctgttcgtggaggtgcaggagcagccccagaccctggtggagctgatgatccacagaaccggcggcagcctgggccaggtggccgtggagtggagagtggtgggcggcaccgccaccgagggcctggacttcatcggcgccggcgagatcctgaccttcgccgagggcgagaccaagaagaccgtgatcctgaccatcctggacgacagcgagcccgaggacgacgagagcatcatcgtgagcctggtgtacaccgagggcggcagcagaatcctgcccagcagcgacaccgtgagagtgaacatcctggccaacgacaacgtggccggcatcgtgagcttccagaccgccagcagaagcgtgatcggccacgagggcgagatcctgcagttccacgtgatcagaaccttccccggcagaggcaacgtgaccgtgaactggaagatcatcggccagaacctggagctgaacttcgccaacttcagcggccagctgttcttccccgagggcagcctgaacaccaccctgttcgtgcacctgctggacgacaacatccccgaggagaaggaggtgtaccaggtgatcctgtacgacgtgagaacccagggcgtgccccccgccggcatcgccctgctggacgcccagggctacgccgccgtgctgaccgtggaggccagcgacgagccccacggcgtgctgaacttcgccctgagcagcagattcgtgctgctgcaggaggccaacatcaccatccagctgttcatcaacagagagttcggcagcctgggcgccatcaacgtgacctacaccaccgtgcccggcatgctgagcctgaagaaccagaccgtgggcaacctggccgagcccgaggtggacttcgtgcccatcatcggcttcctgatcctggaggagggcgagaccgccgccgccatcaacatcaccatcctggaggacgacgtgcccgagctggaggagtacttcctggtgaacctgacctacgtgggcctgaccatggccgccagcaccagcttcccccccagactggacagcgagggcctgaccgcccaggtgatcatcgacgccaacgacggcgccagaggcgtgatcgagtggcagcagagcagattcgaggtgaacgagacccacggcagcctgaccctggtggcccagagaagcagagagcccctgggccacgtgagcctgttcgtgtacgcccagaacctggaggcccaggtgggcctggactacatcttcacccccatgatcctgcacttcgccgacggcgagagatacaagaacgtgaacatcatgatcctggacgacgacatccccgagggcgacgagaagttccagctgatcctgaccaaccccagccccggcctggagctgggcaagaacaccatcgccctgatcatcgtgctggccaacgacgacggccccggcgtgctgagcttcaacaacagcgagcacttcttcctgagagagcccaccgccctgtacgtgcaggagagcgtggccgtgctgtacatcgtgagagagcccgcccagggcctgttcggcaccgtgaccgtgcagttcatcgtgaccgaggtgaacagcagcaacgagagcaaggacctgacccccagcaagggctacatcgtgctggaggagggcgtgagattcaaggccctgcagatcagcgccatcctggacaccgagcccgagatggacgagtacttcgtgtgcaccctgttcaaccccaccggcggcgccagactgggcgtgcacgtgcagaccctgatcaccgtgctgcagaaccaggcccccctgggcctgttcagcatcagcgccgtggagaacagagccaccagcatcgacatcgaggaggccaacagaaccgtgtacctgaacgtgagcagaaccaacggcatcgacctggccgtgagcgtgcagtgggagaccgtgagcgagaccgccttcggcatgagaggcatggacgtggtgttcagcgtgttccagagcttcctggacgagagcgccagcggctggtgcttcttcaccctggagaacctgatctacggcatcatgctgagaaagagcagcgtgaccgtgtacagatggcagggcatcttcatccccgtggaggacctgaacatcgagaaccccaagacctgcgaggccttcaacatcggcttcagcccctacttcgtgatcacccacgaggagagaaacgaggagaagcccagcctgaacagcgtgttcaccttcaccagcggcttcaagctgttcctggtgcagaccatcatcatcctggagagcagccaggtgagatacttcaccagcgacagccaggactacctgatcatcgccagccagagagacgacagcgagctgacccaggtgttcagatggaacggcggcagcttcgtgctgcaccagaagctgcccgtgagaggcgtgctgaccgtggccctgttcaacaagggcggcagcgtgttcctggccatcagccaggccaacgccagactgaacagcctgctgttcagatggagcggcagcggcttcatcaacttccaggaggtgcccgtgagcggcaccaccgaggtggaggccctgagcagcgccaacgacatctacctgatcttcgccgagaacgtgttcctgggcgaccagaacagcatcgacatcttcatctgggagatgggccagagcagcttcagatacttccagagcgtggacttcgccgccgtgaacagaatccacagcttcacccccgccagcggcatcgcccacatcctgctgatcggccaggacatgagcgccctgtactgctggaacagcgagagaaaccagttcagcttcgtgctggaggtgcccagcgcctacgacgtggccagcgtgaccgtgaagagcctgaacagcagcaagaacctgatcgccctggtgggcgcccacagccacatctacgagctggcctacatcagcagccacagcgacttcatccccagcagcggcgagctgatcttcgagcccggcgagagagaggccaccatcgccgtgaacatcctggacgacaccgtgcccgagaaggaggagagcttcaaggtgcagctgaagaaccccaagggcggcgccgagatcggcatcaacgacagcgtgaccatcaccatcctgagcaacgacgacgcctacggcatcgtggccttcgcccagaacagcctgtacaagcaggtggaggagatggagcaggacagcctggtgaccctgaacgtggagagactgaagggcacctacggcagaatcaccatcgcctgggaggccgacggcagcatcagcgacatcttccccaccagcggcgtgatcctgttcaccgagggccaggtgctgagcaccatcaccctgaccatcctggccgacaacatccccgagctgagcgaggtggtgatcgtgaccctgaccagaatcaccaccgagggcgtggaggacagctacaagggcgccaccatcgaccaggacagaagcaagagcgtgatcaccaccctgcccaacgacagccccttcggcctggtgggctggagagccgccagcgtgttcatcagagtggccgagcccaaggagaacaccaccaccctgcagctgcagatcgccagagacaagggcctgctgggcgacatcgccatccacctgagagcccagcccaacttcctgctgcacgtggacaaccaggccaccgagaacgaggactacgtgctgcaggagaccatcatcatcatgaaggagaacatcaaggaggcccacgccgaggtgagcatcctgcccgacgacctgcccgagctggaggagggcttcatcgtgaccatcaccgaggtgaacctggtgaacagcgacttcagcaccggccagcccagcgtgagaagacccggcatggagatcgccgagatcatgatcgaggagaacgacgaccccagaggcatcttcatgttccacgtgaccagaggcgccggcgaggtgatcaccgcctacgaggtgcccccccccctgaacgtgctgcaggtgcccgtggtgagactggccggcagcttcggcgccgtgaacgtgtactggaaggccagccccgacagcgccggcctggaggacttcaagcccagccacggcatcctggagttcgccgacaagcaggtgaccgccatgatcgagatcaccatcatcgacgacgccgagttcgagctgaccgagaccttcaacatcagcctgatcagcgtggccggcggcggcagactgggcgacgacgtggtggtgaccgtggtgatcccccagaacgacagccccttcggcgtgttcggcttcgaggagaagaccgtgatgatcgacgagagcctgagcagcgacgaccccgacagctacgtgaccctgaccgtggtgagaagccccggcggcaagggcaccgtgagactggagtggaccatcgacgagaaggccaagcacaacctgagccccctgaacggcaccctgcacttcgacgagaccgagagccagaagaccatcgtgctgcacaccctgcaggacaccgtgctggaggaggacagaagattcaccatccagctgatcagcatcgacgaggtggagatcagccccgtgaagggcagcgccagcatcatcatcagaggcgacaagagagccagcggcgaggtgggcatcgcccccagcagcagacacatcctgatcggcgagcccagcgccaagtacaacggcaccgccatcatcagcctggtgagaggccccggcatcctgggcgaggtgaccgtgttctggagaatcttcccccccagcgtgggcgagttcgccgagaccagcggcaagctgaccatgagagacgagcagagcgccgtgatcgtggtgatccaggccctgaacgacgacatccccgaggagaagagcttctacgagttccagctgaccgccgtgagcgagggcggcgtgctgagcgagagcagcagcaccgccaacatcaccgtggtggccagcgacagcccctacggcagattcgccttcagccacgagcagctgagagtgagcgaggcccagagagtgaacatcaccatcatcagaagcagcggcgacttcggccacgtgagactgtggtacaagaccatgagcggcaccgccgaggccggcctggacttcgtgcccgccgccggcgagctgctgttcgaggccggcgagatgagaaagagcctgcacgtggagatcctggacgacgactaccccgagggccccgaggagttcagcctgaccatcaccaaggtggagctgcagggcagaggctacgacttcaccatccaggagaacggcctgcagatcgaccagccccccgagatcggcaacatcagcatcgtgagaatcatcatcatgaagaacgacaacgccgagggcatcatcgagttcgaccccaagtacaccgccttcgaggtggaggaggacgtgggcctgatcatgatccccgtggtgagactgcacggcacctacggctacgtgaccgccgacttcatcagccagagcagcagcgccagccccggcggcgtggactacatcctgcacggcagcaccgtgaccttccagcacggccagaacctgagcttcatcaacatcagcatcatcgacgacaacgagagcgagttcgaggagcccatcgagatcctgctgaccggcgccaccggcggcgccgtgctgggcagacacctggtgagcagaatcatcatcgccaagagcgacagccccttcggcgtgatcagattcctgaaccagagcaagatcagcatcgccaaccccaacagcaccatgatcctgagcctggtgctggagagaaccggcggcctgctgggcgagatccaggtgaactgggagaccgtgggccccaacagccaggaggccctgctgccccagaacagagacatcgccgaccccgtgagcggcctgttctacttcggcgagggcgagggcggcgtgagaaccatcatcctgaccatctacccccacgaggagatcgaggtggaggagaccttcatcatcaagctgcacctggtgaagggcgaggccaagctggacagcagagccaaggacgtgaccctgaccatccaggagttcggcgaccccaacggcgtggtgcagttcgcccccgagaccctgagcaagaagacctacagcgagcccctggccctggagggccccctgctgatcaccttcttcgtgagaagagtgaagggcaccttcggcgagatcatggtgtactgggagctgagcagcgagttcgacatcaccgaggacttcctgagcaccagcggcttcttcaccatcgccgacggcgagagcgaggccagcttcgacgtgcacctgctgcccgacgaggtgcccgagatcgaggaggactacgtgatccagctggtgagcgtggagggcggcgccgagctggacctggagaagagcatcacctggttcagcgtgtacgccaacgacgacccccacggcgtgttcgccctgtacagcgacagacagagcatcctgatcggccagaacctgatcagaagcatccagatcaacatcaccagactggccggcaccttcggcgacgtggccgtgggcctgagaatcagcagcgaccacaaggagcagcccatcgtgaccgagaacgccgagagacagctggtggtgaaggacggcgccacctacaaggtggacgtggtgcccatcaagaaccaggtgttcctgagcctgggcagcaacttcaccctgcagctggtgaccgtgatgctggtgggcggcagattctacggcatgcccaccatcctgcaggaggccaagagcgccgtgctgcccgtgagcgagaaggccgccaacagccaggtgggcttcgagagcaccgccttccagctgatgaacatcaccgccggcaccagccacgtgatgatcagcagaagaggcacctacggcgccctgagcgtggcctggaccaccggctacgcccccggcctggagatccccgagttcatcgtggtgggcaacatgacccccaccctgggcagcctgagcttcagccacggcgagcagagaaagggcgtgttcctgtggaccttccccagccccggctggcccgaggccttcgtgctgcacctgagcggcgtgcagagcagcgcccccggcggcgcccagctgagaagcggcttcatcgtggccgagatcgagcccatgggcgtgttccagttcagcaccagcagcagaaacatcatcgtgagcgaggacacccagatgatcagactgcacgtgcagagactgttcggcttccacagcgacctgatcaaggtgagctaccagaccaccgccggcagcgccaagcccctggaggacttcgagcccgtgcagaacggcgagctgttcttccagaagttccagaccgaggtggacttcgagatcaccatcatcaacgaccagctgagcgagatcgaggagttcttctacatcaacctgaccagcgtggagatcagaggcctgcagaagttcgacgtgaactggagccccagactgaacctggacttcagcgtggccgtgatcaccatcctggacaacgacgacctggccggcatggacatcagcttccccgagaccaccgtggccgtggccgtggacaccaccctgatccccgtggagaccgagagcaccacctacctgagcaccagcaagaccaccaccatcctgcagcccaccaacgtggtggccatcgtgaccgaggccaccggcgtgagcgccatccccgagaagctggtgaccctgcacggcacccccgccgtgagcgagaagcccgacgtggccaccgtgaccgccaacgtgagcatccacggcaccttcagcctgggccccagcatcgtgtacatcgaggaggagatgaagaacggcaccttcaacaccgccgaggtgctgatcagaagaaccggcggcttcaccggcaacgtgagcatcaccgtgaagaccttcggcgagagatgcgcccagatggagcccaacgccctgcccttcagaggcatctacggcatcagcaacctgacctgggccgtggaggaggaggacttcgaggagcagaccctgaccctgatcttcctggacggcgagagagagagaaaggtgagcgtgcagatcctggacgacgacgagcccgagggccaggagttcttctacgtgttcctgaccaacccccagggcggcgcccagatcgtggaggagaaggacgacaccggcttcgccgccttcgccatggtgatcatcaccggcagcgacctgcacaacggcatcatcggcttcagcgaggagagccagagcggcctggagctgagagagggcgccgtgatgagaagactgcacctgatcgtgaccagacagcccaacagagccttcgaggacgtgaaggtgttctggagagtgaccctgaacaagaccgtggtggtgctgcagaaggacggcgtgaacctggtggaggagctgcagagcgtgagcggcaccaccacctgcaccatgggccagaccaagtgcttcatcagcatcgagctgaagcccgagaaggtgccccaggtggaggtgtacttcttcgtggagctgtacgaggccaccgccggcgccgccatcaacaacagcgccagattcgcccagatcaagatcctggagagcgacgagagccagagcctggtgtacttcagcgtgggcagcagactggccgtggcccacaagaaggccaccctgatcagcctgcaggtggccagagacagcggcaccggcctgatgatgagcgtgaacttcagcacccaggagctgagaagcgccgagaccatcggcagaaccatcatcagccccgccatcagcggcaaggacttcgtgatcaccgagggcaccctggtgttcgagcccggccagagaagcaccgtgctggacgtgatcctgacccccgagaccggcagcctgaacagcttccccaagagattccagatcgtgctgttcgaccccaagggcggcgccagaatcgacaaggtgtacggcaccgccaacatcaccctggtgagcgacgccgacagccaggccatctggggcctggccgaccagctgcaccagcccgtgaacgacgacatcctgaacagagtgctgcacaccatcagcatgaaggtggccaccgagaacaccgacgagcagctgagcgccatgatgcacctgatcgagaagatcaccaccgagggcaagatccaggccttcagcgtggccagcagaaccctgttctacgagatcctgtgcagcctgatcaaccccaagagaaaggacaccagaggcttcagccacttcgccgaggtgaccgagaacttcgccttcagcctgctgaccaacgtgacctgcggcagccccggcgagaagagcaagaccatcctggacagctgcccctacctgagcatcctggccctgcactggtacccccagcagatcaacggccacaagttcgagggcaaggagggcgactacatcagaatccccgagagactgctggacgtgcaggacgccgagatcatggccggcaagagcacctgcaagctggtgcagttcaccgagtacagcagccagcagtggttcatcagcggcaacaacctgcccaccctgaagaacaaggtgctgagcctgagcgtgaagggccagagcagccagctgctgaccaacgacaacgaggtgctgtacagaatctacgccgccgagcccagaatcatcccccagaccagcctgtgcctgctgtggaaccaggccgccgccagctggctgagcgacagccagttctgcaaggtggtggaggagaccgccgactacgtggagtgcgcctgcagccacatgagcgtgtacgccgtgtacgccagaaccgacaacctgagcagctacaacgaggccttcttcaccagcggcttcatctgcatcagcggcctgtgcctggccgtgctgagccacatcttctgcgccagatacagcatgttcgccgccaagctgctgacccacatgatggccgccagcctgggcacccagatcctgttcctggccagcgcctacgccagcccccagctggccgaggagagctgcagcgccatggccgccgtgacccactacctgtacctgtgccagttcagctggatgctgatccagagcgtgaacttctggtacgtgctggtgatgaacgacgagcacaccgagagaagatacctgctgttcttcctgctgagctggggcctgcccgccttcgtggtgatcctgctgatcgtgatcctgaagggcatctaccaccagagcatgagccagatctacggcctgatccacggcgacctgtgcttcatccccaacgtgtacgccgccctgttcaccgccgccctggtgcccctgacctgcctggtggtggtgttcgtggtgttcatccacgcctaccaggtgaagccccagtggaaggcctacgacgacgtgttcagaggcagaaccaacgccgccgagatccccctgatcctgtacctgttcgccctgatcagcgtgacctggctgtggggcggcctgcacatggcctacagacacttctggatgctggtgctgttcgtgatcttcaacagcctgcagggcctgtacgtgttcatggtgtacttcatcctgcacaaccagatgtgctgccccatgaaggccagctacaccgtggagatgaacggccaccccggccccagcaccgccttcttcacccccggcagcggcatgccccccgccggcggcgagatcagcaagagcacccagaacctgatcggcgccatggaggaggtgccccccgactgggagagagccagcttccagcagggcagccaggccagccccgacctgaagcccagcccccagaacggcgccaccttccccagcagcggcggctacggccagggcagcctgatcgccgacgaggagagccaggagttcgacgacctgatcttcgccctgaagaccggcgccggcctgagcgtgagcgacaacgagagcggccagggcagccaggagggcggcaccctgaccgacagccagatcgtggagctgagaagaatccccatcgccgacacccacctgtag

SEQ ID NO: 82516 - DNA, 4188 bp, Artificial Sequence
  Description of Artificial Sequence: Synthetic coding sequence
atgaccggcgccgagatcgagagcggcgcccaggtgaagcccgagaagaagcccggcgaggaggtggtgggcggcgccgagatcgagaacgacgtgcccctggtggtgagacccaaggtgagaacccaggcccagatcatgcccggcgccagacccaagaacaagagcaaggtgatgcccggcgccagcaccaaggtggagaccagcgccgtgggcggcgccagacccaagagcaaggccaaggccatccccgtgagcagattcaaggaggaggcccagatgtgggcccagcccagattcggcgccgagagactgagcaagaccgagagaaacagccagaccaacatcatcgccagccccctggtgagcaccgacagcgtgctggtggccaagaccaagtacctgagcgaggacagagagctggtgaacaccgacaccgagagcttccccagaagaaaggcccactaccaggccggcttccagcccagcttcagaagcaaggaggagaccaacatgggcagctggtgctgccccagacccaccagcaagcaggaggccagccccaacagcgacttcaagtgggtggacaagagcgtgagcagcctgttctggagcggcgacgaggtgaccgccaagttccaccccggcaacagagtgaaggacagcaacagaagcatgcacatggccaaccaggaggccaacaccatgagcagaagccagaccaaccaggagctgtacatcgccagcagcagcggcagcgaggacgagagcgtgaagaccccctggttctgggccagagacaagaccaacacctggagcggccccagagaggaccccaacagcagaagcagattcagaagcaagaaggaggtgtacgtggagagcagcagcggcagcgagcacgaggaccacctggagagctggttcggcgccggcaaggaggccaagttcagaagcaagatgagagccggcaaggaggccaacaacagagccagacacagagccaagagagaggcctgcatcgacttcatgcccggcagcatcgacgtgatcaagaaggagagctgcttctggcccgaggagaacgccaacaccttcagcagacccatgatcaagaaggaggccagagccagagccatgaccaaggaggaggccaagaccaaggccagagccagagccaagcaggaggccagaagcgaggaggaggccctgatcggcacctggttctgggccaccgacgagagcagcatggccgacgaggccagcatcgagagcagcctgcaggtggaggacgagagcatcatcggcagctggttctggaccgaggaggaggccagcatgggcaccggcgccagcagcaagagcagacccagaaccgacggcgagagaatcggcgacagcctgttcggcgccagagagaagaccagcatgaagaccggcgccgaggccaccagcgagagcatcctggccgccgacgacgagcaggtgatcatcggcagctggttctgggccggcgaggaggtgaaccaggaggccgaggaggagaccatcttcggcagctggttctgggtgatcgacgccgccagcgtggagagcggcgtgggcgtgagctgcgagagcagaaccagaagcgaggaggaggaggtgatcggcccctggttctggagcggcgagcaggtggacatcgaggccggcatcggcgaggaggccagacccggcgccgaggaggagaccatcttcggcagctggttctgggccgagaaccagacctacatggactgcagagccgagaccagctgcgacaccatgcagggcgccgaggaggaggagcccatcatcggcagctggttctggaccagagtggaggcctgcgtggagggcgacgtgaacagcaagagcagcctggaggacaaggaggaggccatgatcccctgcttcggcgccaaggaggaggtgagcatgaagcacggcaccggcgtgagatgcagattcatggccggcgccgaggagaccaacaacaagagctgcttctgggccgagaaggagccctgcatgtaccccgccggcggcggcagctggaagagcagacccgaggaggaggaggacatcgtgaacagctggttctggagcagaaagtacaccaagcccgaggccatcatcggcagctggctgtgggccaccgaggagagcaacatcgacggcaccggcgagaaggccaagctgctgaccgaggaggagaccatcatcaacagctggttctggaaggaggacgaggccatcagcgaggccaccgacagagaggagagcagacccgaggccgaggagggcgacatcatcggcagctggttctgggccggcgaggaggacagactggagcccgccgccgagaccagagaggaggacagactggccgccgagaaggagggcatcgtgggcagctggttcggcgccagagaggagaccatcagaagagaggccggcagctgcagcaagagcagccccaaggccgaggaggaggaggtgatcatcggcagctggttctgggaggaggaggccagccccgaggccgtggccggcgtgggcttcgagagcaagcccggcaccgaggaggaggagatcaccgtgggcagctggttctggcccgaggaggaggccagcatccaggccggcagccaggccgtggaggagatggagagcgagaccgaggaggagaccatcttcggcagctggttctgggacggcaaggaggtgagcgaggaggccggcccctgctgcgtgagcaagcccgaggacgacgaggagatgatcgtggagagctggttctggagcagagacaaggccatcaaggagaccggcaccgtggccacctgcgagagcaagcccgagaacgaggagggcgccatcgtgggcagctggttcgaggccgaggacgaggtggacaacagaaccgacaacggcagcaactgcggcagcagaaccctggccgacgaggacgaggccatcgtgggcagctggttctgggccggcgacgaggcccacttcgagagcaaccccagccccgtgttcagagccatctgcagaagcacctgcagcgtggagcaggagcccgaccccagcagaagaccccagagctgggaggaggtgaccgtgcagttcaagcccggcccctggggcagagtgggcttccccagcatcagccccttcagattccccaaggaggccgccagcctgttctgcgagatgttcggcggcaagcccagaaacatggtgctgagccccgagggcgaggaccaggagagcctgctgcagcccgaccagcccagccccgagttccccttccagtacgaccccagctacagaagcgtgcaggagatcagagagcacctgagagccaaggagagcaccgagcccgagagcagcagctgcaactgcatccagtgcgagctgaagatcggcagcgaggagttcgaggagctgctgctgctgatggagaagatcagagaccccttcatccacgagatcagcaagatcgccatgggcatgagaagcgccagccagttcaccagagacttcatcagagacagcggcgtggtgagcctgatcgagaccctgctgaactaccccagcagcagagtgagaaccagcttcctggagaacatgatcagaatggcccccccctaccccaacctgaacatcatccagacctacatctgcaaggtgtgcgaggagaccctggcctacagcgtggacagccccgagcagctgagcggcatcagaatgatcagacacctgaccaccaccaccgactaccacaccctggtggccaactacatgagcggcttcctgagcctgctggccaccggcaacgccaagaccagattccacgtgctgaagatgctgctgaacctgagcgagaacctgttcatgaccaaggagctgctgagcgccgaggccgtgagcgagttcatcggcctgttcaacagagaggagaccaacgacaacatccagatcgtgctggccatcttcgagaacatcggcaacaacatcaagaaggagaccgtgttcagcgacgacgacttcaacatcgagcccctgatcagcgccttccacaaggtggagaagttcgccaaggagctgcagggcaagaccgacaaccagaacgaccccgagggcgaccaggagaactag

SEQ ID NO: 82517 - DNA, 4188 bp, Artificial Sequence; identical to SEQ ID NO: 82516
  Description of Artificial Sequence: Synthetic coding sequence

SEQ ID NO: 82518 - DNA, 4188 bp, Artificial Sequence; identical to SEQ ID NO: 82516
  Description of Artificial Sequence: Synthetic coding sequence

SEQ ID NO: 82519 - DNA, 4188 bp, Artificial Sequence; identical to SEQ ID NO: 82516
  Description of Artificial Sequence: Synthetic coding sequence

SEQ ID NO: 82520 - DNA, 1692 bp, Artificial Sequence
  Description of Artificial Sequence: Synthetic coding sequence
atggacttcggcagcctggagaccgtggtggccaacagcgccttcatcgccgccagaggcagcttcgacggcagcagcagccagcccagcagagacaagaagtacctggccaagctgaagctgccccccctgagcaagtgcgagagcctgagagacagcctgagcctggagttcgagagcgtgtgcctggagcagcccatcggcaagaagctgttccagcagttcctgcagagcgccgagaagcacctgcccgccctggagctgtggaaggacatcgaggactacgacaccgccgacaacgacctgcagccccagaaggcccagaccatcctggcccagtacctggacccccaggccaagctgttctgcagcttcctggacgagggcatcgtggccaagttcaaggagggccccgtggagatccaggacggcctgttccagcccctgctgcaggccaccctggcccacctgggccaggcccccttccaggagtacctgggcagcctgtacttcctgagattcctgcagtggaagtggctggaggcccagcccatgggcgaggactggttcctggacttcagagtgctgggcaagggcggcttcggcgaggtgagcgcctgccagatgaaggccaccggcaagctgtacgcctgcaagaagctgaacaagaagagactgaagaagagaaagggctaccagggcgccatggtggagaagaagatcctgatgaaggtgcacagcagattcatcgtgagcctggcctacgccttcgagaccaaggccgacctgtgcctggtgatgaccatcatgaacggcggcgacatcagataccacatctacaacgtgaacgaggagaaccccggcttccccgagcccagagccctgttctacaccgcccagatcatctgcggcctggagcacctgcaccagagaagaatcgtgtacagagacctgaagcccgagaacgtgctgctggacaacgacggcaacgtgagaatcagcgacctgggcctggccgtggagctgctggacggccagagcaagaccaagggctacgccggcacccccggcttcatggcccccgagctgctgcagggcgaggagtacgacttcagcgtggactacttcgccctgggcgtgaccctgtacgagatgatcgccgccagaggccccttcagagccagaggcgagaaggtggagaacaaggagctgaagcacagaatcatcagcgagcccgtgaagtaccccgacaagttcagccaggccagcaaggacttctgcgaggccctgctggagaaggaccccgagaagagactgggcttcagagacgagacctgcgacaagctgagagcccaccccctgttcaaggacctgaactggagacagctggaggccggcatgctgatgccccccttcatccccgacagcaagaccgtgtacgccaaggacatccaggacgtgggcgccttcagcaccgtgaagggcgtggccttcgacaagaccgacaccgagttcttccaggagttcgccaccggcaactgccccatcccctggcaggaggagatgatcgagaccggcatcttcggcgagctgaacgtgtggagaagcgacggccagatgcccgacgacatgaagggcatcagcggcggcagcagcagcagcagcaagagcggcatgtgcctggtgagctag

SEQ ID NO: 82521 - DNA, 285 bp, Artificial Sequence
  Description of Artificial Sequence: Synthetic coding sequence
atgatcgccgccagaggccccttcagagccagaggcgagaaggtggagaacaaggagctgaagcacagaatcatcagcgagcccgtgaagtaccccgacaagttcagccaggccagcaaggacttctgcgaggccctgctggagaaggaccccgagaagagactgggcttcagagacgagacctgcgacaagctgagagcccaccccctgttcaaggacctgaactggagacagctggaggccggcatgctgatgccccccttcatccccgacagcaagacctag

SEQ ID NO: 82522 - DNA, 228 bp, Artificial Sequence
  Description of Artificial Sequence: Synthetic coding sequence
atggagctggagaacatcgtggccaacaccgtgctgctgaaggccagagagggcggcggcggcaagagaaagggcaagagcaagaagtggaaggagatcctgaagttcccccacatcagccagtgcgaggacctgagaagaaccatcggcgagctgagcggcagcctgatcagctggagcagcagcaccaaggagcacggcagacccaccgagatcaagatgagatag

SEQ ID NO: 82523 - DNA, 1458 bp, Artificial Sequence
  Description of Artificial Sequence: Synthetic coding sequence
atgaccaagtacctgacccccaagagccccgtgttcatcgcccaggtgggccaggacctggtgagccagaccgaggagaagctgctgcagaagccctgcaaggagctgttcagcgcctgcgcccagagcgtgcacgagtacctgagaggcgagcccttccacgagtacctggacagcatgttcttcgacagattcctgcagtggaagtggctggagagacagcccgtgaccaagaacaccttcagacagtacagagtgctgggcaagggcggcttcggcgaggtgtgcgcctgccaggtgagagccaccggcaagatgtacgcctgcaagagactggagaagaagagaatcaagaagagaaagggcgagagcatggccctgaacgagaagcagatcctggagaaggtgaacagccagttcgtggtgaacctggcctacgcctacgagaccaaggacgccctgtgcctggtgctgaccatcatgaacggcggcgacctgaagttccacatctacaacatgggcaaccccggcttcgaggaggagagagccctgttctacgccgccgagatcctgtgcggcctggaggacctgcacagagagaacaccgtgtacagagacctgaagcccgagaacatcctgctggacgactacggccacatcagaatcagcgacctgggcctggccgtgaagatccccgagggcgacctgatcagaggcagagtgggcaccgtgggctacatggcccccgaggtgctgaacaaccagagatacggcctgagccccgactactggggcctgggctgcctgatctacgagatgatcgagggccagagccccttcagaggcagaaaggagaaggtgaagagagaggaggtggacagaagagtgctggagaccgaggaggtgtacagccacaagttcagcgaggaggccaagagcatctgcaagatgctgctgaccaaggacgccaagcagagactgggctgccaggaggagggcgccgccgaggtgaagagacaccccttcttcagaaacatgaacttcaagagactggaggccggcatgctggacccccccttcgtgcccgaccccagagccgtgtactgcaaggacgtgctggacatcgagcagttcagcaccgtgaagggcgtgaacctggaccacaccgacgacgacttctacagcaagttcagcaccggcagcgtgagcatcccctggcagaacgagatgatcgagaccgagtgcttcaaggagctgaacgtgttcggccccaacggcaccctgccccccgacctgaacagaaaccacccccccgagccccccaagaagggcctgctgcagagactgttcaagagacagcaccagaacaacagcaagagcagccccagcagcaagaccagcttcaaccaccacatcaacagcaaccacgtgagcagcaacagcaccggcagcagctag

SEQ ID NO: 82524 - DNA, 1773 bp, Artificial Sequence
  Description of Artificial Sequence: Synthetic coding sequence
atggagctggagaacatcgtggccaacaccgtgctgctgaaggccagagagggcggcggcggcaagagaaagggcaagagcaagaagtggaaggagatcctgaagttcccccacatcagccagtgcgaggacctgagaagaaccatcgacagagactactgcagcctgtgcgacaagcagcccatcggcagactgctgttcagacagttctgcgagaccagacccggcctggagtgctacatccagttcctggacagcgtggccgagtacgaggtgacccccgacgagaagctgggcgagaagggcaaggagatcatgaccaagtacctgacccccaagagccccgtgttcatcgcccaggtgggccaggacctggtgagccagaccgaggagaagctgctgcagaagccctgcaaggagctgttcagcgcctgcgcccagagcgtgcacgagtacctgagaggcgagcccttccacgagtacctggacagcatgttcttcgacagattcctgcagtggaagtggctggagagacagcccgtgaccaagaacaccttcagacagtacagagtgctgggcaagggcggcttcggcgaggtgtgcgcctgccaggtgagagccaccggcaagatgtacgcctgcaagagactggagaagaagagaatcaagaagagaaagggcgagagcatggccctgaacgagaagcagatcctggagaaggtgaacagccagttcgtggtgaacctggcctacgcctacgagaccaaggacgccctgtgcctggtgctgaccatcatgaacggcggcgacctgaagttccacatctacaacatgggcaaccccggcttcgaggaggagagagccctgttctacgccgccgagatcctgtgcggcctggaggacctgcacagagagaacaccgtgtacagagacctgaagcccgagaacatcctgctggacgactacggccacatcagaatcagcgacctgggcctggccgtgaagatccccgagggcgacctgatcagaggcagagtgggcaccgtgggctacatggcccccgaggtgctgaacaaccagagatacggcctgagccccgactactggggcctgggctgcctgatctacgagatgatcgagggccagagccccttcagaggcagaaaggagaaggtgaagagagaggaggtggacagaagagtgctggagaccgaggaggtgtacagccacaagttcagcgaggaggccaagagcatctgcaagatgctgctgaccaaggacgccaagcagagactgggctgccaggaggagggcgccgccgaggtgaagagacaccccttcttcagaaacatgaacttcaagagactggaggccggcatgctggacccccccttcgtgcccgaccccagagccgtgtactgcaaggacgtgctggacatcgagcagttcagcaccgtgaagggcgtgaacctggaccacaccgacgacgacttctacagcaagttcagcaccggcagcgtgagcatcccctggcagaacgagatgatcgagaccgagtgcttcaaggagctgaacgtgttcggccccaacggcaccctgccccccgacctgaacagaaaccacccccccgagccccccaagaagggcctgctgcagagactgttcaagagacagcaccagaacaacagcaagagcagccccagcagcaagaccagcttcaaccaccacatcaacagcaaccacgtgagcagcaacagcaccggcagcagctag

SEQ ID NO: 82525 - DNA, 1200 bp, Artificial Sequence
  Description of Artificial Sequence: Synthetic coding sequence
atgaccaagtacctgacccccaagagccccgtgttcatcgcccaggtgggccaggacctggtgagccagaccgaggagaagctgctgcagaagccctgcaaggagctgttcagcgcctgcgcccagagcgtgcacgagtacctgagaggcgagcccttccacgagtacctggacagcatgttcttcgacagattcctgcagtggaagtggctggagagacagcccgtgaccaagaacaccttcagacagtacagagtgctgggcaagggcggcttcggcgaggtgtgcgcctgccaggtgagagccaccggcaagatgtacgcctgcaagagactggagaagaagagaatcaagaagagaaagggcgagagcatggccctgaacgagaagcagatcctggagaaggtgaacagccagttcgtggtgaacctggcctacgcctacgagaccaaggacgccctgtgcctggtgctgaccatcatgaacggcggcgacctgaagttccacatctacaacatgggcaaccccggcttcgaggagggcgccgccgaggtgaagagacaccccttcttcagaaacatgaacttcaagagactggaggccggcatgctggacccccccttcgtgcccgaccccagagccgtgtactgcaaggacgtgctggacatcgagcagttcagcaccgtgaagggcgtgaacctggaccacaccgacgacgacttctacagcaagttcagcaccggcagcgtgagcatcccctggcagaacgagatgatcgagaccgagtgcttcaaggagctgaacgtgttcggccccaacggcaccctgccccccgacctgaacagaaaccacccccccgagccccccaagaagggcctgctgcagagactgttcaagagacagcaccagaacaacagcaagagcagccccagcagcaagagcaccgtggagcccgcccagaccctgctgctgagaagcggcagcagcggcgcccccgccctggtgggcctgcccggcgagacccccggcgccggcgagggcggcagacccagcagaagaagaagaaccagcagattcctgaaggagatcagcacccaggtgtgcttccccagaagacccagacccggctggatcggcttcgtgttcggcgagcactgcaacagaaaccccatcggctacgacaacctgcacgtgttctag

SEQ ID NO: 82526 - DNA, 1731 bp, Artificial Sequence
  Description of Artificial Sequence: Synthetic coding sequence
atggagctggagaacatcgtggccaacaccgtgctgctgaaggccagagagggcggcggcggcaacagaaagggcaagagcaagaagtggagacagatgctgcagttcccccacatcagccagtgcgaggagctgagactgagcctggagagagactaccacagcctgtgcgagagacagcccatcggcagactgctgttcagagagttctgcgccaccagacccgagctgagcagatgcgtggccttcctggacggcgtggccgagtacgaggtgacccccgacgacaagagaaaggcctgcggcagacagctgacccagaacttcctgagccacaccggccccgacctgatccccgaggtgcccagacagctggtgaccaactgcacccagagactggagcagggcccctgcaaggacctgttccaggagctgaccagactgacccacgagtacctgagcgtggcccccttcgccgactacctggacagcatctacttcaacagattcctgcagtggaagtggctggagagacagcccgtgaccaagaacaccttcagacagtacagagtgctgggcaagggcggcttcggcgaggtgtgcgcctgccaggtgagagccaccggcaagatgtacgcctgcaagaagctggagaagaagagaatcaagaagagaaagggcgaggccatggccctgaacgagaagcagatcctggagaaggtgaacagcagattcgtggtgagcctggcctacgcctacgagaccaaggacgccctgtgcctggtgctgaccctgatgaacggcggcgacctgaagttccacatctaccacatgggccaggccggcttccccgaggccagagccgtgttctacgccgccgagatctgctgcggcctggaggacctgcacagagagagaatcgtgtacagagacctgaagcccgagaacatcctgctggacgaccacggccacatcagaatcagcgacctgggcctggccgtgcacgtgcccgagggccagaccatcaagggcagagtgggcaccgtgggctacatggcccccgaggtggtgaagaacgagagatacaccttcagccccgactggtgggccctgggctgcctgctgtacgagatgatcgccggccagagccccttccagcagagaaagaagaagatcaagagagaggaggtggagagactggtgaaggaggtgcccgaggagtacagcgagagattcagcccccaggccagaagcctgtgcagccagctgctgtgcaaggaccccgccgagagactgggctgcagaggcggcagcgccagagaggtgaaggagcaccccctgttcaagaagctgaacttcaagagactgggcgccggcatgctggagccccccttcaagcccgacccccaggccatctactgcaaggacgtgctggacatcgagcagttcagcaccgtgaagggcgtggagctggagcccaccgaccaggacttctaccagaagttcgccaccggcagcgtgcccatcccctggcagaacgagatggtggagaccgagtgcttccaggagctgaacgtgttcggcctggacggcagcgtgccccccgacctggactggaagggccagccccccgccccccccaagaagggcctgctgcagagactgttcagcagacaggactgctgcggcaactgcagcgacagcgaggaggagctgcccaccagactgtag

SEQ ID NO: 82527 - DNA, 1683 bp, Artificial Sequence
  Description of Artificial Sequence: Synthetic coding sequence
atggagctggagaacatcgtggccaacaccgtgctgctgaaggccagagagggcggcggcggcaacagaaagggcaagagcaagaagtggagacagatgctgcagttcccccacatcagccagtgcgaggagctgagactgagcctggagagagactaccacagcctgtgcgagagacagcccatcggcagactgctgttcagagagttctgcgccaccagacccgagctgagcagatgcgtggccttcctggacggcgtggccgagtacgaggtgacccccgacgacaagagaaaggcctgcggcagacagctgacccagaacttcctgagccacaccggccccgacctgatccccgaggtgcccagacagctggtgaccaactgcacccagagactggagcagggcccctgcaaggacctgttccaggagctgaccagactgacccacgagtacctgagcgtggcccccttcgccgactacctggacagcatctacttcaacagattcctgcagtggaagtggctggagagacagcccgtgaccaagaacaccttcagacagtacagagtgctgggcaagggcggcttcggcgaggtgtgcgcctgccaggtgagagccaccggcaagatgtacgcctgcaagaagctggagaagaagagaatcaagaagagaaagggcgaggccatggccctgaacgagaagcagatcctggagaaggtgaacagcagattcgtggtgagcctggcctacgcctacgagaccaaggacgccctgtgcctggtgctgaccctgatgaacggcggcgacctgaagttccacatctaccacatgggccaggccggcttccccgaggccagagccgtgttctacgccgccgagatctgctgcggcctggaggacctgcacagagagagaatcgtgtacagagacctgaagcccgagaacatcctgctggacgaccacggccacatcagaatcagcgacctgggcctggccgtgcacgtgcccgagggccagaccatcaagggcagagtgggcaccgtgggctacatggcccccgaggtggtgaagaacgagagatacaccttcagccccgactggtgggccctgggctgcctgctgtacgagatgatcgccggccagagccccttccagcagagaaagaagaagatcaagagagaggaggtggagagactggtgaaggaggtgcccgaggagtacagcgagagattcagcccccaggccagaagcctgtgcagccagctgctgtgcaaggaccccgccgagagactgggctgcagaggcggcagcgccagagaggtgaaggagcaccccctgttcaagaagctgaacttcaagagactgggcgccggcatgctggagccccccttcaagcccgacccccaggccatctactgcaaggacgtgctggacatcgagcagttcagcaccgtgaagggcgtggagctggagcccaccgaccaggacttctaccagaagttcgccaccggcagcgtgcccatcccctggcagaacgagatggtggagaccgagtgcttccaggagctgaacgtgttcggcctggacggcagcgtgccccccgacctggactggaagggccagccccccgccccccccaagaagggcctgctgcagagactgttcagcagacagagatag

SEQ ID NO: 82528 - DNA, 1770 bp, Artificial Sequence
  Description of Artificial Sequence: Synthetic coding sequence
atggagctggagaacatcgtggccaacaccgtgctgctgaaggccagagagggcggcggcggcaacagaaagggcaagagcaagaagtggagacagatgctgcagttcccccacatcagccagtgcgaggagctgagactgagcctggagagagactaccacagcctgtgcgagagacagcccatcggcagactgctgttcagagagttctgcgccaccagacccgagctgagcagatgcgtggccttcctggacggcgtggccgagtacgaggtgacccccgacgacaagagaaaggcctgcggcagacagctgacccagaacttcctgagccacaccggccccgacctgatccccgaggtgcccagacagctggtgaccaactgcacccagagactggagcagggcccctgcaaggacctgttccaggagctgaccagactgacccacgagtacctgagcgtggcccccttcgccgactacctggacagcatctacttcaacagattcctgcagtggaagtggctggagagacagcccgtgaccaagaacaccttcagacagtacagagtgctgggcaagggcggcttcggcgaggtgtgcgcctgccaggtgagagccaccggcaagatgtacgcctgcaagaagctggagaagaagagaatcaagaagagaaagggcgaggccatggccctgaacgagaagcagatcctggagaaggtgaacagcagattcgtggtgagcctggcctacgcctacgagaccaaggacgccctgtgcctggtgctgaccctgatgaacggcggcgacctgaagttccacatctaccacatgggccaggccggcttccccgaggccagagccgtgttctacgccgccgagatctgctgcggcctggaggacctgcacagagagagaatcgtgtacagagacctgaagcccgagaacatcctgctggacgaccacggccacatcagaatcagcgacctgggcctggccgtgcacgtgcccgagggccagaccatcaagggcagagtgggcaccgtgggctacatggcccccgaggtggtgaagaacgagagatacaccttcagccccgactggtgggccctgggctgcctgctgtacgagatgatcgccggccagagccccttccagcagagaaagaagaagatcaagagagaggaggtggagagactggtgaaggaggtgcccgaggagtacagcgagagattcagcccccaggccagaagcctgtgcagccagctgctgtgcaaggaccccgccgagagactgggctgcagaggcggcagcgccagagaggtgaaggagcaccccctgttcaagaagctgaacttcaagagactgggcgccggcatgctggagccccccttcaagcccgacccccaggccatctactgcaaggacgtgctggacatcgagcagttcagcaccgtgaagggcgtggagctggagcccaccgaccaggacttctaccagaagttcgccaccggcagcgtgcccatcccctggcagaacgagatggtggagaccgagtgcttccaggagctgaacgtgttcggcctggacggcagcgtgccccccgacctggactggaagggccagccccccgccccccccaagaagggcctgctgcagagactgttcagcagacagagaatcgccgtggagaccgccgccaccgccagaaagagcagcccccccgccagcagcccccagcccgaggcccccaccagcagctggagatag

SEQ ID NO: 82529 - DNA, 1662 bp, Artificial Sequence
  Description of Artificial Sequence: Synthetic coding sequence
atggtggacatgggcgccctggacaacctgatcgccaacaccgcctacctgcaggccagaaagcccagcgactgcgacagcaaggagctgcagagaagaagaagaagcctggccctgcccggcctgcagggctgcgccgagctgagacagaagctgagcctgaacttccacagcctgtgcgagcagcagcccatcggcagaagactgttcagagacttcctggccaccgtgcccaccttcagaaaggccgccaccttcctggaggacgtgcagaactgggagctggccgaggagggccccaccaaggacagcgccctgcagggcctggtggccacctgcgccagcgcccccgcccccggcaacccccagcccttcctgagccaggccgtggccaccaagtgccaggccgccaccaccgaggaggagagagtggccgccgtgaccctggccaaggccgaggccatggccttcctgcaggagcagcccttcaaggacttcgtgaccagcgccttctacgacaagttcctgcagtggaagctgttcgagatgcagcccgtgagcgacaagtacttcaccgagttcagagtgctgggcaagggcggcttcggcgaggtgtgcgccgtgcaggtgaagaacaccggcaagatgtacgcctgcaagaagctggacaagaagagactgaagaagaagggcggcgagaagatggccctgctggagaaggagatcctggagaaggtgagcagccccttcatcgtgagcctggcctacgccttcgagagcaagacccacctgtgcctggtgatgagcctgatgaacggcggcgacctgaagttccacatctacaacgtgggcaccagaggcctggacatgagcagagtgatcttctacagcgcccagatcgcctgcggcatgctgcacctgcacgagctgggcatcgtgtacagagacatgaagcccgagaacgtgctgctggacgacctgggcaactgcagactgagcgacctgggcctggccgtggagatgaagggcggcaagcccatcacccagagagccggcaccaacggctacatggcccccgagatcctgatggagaaggtgagctacagctaccccgtggactggttcgccatgggctgcagcatctacgagatggtggccggcagaacccccttcaaggactacaaggagaaggtgagcaaggaggacctgaagcagagaaccctgcaggacgaggtgaagttccagcacgacaacttcaccgaggaggccaaggacatctgcagactgttcctggccaagaagcccgagcagagactgggcagcagagagaagagcgacgaccccagaaagcaccacttcttcaagaccatcaacttccccagactggaggccggcctgatcgagccccccttcgtgcccgaccccagcgtggtgtacgccaaggacatcgccgagatcgacgacttcagcgaggtgagaggcgtggagttcgacgacaaggacaagcagttcttcaagaacttcgccaccggcgccgtgcccatcgcctggcaggaggagatcatcgagaccggcctgttcgaggagctgaacgaccccaacagacccaccggctgcgaggagggcaacagcagcaagagcggcgtgtgcctgctgctgtag

SEQ ID NO: 82530 - DNA, 2088 bp, Artificial Sequence
  Description of Artificial Sequence: Synthetic coding sequence
atggaggagaagcccggccagccccagccccagcaccaccacagccaccaccacccccaccaccacccccagcagcagcagcagcagccccaccaccaccaccactactacttctacaaccacagccacaaccaccaccaccaccaccaccaccagcagccccaccagtacctgcagcacggcgccgagggcagccccaaggcccagcccaagcccctgaagcacgagcagaagcacaccctgcagcagcaccaggagacccccaagaagaagaccggctacggcgagctgaacggcaacgccggcgagagagagatcagcctgaagaacctgagcagcgacgaggccaccaaccccatcagcagagtgctgaacggcaaccagcaggtggtggacaccagcctgaagcagaccgtgaaggccaacaccttcggcaaggccggcatcaagaccaagaacttcatccagaagaacagcatggacaagaagaacggcaagagctacgagaacaagagcggcgagaaccagagcgtggacaagagcgacaccatccccatccccaacggcgtggtgaccaacaacagcggctacatcaccaacggctacatgggcaagggcgccgacaacgacggcagcggcagcgagagcggctacaccacccccaagaagagaaaggccagaagaaacagcgccaagggctgcgagaacctgaacatcgtgcaggacaagatcatgcagcaggagaccagcgtgcccaccctgaagcagggcctggagaccttcaagcccgactacagcgagcagaagggcaacagagtggacggcagcaagcccatctggaagtacgagaccggccccggcggcaccagcagaggcaagcccgccgtgggcgacatgctgagaaagagcagcgacagcaagcccggcgtgagcagcaagaagttcgacgacagacccaagggcaagcacgccagcgccgtggccagcaaggaggacagctggaccctgttcaagcccccccccgtgttccccgtggacaacagcagcgccaagatcgtgcccaagatcagctacgccagcaaggtgaaggagaacctgaacaagaccatccagaacagcagcgtgagccccaccagcagcagcagcagcagcagcagcaccggcgagacccagacccagagcagcagcagactgagccaggtgcccatgagcgccctgaagagcgtgaccagcgccaacttcagcaacggccccgtgctggccggcaccgacggcaacgtgtacccccccggcggccagcccctgctgaccaccgccgccaacaccctgacccccatcagcagcggcaccgacagcgtgctgcaggacatgagcctgaccagcgccgccgtggagcagatcaagaccagcctgttcatctaccccagcaacatgcagaccatgctgctgagcaccgcccaggtggacctgcccagccagaccgaccagcagaacctgggcgacatcttccagaaccagtggggcctgagcttcatcaacgagcccagcgccggccccgagaccgtgaccggcaagagcagcgagcacaaggtgatggaggtgaccttccagggcgagtaccccgccaccctggtgagccagggcgccgagatcatccccagcggcaccgagcaccccgtgttccccaaggcctacgagctggagaagagaaccagcccccaggtgctgggcagcatcctgaagagcggcaccaccagcgagagcggcgccctgagcctggagcccagccacatcggcgacctgcagaaggccgacaccagcagccagggcgccctggtgttcctgagcaaggactacgagatcgagagccagaaccccctggccagccccaccaacaccctgctgggcagcgccaaggagcagagataccagagaggcctggagagaaacgacagctggggcagcttcgacctgagagccgccatcgtgtaccacaccaaggagatggagagcatctggaacctgcagaagcaggaccccaagagaatcatcacctacaacgaggccatggacagccccgaccagtag

SEQ ID NO: 82531 - DNA, 534 bp, Artificial Sequence
  Description of Artificial Sequence: Synthetic coding sequence
atgagcagaaagggccccagagccgaggtgtgcgccgactgcagcgcccccgaccccggctgggccagcatcagcagaggcgtgctggtgtgcgacgagtgctgcagcgtgcacagaagcctgggcagacacatcagcatcgtgaagcacctgagacacagcgcctggccccccaccctgctgcagatggtgcacaccctggccagcaacggcgccaacagcatctgggagcacagcctgctggaccccgcccaggtgcagagcggcagaagaaaggccaacccccaggacaaggtgcaccccatcaagagcgagttcatcagagccaagtaccagatgctggccttcgtgcacaagctgccctgcagagacgacgacggcgtgaccgccaaggacgacctgaccggccacagaagctgggccacccccgacatcaacccccaccccaacagagccaccggcaccagcgccctgagcgccgccaccctgcccggcagccaggtgccctggtgcccccccctgagcagcccctag

SEQ ID NO: 82532 - DNA, 2313 bp, Artificial Sequence
  Description of Artificial Sequence: Synthetic coding sequence
atgagcagaaagggccccagagccgaggtgtgcgccgactgcagcgcccccgaccccggctgggccagcatcagcagaggcgtgctggtgtgcgacgagtgctgcagcgtgcacagaagcctgggcagacacatcagcatcgtgaagcacctgagacacagcgcctggccccccaccctgctgcagatggtgcacaccctggccagcaacggcgccaacagcatctgggagcacagcctgctggaccccgcccaggtgcagagcggcagaagaaaggccaacccccaggacaaggtgcaccccatcaagagcgagttcatcagagccaagtaccagatgctggccttcgtgcacaagctgccctgcagagacgacgacggcgtgaccgccaaggacctgagcaagcagctgcacagcagcgtgagaaccggcaacctggagacctgcctgagactgctgagcctgggcgcccaggccaacttcttccaccccgagaagggcaccacccccctgcacgtggccgccaaggccggccagaccctgcaggccgagctgctggtggtgtacggcgccgaccccggcagccccgacgtgaacggcagaacccccatcgactacgccagacaggccggccaccacgagctggccgagagactggtggagtgccagtacgagctgaccgacagactggccttctacctgtgcggcagaaagcccgaccacaagaacggccactacatcatcccccagatggccgacagaagcagacagaagtgcatgagccagagcctggacctgagcgagctggccaaggccgccaagaagaagctgcaggccctgagcaacagactgttcgaggagctggccatggacgtgtacgacgaggtggacagaagagagaacgacgccgtgtggctggccacccagaaccacagcaccctggtgaccgagagaagcgccgtgcccttcctgcccgtgaaccccgagtacagcgccaccagaaaccagggcagacagaagctggccagattcaacgccagagagttcgccaccctgatcatcgacatcctgagcgaggccaagagaagacagcagggcaagagcctgagcagccccaccgacaacctggagctgagcctgagaagccagagcgacctggacgaccagcacgactacgacagcgtggccagcgacgaggacaccgaccaggagcccctgagaagcaccggcgccaccagaagcaacagagccagaagcatggacagcagcgacctgagcgacggcgccgtgaccctgcaggagtacctggagctgaagaaggccctggccaccagcgaggccaaggtgcagcagctgatgaaggtgaacagcagcctgagcgacgagctgagaagactgcagagagagatccacaagctgcaggccgagaacctgcagctgagacagccccccggccccgtgcccaccccccccctgcccagcgagagagccgagcacacccccatggcccccggcggcagcacccacagaagagacagacaggccttcagcatgtacgagcccggcagcgccctgaagcccttcggcggcccccccggcgacgagctgaccaccagactgcagcccttccacagcaccgagctggaggacgacgccatctacagcgtgcacgtgcccgccggcctgtacagaatcagaaagggcgtgagcgccagcgccgtgcccttcacccccagcagccccctgctgagctgcagccaggagggcagcagacacaccagcaagctgagcagacacggcagcggcgccgacagcgactacgagaacacccagagcggcgaccccctgctgggcctggagggcaagagattcctggagctgggcaaggaggaggacttccaccccgagctggagagcctggacggcgacctggaccccggcctgcccagcaccgaggacgtgatcctgaagaccgagcaggtgaccaagaacatccaggagctgctgagagccgcccaggagttcaagcacgacagcttcgtgccctgcagcgagaagatccacctggccgtgaccgagatggccagcctgttccccaagagacccgccctggagcccgtgagaagcagcctgagactgctgaacgccagcgcctacagactgcagagcgagtgcagaaagaccgtgccccccgagcccggcgcccccgtggacttccagctgctgacccagcaggtgatccagtgcgcctacgacatcgccaaggccgccaagcagctggtgaccatcaccaccagagagaagaagcagtag

SEQ ID NO: 82533 - DNA, 1212 bp, Artificial Sequence
  Description of Artificial Sequence: Synthetic coding sequence
atgttcgtggccagcgagagaaagatgagagcccaccaggtgctgaccttcctgctgctgttcgtgatcaccagcgtggccagcgagaacgccagcaccagcagaggctgcggcctggacctgctgccccagtacgtgagcctgtgcgacctggacgccatctggggcatcgtggtggaggccgtggccggcgccggcgccctgatcaccctgctgctgatgctgatcctgctggtgagactgcccttcatcaaggagaaggagaagaagagccccgtgggcctgcacttcctgttcctgctgggcaccctgggcctgttcggcctgaccttcgccttcatcatccaggaggacgagaccatctgcagcgtgagaagattcctgtggggcgtgctgttcgccctgtgcttcagctgcctgctgagccaggcctggagagtgagaagactggtgagacacggcaccggccccgccggctggcagctggtgggcctggccctgtgcctgatgctggtgcaggtgatcatcgccgtggagtggctggtgctgaccgtgctgagagacaccagacccgcctgcgcctacgagcccatggacttcgtgatggccctgatctacgacatggtgctgctggtggtgaccctgggcctggccctgttcaccctgtgcggcaagttcaagagatggaagctgaacggcgccttcctgctgatcaccgccttcctgagcgtgctgatctgggtggcctggatgaccatgtacctgttcggcaacgtgaagctgcagcagggcgacgcctggaacgaccccaccctggccatcaccctggccgccagcggctgggtgttcgtgatcttccacgccatccccgagatccactgcaccctgctgcccgccctgcaggagaacacccccaactacttcgacaccagccagcccagaatgagagagaccgccttcgaggaggacgtgcagctgcccagagcctacatggagaacaaggccttcagcatggacgagcacaacgccgccctgagaaccgccggcttccccaacggcagcctgggcaagagacccagcggcagcctgggcaagagacccagcgcccccttcagaagcaacgtgtaccagcccaccgagatggccgtggtgctgaacggcggcaccatccccaccgccccccccagccacaccggcagacacctgtggtag

SEQ ID NO: 82534 - DNA, 1215 bp, Artificial Sequence
  Description of Artificial Sequence: Synthetic coding sequence
atgttcgtggccagcgagagaaagatgagagcccaccaggtgctgaccttcctgctgctgttcgtgatcaccagcgtggccagcgagaacgccagcaccagcagaggctgcggcctggacctgctgccccagtacgtgagcctgtgcgacctggacgccatctggggcatcgtggtggaggccgtggccggcgccggcgccctgatcaccctgctgctgatgctgatcctgctggtgagactgcccttcatcaaggagaaggagaagaagagccccgtgggcctgcacttcctgttcctgctgggcaccctgggcctgttcggcctgaccttcgccttcatcatccaggaggacgagaccatctgcagcgtgagaagattcctgtggggcgtgctgttcgccctgtgcttcagctgcctgctgagccaggcctggagagtgagaagactggtgagacacggcaccggccccgccggctggcagctggtgggcctggccctgtgcctgatgctggtgcaggtgatcatcgccgtggagtggctggtgctgaccgtgctgagagacaccagacccgcctgcgcctacgagcccatggacttcgtgatggccctgatctacgacatggtgctgctggtggtgaccctgggcctggccctgttcaccctgtgcggcaagttcaagagatggaagctgaacggcgccttcctgctgatcaccgccttcctgagcgtgctgatctgggtggcctggatgaccatgtacctgttcggcaacgtgaagctgcagcagggcgacgcctggaacgaccccaccctggccatcaccctggccgccagcggctgggtgttcgtgatcttccacgccatccccgagatccactgcaccctgctgcccgccctgcaggagaacacccccaactacttcgacaccagccagcccagaatgagagagaccgccttcgaggaggacgtgcagctgcccagagcctacatggagaacaaggccttcagcatggacgagcacaacgccgccctgagaaccgccggcttccccaacggcagcctgggcaagagacccagcggcagcctgggcaagagacccagcgcccccttcagaagcaacgtgtaccagcccaccgagatggccgtggtgctgaacggcggcaccgagatggtgacccaccccagaagcctggagagcttcggcgccttctag

SEQ ID NO: 82535 - DNA, 1290 bp, Artificial Sequence
  Description of Artificial Sequence: Synthetic coding sequence
atgaaccccccctggagcgtggcctggggccaggagggcttcagagccggcacccccggcagcagatacctgcccagaatgttcgtggccagcgagagaaagatgagagcccaccaggtgctgaccttcctgctgctgttcgtgatcaccagcgtggccagcgagaacgccagcaccagcagaggctgcggcctggacctgctgccccagtacgtgagcctgtgcgacctggacgccatctggggcatcgtggtggaggccgtggccggcgccggcgccctgatcaccctgctgctgatgctgatcctgctggtgagactgcccttcatcaaggagaaggagaagaagagccccgtgggcctgcacttcctgttcctgctgggcaccctgggcctgttcggcctgaccttcgccttcatcatccaggaggacgagaccatctgcagcgtgagaagattcctgtggggcgtgctgttcgccctgtgcttcagctgcctgctgagccaggcctggagagtgagaagactggtgagacacggcaccggccccgccggctggcagctggtgggcctggccctgtgcctgatgctggtgcaggtgatcatcgccgtggagtggctggtgctgaccgtgctgagagacaccagacccgcctgcgcctacgagcccatggacttcgtgatggccctgatctacgacatggtgctgctggtggtgaccctgggcctggccctgttcaccctgtgcggcaagttcaagagatggaagctgaacggcgccttcctgctgatcaccgccttcctgagcgtgctgatctgggtggcctggatgaccatgtacctgttcggcaacgtgaagctgcagcagggcgacgcctggaacgaccccaccctggccatcaccctggccgccagcggctgggtgttcgtgatcttccacgccatccccgagatccactgcaccctgctgcccgccctgcaggagaacacccccaactacttcgacaccagccagcccagaatgagagagaccgccttcgaggaggacgtgcagctgcccagagcctacatggagaacaaggccttcagcatggacgagcacaacgccgccctgagaaccgccggcttccccaacggcagcctgggcaagagacccagcggcagcctgggcaagagacccagcgcccccttcagaagcaacgtgtaccagcccaccgagatggccgtggtgctgaacggcggcaccatccccaccgccccccccagccacaccggcagacacctgtggtag

SEQ ID NO: 82536 - DNA, 759 bp, Artificial Sequence
  Description of Artificial Sequence: Synthetic coding sequence
atgttcgtggccagcgagagaaagatgagagcccaccaggtgctgaccttcctgctgctgttcgtgatcaccagcgtggccagcgagaacgccagcaccagcagaggctgcggcctggacctgctgccccagtacgtgagcctgtgcgacctggacgccatctggggcatcgtggtggaggccgtggccggcgccggcgccctgatcaccctgctgctgatgctgatcctgctggtgagactgcccttcttcctgctgatcaccgccttcctgagcgtgctgatctgggtggcctggatgaccatgtacctgttcggcaacgtgaagctgcagcagggcgacgcctggaacgaccccaccctggccatcaccctggccgccagcggctgggtgttcgtgatcttccacgccatccccgagatccactgcaccctgctgcccgccctgcaggagaacacccccaactacttcgacaccagccagcccagaatgagagagaccgccttcgaggaggacgtgcagctgcccagagcctacatggagaacaaggccttcagcatggacgagcacaacgccgccctgagaaccgccggcttccccaacggcagcctgggcaagagacccagcggcagcctgggcaagagacccagcgcccccttcagaagcaacgtgtaccagcccaccgagatggccgtggtgctgaacggcggcaccatccccaccgccccccccagccacaccggcagacacctgtggtag

SEQ ID NO: 82537 - DNA, 489 bp, Artificial Sequence
  Description of Artificial Sequence: Synthetic coding sequence
atggccatccacaaggccctggtgatgtgcctgggcctgcccctgttcctgttccccgagcagagctaccagggcgacatgtaccccaccagaggcgtgggctacgagaccatcctgaaggagcagaagggccagagcatgttcgtggagaacaaggccttcagcatggacgagcccgtggccgccaagagacccgtgagcccctacagcggctacaacggccagctgctgaccagcgtgtaccagcccaccgagatggccctgatgcacaaggtgcccagcgagggcgcctacgacatcatcctgcccagagccaccgccaacagccaggtgatgggcagcgccaacagcaccctgagagccgaggacatgtacagcgcccagagccaccaggccgccaccccccccaaggacggcaagaacagccaggtgagcgagctgacccagagaggccaggccaacaccaaccaggtgttcctgagactgtag

SEQ ID NO: 82538 - DNA, 1461 bp, Artificial Sequence
  Description of Artificial Sequence: Synthetic coding sequence
atgagaggcagaggcagccagcagcagcagcccaccagaagacagggccagaagctgcccagccccagccccgccggcaagtacgagagcgcccagcccggcggcacccagcccgagcccggcctgggcgccagaatggccatccacaaggccctggtgatgtgcctgggcctgcccctgttcctgttccccggcgcctgggcccagggccacgtgccccccggctgcagccagggcctgaaccccctgtactacaacctgtgcgacagaagcggcgcctggggcatcgtgctggaggccgtggccggcgccggcatcgtgaccaccttcgtgctgaccatcatcctggtggccagcctgcccttcgtgcaggacaccaagaagagaagcctgctgggcacccaggtgttcttcctgctgggcaccctgggcctgttctgcctggtgttcgcctgcgtggtgaagcccgacttcagcacctgcgccagcagaagattcctgttcggcgtgctgttcgccatctgcttcagctgcctggccgcccacgtgttcgccctgaacttcctggccagaaagaaccacggccccagaggctgggtgatcttcaccgtggccctgctgctgaccctggtggaggtgatcatcaacaccgagtggctgatcatcaccctggtgagaggcagcggcgagggcggcccccagggcaacagcagcgccggctgggccgtggccagcccctgcgccatcgccaacatggacttcgtgatggccctgatctacgtgatgctgctgctgctgggcgccttcctgggcgcctggcccgccctgtgcggcagatacaagagatggagaaagcacggcgtgttcgtgctgctgaccaccgccaccagcgtggccatctgggtggtgtggatcgtgatgtacacctacggcaacaagcagcacaacagccccacctgggacgaccccaccctggccatcgccctggccgccaacgcctgggccttcgtgctgttctacgtgatccccgaggtgagccaggtgaccaagagcagccccgagcagagctaccagggcgacatgtaccccaccagaggcgtgggctacgagaccatcctgaaggagcagaagggccagagcatgttcgtggagaacaaggccttcagcatggacgagcccgtggccgccaagagacccgtgagcccctacagcggctacaacggccagctgctgaccagcgtgtaccagcccaccgagatggccctgatgcacaaggtgcccagcgagggcgcctacgacatcatcctgcccagagccaccgccaacagccaggtgatgggcagcgccaacagcaccctgagagccgaggacatgtacagcgcccagagccaccaggccgccaccccccccaaggacggcaagaacagccaggtgttcagaaacccctacgtgtgggactag

SEQ ID NO: 82539 - DNA, 1326 bp, Artificial Sequence
  Description of Artificial Sequence: Synthetic coding sequence
atggccatccacaaggccctggtgatgtgcctgggcctgcccctgttcctgttccccggcgcctgggcccagggccacgtgccccccggctgcagccagggcctgaaccccctgtactacaacctgtgcgacagaagcggcgcctggggcatcgtgctggaggccgtggccggcgccggcatcgtgaccaccttcgtgctgaccatcatcctggtggccagcctgcccttcgtgcaggacaccaagaagagaagcctgctgggcacccaggtgttcttcctgctgggcaccctgggcctgttctgcctggtgttcgcctgcgtggtgaagcccgacttcagcacctgcgccagcagaagattcctgttcggcgtgctgttcgccatctgcttcagctgcctggccgcccacgtgttcgccctgaacttcctggccagaaagaaccacggccccagaggctgggtgatcttcaccgtggccctgctgctgaccctggtggaggtgatcatcaacaccgagtggctgatcatcaccctggtgagaggcagcggcgagggcggcccccagggcaacagcagcgccggctgggccgtggccagcccctgcgccatcgccaacatggacttcgtgatggccctgatctacgtgatgctgctgctgctgggcgccttcctgggcgcctggcccgccctgtgcggcagatacaagagatggagaaagcacggcgtgttcgtgctgctgaccaccgccaccagcgtggccatctgggtggtgtggatcgtgatgtacacctacggcaacaagcagcacaacagccccacctgggacgaccccaccctggccatcgccctggccgccaacgcctgggccttcgtgctgttctacgtgatccccgaggtgagccaggtgaccaagagcagccccgagcagagctaccagggcgacatgtaccccaccagaggcgtgggctacgagaccatcctgaaggagcagaagggccagagcatgttcgtggagaacaaggccttcagcatggacgagcccgtggccgccaagagacccgtgagcccctacagcggctacaacggccagctgctgaccagcgtgtaccagcccaccgagatggccctgatgcacaaggtgcccagcgagggcgcctacgacatcatcctgcccagagccaccgccaacagccaggtgatgggcagcgccaacagcaccctgagagccgaggacatgtacagcgcccagagccaccaggccgccaccccccccaaggacggcaagaacagccaggtgttcagaaacccctacgtgtgggactag

SEQ ID NO: 82540 - DNA, 1329 bp, Artificial Sequence
  Description of Artificial Sequence: Synthetic coding sequence
atggccatccacaaggccctggtgatgtgcctgggcctgcccctgttcctgttccccggcgcctgggcccagggccacgtgccccccggctgcagccagggcctgaaccccctgtactacaacctgtgcgacagaagcggcgcctggggcatcgtgctggaggccgtggccggcgccggcatcgtgaccaccttcgtgctgaccatcatcctggtggccagcctgcccttcgtgcaggacaccaagaagagaagcctgctgggcacccaggtgttcttcctgctgggcaccctgggcctgttctgcctggtgttcgcctgcgtggtgaagcccgacttcagcacctgcgccagcagaagattcctgttcggcgtgctgttcgccatctgcttcagctgcctggccgcccacgtgttcgccctgaacttcctggccagaaagaaccacggccccagaggctgggtgatcttcaccgtggccctgctgctgaccctggtggaggtgatcatcaacaccgagtggctgatcatcaccctggtgagaggcagcggcgagggcggcccccagggcaacagcagcgccggctgggccgtggccagcccctgcgccatcgccaacatggacttcgtgatggccctgatctacgtgatgctgctgctgctgggcgccttcctgggcgcctggcccgccctgtgcggcagatacaagagatggagaaagcacggcgtgttcgtgctgctgaccaccgccaccagcgtggccatctgggtggtgtggatcgtgatgtacacctacggcaacaagcagcacaacagccccacctgggacgaccccaccctggccatcgccctggccgccaacgcctgggccttcgtgctgttctacgtgatccccgaggtgagccaggtgaccaagagcagccccgagcagagctaccagggcgacatgtaccccaccagaggcgtgggctacgagaccatcctgaaggagcagaagggccagagcatgttcgtggagaacaaggccttcagcatggacgagcccgtggccgccaagagacccgtgagcccctacagcggctacaacggccagctgctgaccagcgtgtaccagcccaccgagatggccctgatgcacaaggtgcccagcgagggcgcctacgacatcatcctgcccagagccaccgccaacagccaggtgatgggcagcgccaacagcaccctgagagccgaggacatgtacagcgcccagagccaccaggccgccaccccccccaaggacggcaagaacagccaggcccagagcccccagagcaagaccagatggtag

SEQ ID NO: 82541 - DNA, 1362 bp, Artificial Sequence
  Description of Artificial Sequence: Synthetic coding sequence
atgggcacccagcccgagcccggcctgggcgccagaatggccatccacaaggccctggtgatgtgcctgggcctgcccctgttcctgttccccggcgcctgggcccagggccacgtgccccccggctgcagccagggcctgaaccccctgtactacaacctgtgcgacagaagcggcgcctggggcatcgtgctggaggccgtggccggcgccggcatcgtgaccaccttcgtgctgaccatcatcctggtggccagcctgcccttcgtgcaggacaccaagaagagaagcctgctgggcacccaggtgttcttcctgctgggcaccctgggcctgttctgcctggtgttcgcctgcgtggtgaagcccgacttcagcacctgcgccagcagaagattcctgttcggcgtgctgttcgccatctgcttcagctgcctggccgcccacgtgttcgccctgaacttcctggccagaaagaaccacggccccagaggctgggtgatcttcaccgtggccctgctgctgaccctggtggaggtgatcatcaacaccgagtggctgatcatcaccctggtgagaggcagcggcgagggcggcccccagggcaacagcagcgccggctgggccgtggccagcccctgcgccatcgccaacatggacttcgtgatggccctgatctacgtgatgctgctgctgctgggcgccttcctgggcgcctggcccgccctgtgcggcagatacaagagatggagaaagcacggcgtgttcgtgctgctgaccaccgccaccagcgtggccatctgggtggtgtggatcgtgatgtacacctacggcaacaagcagcacaacagccccacctgggacgaccccaccctggccatcgccctggccgccaacgcctgggccttcgtgctgttctacgtgatccccgaggtgagccaggtgaccaagagcagccccgagcagagctaccagggcgacatgtaccccaccagaggcgtgggctacgagaccatcctgaaggagcagaagggccagagcatgttcgtggagaacaaggccttcagcatggacgagcccgtggccgccaagagacccgtgagcccctacagcggctacaacggccagctgctgaccagcgtgtaccagcccaccgagatggccctgatgcacaaggtgcccagcgagggcgcctacgacatcatcctgcccagagccaccgccaacagccaggtgatgggcagcgccaacagcaccctgagagccgaggacatgtacagcgcccagagccaccaggccgccaccccccccaaggacggcaagaacagccaggtgttcagaaacccctacgtgtgggactag

SEQ ID NO: 82542 - DNA, 597 bp, Artificial Sequence
  Description of Artificial Sequence: Synthetic coding sequence
atgagcaacgtgagagtgagcaacggcagccccagcctggagagaatggacgccagacaggccgagcaccccaagcccagcgcctgcagaaacctgttcggccccgtggaccacgaggagctgaccagagacctggagaagcactgcagagacatggaggaggccagccagagaaagtggaacttcgacttccagaaccacaagcccctggagggcaagtacgagtggcaggaggtggagaagggcagcctgcccgagttctactacagaccccccagaccccccaagggcgcctgcaaggtgcccgcccaggagagccaggacgtgagcggcagcagacccgccgcccccctgatcggcgcccccgccaacagcgaggacacccacctggtggaccccaagaccgaccccagcgacagccagaccggcctggccgagcagtgcgccggcatcagaaagagacccgccaccgacgacagcagcacccagaacaagagagccaacagaaccgaggagaacgtgagcgacggcagccccaacgccggcagcgtggagcagacccccaagaagcccggcctgagaagaagacagacctag

SEQ ID NO: 82543 - DNA, 903 bp, Artificial Sequence
  Description of Artificial Sequence: Synthetic coding sequence
atgtacaaggactgcatcgagagcaccggcgactacttcctgctgtgcgacgccgagggcccctggggcatcatcctggagagcctggccatcctgggcatcgtggtgaccatcctgctgctgctggccttcctgttcctgatgagaaagatccaggactgcagccagtggaacgtgctgcccacccagctgctgttcctgctgagcgtgctgggcctgttcggcctggccttcgccttcatcatcgagctgaaccagcagaccgcccccgtgagatacttcctgttcggcgtgctgttcgccctgtgcttcagctgcctgctggcccacgccagcaacctggtgaagctggtgagaggctgcgtgagcttcagctggaccaccatcctgtgcatcgccatcggctgcagcctgctgcagatcatcatcgccaccgagtacgtgaccctgatcatgaccagaggcatgatgttcgtgaacatgaccccctgccagctgaacgtggacttcgtggtgctgctggtgtacgtgctgttcctgatggccctgaccttcttcgtgagcaaggccaccttctgcggcccctgcgagaactggaagcagcacggcagactgatcttcatcaccgtgctgttcagcatcatcatctgggtggtgtggatcagcatgctgctgagaggcaacccccagttccagagacagccccagtgggacgaccccgtggtgtgcatcgccctggtgaccaacgcctgggtgttcctgctgctgtacatcgtgcccgagctgtgcatcctgtacagaagctgcagacaggagtgccccctgcagggcaacgcctgccccgtgaccgcctaccagcacagcttccaggtggagaaccaggagctgagcagagactgctag

SEQ ID NO: 82544 - DNA, 363 bp, Artificial Sequence
  Description of Artificial Sequence: Synthetic coding sequence
atgtacaaggactgcatcgagagcaccggcgactacttcctgctgtgcgacgccgagggcccctggggcatcatcctggagagcctggccatcctgggcatcgtggtgaccatcctgctgctgctggccttcctgttcctgatgagaaagatccaggactgcagccagtggaacgtgctgcccacccagctgctgttcctgctgagcgtgctgggcctgttcggcctggccttcgccttcatcatcgagctgaaccagcagaccgcccccgtgagatacttcctgttcggcgtgctgttcgccctgtgcttcagctgcctgctggcccacgccagcaacctggtgaagctggtgagaggctag

SEQ ID NO: 82545 - DNA, 312 bp, Artificial Sequence
  Description of Artificial Sequence: Synthetic coding sequence
atggagaccgtgcaggagctgatccccctggccaaggagatgatggcccagaagagaaagggcaagatggtgaagctgtacgtgctgggcagcgtgctggccctgttcggcgtggtgctgggcctgatggagaccgtgtgcagccccttcaccgccgccagaagactgagagaccaggaggccgccgtggccgagctgcaggccgccctggagagacaggccctgcagaagcaggccctgcaggagaagggcaagcagcaggacaccgtgctgggcggcagagccctgagcaacagacagcacgccagctag

SEQ ID NO: 82546 - DNA, 1500 bp, Artificial Sequence
  Description of Artificial Sequence: Synthetic coding sequence
atggagctgagcgagcccatcgtggagaacggcgagaccgagatgagccccgaggagagctgggagcacaaggaggagatcagcgaggccgagcccggcggcggcagcctgggcgacggcagaccccccgaggagagcgcccacgagatgatggaggaggaggaggagatccccaagcccaagagcgtggtggccccccccggcgcccccaagaaggagcacgtgaacgtggtgttcatcggccacgtggacgccggcaagagcaccatcggcggccagatcatgtacctgaccggcatggtggacaagagaaccctggagaagtacgagagagaggccaaggagaagaacagagagacctggtacctgagctgggccctggacaccaaccaggaggagagagacaagggcaagaccgtggaggtgggcagagcctacttcgagaccgagaagaagcacttcaccatcctggacgcccccggccacaagagcttcgtgcccaacatgatcggcggcgccagccaggccgacctggccgtgctggtgatcagcgccagaaagggcgagttcgagaccggcttcgagaagggcggccagaccagagagcacgccatgctggccaagaccgccggcgtgaagcacctgatcgtgctgatcaacaagatggacgaccccaccgtgaactggagcaacgagagatacgaggagtgcaaggagaagctggtgcccttcctgaagaaggtgggcttcaaccccaagaaggacatccacttcatgccctgcagcggcctgaccggcgccaacctgaaggagcagagcgacttctgcccctggtacatcggcctgcccttcatcccctacctggacaacctgcccaacttcaacagaagcgtggacggccccatcagactgcccatcgtggacaagtacaaggacatgggcaccgtggtgctgggcaagctggagagcggcagcatctgcaagggccagcagctggtgatgatgcccaacaagcacaacgtggaggtgctgggcatcctgagcgacgacgtggagaccgacaccgtggcccccggcgagaacctgaagatcagactgaagggcatcgaggaggaggagatcctgcccggcttcatcctgtgcgaccccaacaacctgtgccacagcggcagaaccttcgacgcccagatcgtgatcatcgagcacaagagcatcatctgccccggctacaacgccgtgctgcacatccacacctgcatcgaggaggtggagatcaccgccctgatctgcctggtggacaagaagagcggcgagaagagcaagaccagacccagattcgtgaagcaggaccaggtgtgcatcgccagactgagaaccgccggcaccatctgcctggagaccttcaaggacttcccccagatgggcagattcaccctgagagacgagggcaagaccatcgccatcggcaaggtgctgaagctggtgcccgagaaggactag

SEQ ID NO: 82547 - DNA, 1914 bp, Artificial Sequence
  Description of Artificial Sequence: Synthetic coding sequence
atggaccccggcagcggcggcggcggcggcggcggcggcggcggcggcagcagcagcggcagcagcagcagcgacagcgcccccgactgctgggaccaggccgacatggaggcccccggccccggcccctgcggcggcggcggcagcctggccgccgccgccgaggcccagagagagaacctgagcgccgccttcagcagacagctgaacgtgaacgccaagcccttcgtgcccaacgtgcacgccgccgagttcgtgcccagcttcctgagaggccccgccgccccccccccccccgtgggcggcgccgccaacaaccacggcgccggcagcggcgccggcggcagagccgcccccgtggagagcagccaggaggagcagagcctgtgcgagggcagcaacagcgccgtgagcatggagctgagcgagcccatcgtggagaacggcgagaccgagatgagccccgaggagagctgggagcacaaggaggagatcagcgaggccgagcccggcggcggcagcctgggcgacggcagaccccccgaggagagcgcccacgagatgatggaggaggaggaggagatccccaagcccaagagcgtggtggccccccccggcgcccccaagaaggagcacgtgaacgtggtgttcatcggccacgtggacgccggcaagagcaccatcggcggccagatcatgtacctgaccggcatggtggacaagagaaccctggagaagtacgagagagaggccaaggagaagaacagagagacctggtacctgagctgggccctggacaccaaccaggaggagagagacaagggcaagaccgtggaggtgggcagagcctacttcgagaccgagaagaagcacttcaccatcctggacgcccccggccacaagagcttcgtgcccaacatgatcggcggcgccagccaggccgacctggccgtgctggtgatcagcgccagaaagggcgagttcgagaccggcttcgagaagggcggccagaccagagagcacgccatgctggccaagaccgccggcgtgaagcacctgatcgtgctgatcaacaagatggacgaccccaccgtgaactggagcaacgagagatacgaggagtgcaaggagaagctggtgcccttcctgaagaaggtgggcttcaaccccaagaaggacatccacttcatgccctgcagcggcctgaccggcgccaacctgaaggagcagagcgacttctgcccctggtacatcggcctgcccttcatcccctacctggacaacctgcccaacttcaacagaagcgtggacggccccatcagactgcccatcgtggacaagtacaaggacatgggcaccgtggtgctgggcaagctggagagcggcagcatctgcaagggccagcagctggtgatgatgcccaacaagcacaacgtggaggtgctgggcatcctgagcgacgacgtggagaccgacaccgtggcccccggcgagaacctgaagatcagactgaagggcatcgaggaggaggagatcctgcccggcttcatcctgtgcgaccccaacaacctgtgccacagcggcagaaccttcgacgcccagatcgtgatcatcgagcacaagagcatcatctgccccggctacaacgccgtgctgcacatccacacctgcatcgaggaggtggagatcaccgccctgatctgcctggtggacaagaagagcggcgagaagagcaagaccagacccagattcgtgaagcaggaccaggtgtgcatcgccagactgagaaccgccggcaccatctgcctggagaccttcaaggacttcccccagatgggcagattcaccctgagagacgagggcaagaccatcgccatcggcaaggtgctgaagctggtgcccgagaaggactag

SEQ ID NO: 82548 - DNA, 1911 bp, Artificial Sequence
  Description of Artificial Sequence: Synthetic coding sequence
atggaccccggcagcggcggcggcggcggcggcggcggcggcggcggcagcagcagcggcagcagcagcagcgacagcgcccccgactgctgggaccaggccgacatggaggcccccggccccggcccctgcggcggcggcggcagcctggccgccgccgccgaggcccagagagagaacctgagcgccgccttcagcagacagctgaacgtgaacgccaagcccttcgtgcccaacgtgcacgccgccgagttcgtgcccagcttcctgagaggccccgccgccccccccccccccgtgggcggcgccgccaacaaccacggcgccggcagcggcgccggcggcagagccgcccccgtggagagcagccaggaggagcagagcctgtgcgagggcagcaacagcgccgtgagcatggagctgagcgagcccatcgagaacggcgagaccgagatgagccccgaggagagctgggagcacaaggaggagatcagcgaggccgagcccggcggcggcagcctgggcgacggcagaccccccgaggagagcgcccacgagatgatggaggaggaggaggagatccccaagcccaagagcgtggtggccccccccggcgcccccaagaaggagcacgtgaacgtggtgttcatcggccacgtggacgccggcaagagcaccatcggcggccagatcatgtacctgaccggcatggtggacaagagaaccctggagaagtacgagagagaggccaaggagaagaacagagagacctggtacctgagctgggccctggacaccaaccaggaggagagagacaagggcaagaccgtggaggtgggcagagcctacttcgagaccgagaagaagcacttcaccatcctggacgcccccggccacaagagcttcgtgcccaacatgatcggcggcgccagccaggccgacctggccgtgctggtgatcagcgccagaaagggcgagttcgagaccggcttcgagaagggcggccagaccagagagcacgccatgctggccaagaccgccggcgtgaagcacctgatcgtgctgatcaacaagatggacgaccccaccgtgaactggagcaacgagagatacgaggagtgcaaggagaagctggtgcccttcctgaagaaggtgggcttcaaccccaagaaggacatccacttcatgccctgcagcggcctgaccggcgccaacctgaaggagcagagcgacttctgcccctggtacatcggcctgcccttcatcccctacctggacaacctgcccaacttcaacagaagcgtggacggccccatcagactgcccatcgtggacaagtacaaggacatgggcaccgtggtgctgggcaagctggagagcggcagcatctgcaagggccagcagctggtgatgatgcccaacaagcacaacgtggaggtgctgggcatcctgagcgacgacgtggagaccgacaccgtggcccccggcgagaacctgaagatcagactgaagggcatcgaggaggaggagatcctgcccggcttcatcctgtgcgaccccaacaacctgtgccacagcggcagaaccttcgacgcccagatcgtgatcatcgagcacaagagcatcatctgccccggctacaacgccgtgctgcacatccacacctgcatcgaggaggtggagatcaccgccctgatctgcctggtggacaagaagagcggcgagaagagcaagaccagacccagattcgtgaagcaggaccaggtgtgcatcgccagactgagaaccgccggcaccatctgcctggagaccttcaaggacttcccccagatgggcagattcaccctgagagacgagggcaagaccatcgccatcggcaaggtgctgaagctggtgcccgagaaggactag

SEQ ID NO: 82549 - DNA, 1887 bp, Artificial Sequence
  Description of Artificial Sequence: Synthetic coding sequence
atggacagcggcagcagcagcagcgacagcgcccccgactgctgggaccaggtggacatggagagccccggcagcgcccccagcggcgacggcgtgagcagcgccgtggccgaggcccagagagagcccctgagcagcgccttcagcagaaagctgaacgtgaacgccaagcccttcgtgcccaacgtgcacgccgccgagttcgtgcccagcttcctgagaggccccacccagccccccaccctgcccgccggcagcggcagcaacgacgagacctgcaccggcgccggctacccccagggcaagagaatgggcagaggcgcccccgtggagcccagcagagaggagcccctggtgagcctggagggcagcaacagcgccgtgaccatggagctgagcgagcccgtggtggagaacggcgaggtggagatggccctggaggagagctgggagcacagcaaggaggtgagcgaggccgagcccggcggcggcagcagcggcgacagcggcccccccgaggagagcggccaggagatgatggaggagaaggaggagatcagaaagagcaagagcgtgatcgtgcccagcggcgcccccaagaaggagcacgtgaacgtggtgttcatcggccacgtggacgccggcaagagcaccatcggcggccagatcatgttcctgaccggcatggtggacaagagaaccctggagaagtacgagagagaggccaaggagaagaacagagagacctggtacctgagctgggccctggacaccaaccaggaggagagagacaagggcaagaccgtggaggtgggcagagcctacttcgagaccgagagaaagcacttcaccatcctggacgcccccggccacaagagcttcgtgcccaacatgatcggcggcgccagccaggccgacctggccgtgctggtgatcagcgccagaaagggcgagttcgagaccggcttcgagaagggcggccagaccagagagcacgccatgctggccaagaccgccggcgtgaagcacctgatcgtgctgatcaacaagatggacgaccccaccgtgaactggagcatcgagagatacgaggagtgcaaggagaagctggtgcccttcctgaagaaggtgggcttcagccccaagaaggacatccacttcatgccctgcagcggcctgaccggcgccaacatcaaggagcagagcgacttctgcccctggtacaccggcctgcccttcatcccctacctggacaacctgcccaacttcaacagaagcatcgacggccccatcagactgcccatcgtggacaagtacaaggacatgggcaccgtggtgctgggcaagctggagagcggcagcatcttcaagggccagcagctggtgatgatgcccaacaagcacaacgtggaggtgctgggcatcctgagcgacgacaccgagaccgacttcgtggcccccggcgagaacctgaagatcagactgaagggcatcgaggaggaggagatcctgcccggcttcatcctgtgcgaccccagcaacctgtgccacagcggcagaaccttcgacgtgcagatcgtgatcatcgagcacaagagcatcatctgccccggctacaacgccgtgctgcacatccacacctgcatcgaggaggtggagatcaccgccctgatcagcctggtggacaagaagagcggcgagaagagcaagaccagacccagattcgtgaagcaggaccaggtgtgcatcgccagactgagaaccgccggcaccatctgcctggagaccttcaaggacttcccccagatgggcagattcaccctgagagacgagggcaagaccatcgccatcggcaaggtgctgaagctggtgcccgagaaggactag

SEQ ID NO: 82550 - DNA, 1638 bp, Artificial Sequence
  Description of Artificial Sequence: Synthetic coding sequence
atggacagcggcagcaacgacgagacctgcaccggcgccggctacccccagggcaagagaatgggcagaggcgcccccgtggagcccagcagagaggagcccctggtgagcctggagggcagcaacagcgccgtgaccatggagctgagcgagcccgtggtggagaacggcgaggtggagatggccctggaggagagctgggagcacagcaaggaggtgagcgaggccgagcccggcggcggcagcagcggcgacagcggcccccccgaggagagcggccaggagatgatggaggagaaggaggagatcagaaagagcaagagcgtgatcgtgcccagcggcgcccccaagaaggagcacgtgaacgtggtgttcatcggccacgtggacgccggcaagagcaccatcggcggccagatcatgttcctgaccggcatggtggacaagagaaccctggagaagtacgagagagaggccaaggagaagaacagagagacctggtacctgagctgggccctggacaccaaccaggaggagagagacaagggcaagaccgtggaggtgggcagagcctacttcgagaccgagagaaagcacttcaccatcctggacgcccccggccacaagagcttcgtgcccaacatgatcggcggcgccagccaggccgacctggccgtgctggtgatcagcgccagaaagggcgagttcgagaccggcttcgagaagggcggccagaccagagagcacgccatgctggccaagaccgccggcgtgaagcacctgatcgtgctgatcaacaagatggacgaccccaccgtgaactggagcatcgagagatacgaggagtgcaaggagaagctggtgcccttcctgaagaaggtgggcttcagccccaagaaggacatccacttcatgccctgcagcggcctgaccggcgccaacatcaaggagcagagcgacttctgcccctggtacaccggcctgcccttcatcccctacctggacaacctgcccaacttcaacagaagcatcgacggccccatcagactgcccatcgtggacaagtacaaggacatgggcaccgtggtgctgggcaagctggagagcggcagcatcttcaagggccagcagctggtgatgatgcccaacaagcacaacgtggaggtgctgggcatcctgagcgacgacaccgagaccgacttcgtggcccccggcgagaacctgaagatcagactgaagggcatcgaggaggaggagatcctgcccggcttcatcctgtgcgaccccagcaacctgtgccacagcggcagaaccttcgacgtgcagatcgtgatcatcgagcacaagagcatcatctgccccggctacaacgccgtgctgcacatccacacctgcatcgaggaggtggagatcaccgccctgatcagcctggtggacaagaagagcggcgagaagagcaagaccagacccagattcgtgaagcaggaccaggtgtgcatcgccagactgagaaccgccggcaccatctgcctggagaccttcaaggacttcccccagatgggcagattcaccctgagagacgagggcaagaccatcgccatcggcaaggtgctgaagctggtgcccgagaaggactag

SEQ ID NO: 82551 - DNA, 1365 bp, Artificial Sequence
  Description of Artificial Sequence: Synthetic coding sequence
atgaccaagagagaggccgaggagctgatcgagatcgagatcgacggcaccgagaaggccgagtgcaccgaggagagcatcgtggagcagacctacgcccccgccgagtgcgtgagccaggccatcgacatcaacgagcccatcggcaacctgaagaagctgctggagcccagactgcagtgcagcctggacgcccacgagatctgcctgcaggacatccagctggaccccgagagaagcctgttcgaccagggcgtgaagaccgacggcaccgtgcagctgagcgtgcaggtgatcagctaccagggcatcgagcccaagctgaacatcctggagatcgtgaagcccgccgacaccgtggaggtggtgatcgaccccgacgcccaccacgccgagagcgaggcccacctggtggaggaggcccaggtgatcaccctggacggcaccaagcacatcaccaccatcagcgacgagaccagcgagcaggtgaccagatgggccgccgccctggagggctacagaaaggagcaggagagactgggcatcccctacgaccccatccagtggagcaccgaccaggtgctgcactgggtggtgtgggtgatgaaggagttcagcatgaccgacatcgacctgaccaccctgaacatcagcggcagagagctgtgcagcctgaaccaggaggacttcttccagagagtgcccagaggcgagatcctgtggagccacctggagctgctgagaaagtacgtgctggccagccaggagcagcagatgaacgagatcgtgaccatcgaccagcccgtgcagatcatccccgccagcgtgcagagcgccacccccaccaccatcaaggtgatcaacagcagcgccaaggccgccaaggtgcagagagcccccagaatcagcggcgaggacagaagcagccccggcaacagaaccggcaacaacggccagatccagctgtggcagttcctgctggagctgctgaccgacaaggacgccagagactgcatcagctgggtgggcgacgagggcgagttcaagctgaaccagcccgagctggtggcccagaagtggggccagagaaagaacaagcccaccatgaactacgagaagctgagcagagccctgagatactactacgacggcgacatgatctgcaaggtgcagggcaagagattcgtgtacaagttcgtgtgcgacctgaagaccctgatcggctacagcgccgccgagctgaacagactggtgaccgagtgcgagcagaagaagctggccaagatgcagctgcacggcatcgcccagcccgtgaccgccgtggccctggccaccgccagcctgcagaccgagaaggacaactag

SEQ ID NO: 82552 - DNA, 1365 bp, Artificial Sequence; identical to SEQ ID NO: 82551
  Description of Artificial Sequence: Synthetic coding sequence

SEQ ID NO: 82553 - DNA, 2163 bp, Artificial Sequence
  Description of Artificial Sequence: Synthetic coding sequence
atggcccagggcctggaggtggccctgaccgacctgcagagcagcagaaacaacgtgagacaccacaccgaggagatcaccgtggaccacctgctggtgagaagaggccaggccttcaacctgaccctgtacttcagaaacagaagcttccagcccggcctggacaacatcatcttcgtggtggagaccggccccctgcccgacctggccctgggcaccagagccgtgttcagcctggccagacaccacagccccagcccctggatcgcctggctggagaccaacggcgccaccagcaccgaggtgagcctgtgcgccccccccaccgccgccgtgggcagatacctgctgaagatccacatcgacagcttccagggcagcgtgaccgcctaccagctgggcgagttcatcctgctgttcaacccctggtgccccgaggacgccgtgtacctggacagcgagccccagagacaggagtacgtgatgaacgactacggcttcatctaccagggcagcaagaactggatcagaccctgcccctggaactacggccagttcgaggacaagatcatcgacatctgcctgaagctgctggacaagagcctgcacttccagaccgaccccgccaccgactgcgccctgagaggcagccccgtgtacgtgagcagagtggtgtgcgccatgatcaacagcaacgacgacaacggcgtgctgaacggcaactggagcgagaactacaccgacggcgccaaccccgccgagtggaccggcagcgtggccatcctgaagcagtggaacgccaccggctgccagcccgtgagatacggccagtgctgggtgttcgccgccgtgatgtgcaccgtgatgagatgcctgggcatccccaccagagtgatcaccaacttcgacagcggccacgacaccgacggcaacctgatcatcgacgagtactacgacaacaccggcagaatcctgggcaacaagaagaaggacaccatctggaacttccacgtgtggaacgagtgctggatggccagaaaggacctgccccccgcctacggcggctggcaggtgctggacgccaccccccaggagatgagcaacggcgtgtactgctgcggccccgccagcgtgagagccatcaaggagggcgaggtggacctgaactacgacacccccttcgtgttcagcatggtgaacgccgactgcatgagctggctggtgcagggcggcaaggagcagaagctgcaccaggacaccagcagcgtgggcaacttcatcagcaccaagagcatccagagcgacgagagagacgacatcaccgagaactacaagtacgaggagggcagcctgcaggagagacaggtgttcctgaaggccctgcagaagctgaaggccagaagcttccacggcagccagagaggcgccgagctgcagcccagcagacccaccagcctgagccaggacagccccagaagcctgcacacccccagcctgagacccagcgacgtggtgcaggtgagcctgaagttcaagctgctggacccccccaacatgggccaggacatctgcttcgtgctgctggccctgaacatgagcagccagttcaaggacctgaaggtgaacctgagcgcccagagcctgctgcacgacggcagccccctgagccccttctggcaggacaccgccttcatcaccctgagccccaaggaggccaagacctacccctgcaagatcagctacagccagtacagccagtacctgagcaccgacaagctgatcagaatcagcgccctgggcgaggagaagagcagccccgagaagatcctggtgaacaagatcatcaccctgagctaccccagcatcaccatcaacgtgctgggcgccgccgtggtgaaccagcccctgagcatccaggtgatcttcagcaaccccctgagcgagcaggtggaggactgcgtgctgaccgtggagggcagcggcctgttcaagaagcagcagaaggtgttcctgggcgtgctgaagccccagcaccaggccagcatcatcctggagaccgtgcccttcaagagcggccagagacagatccaggccaacatgagaagcaacaagttcaaggacatcaagggctacagaaacgtgtacgtggacttcgccctgtag

SEQ ID NO: 82554 - DNA, 1047 bp, Artificial Sequence
  Description of Artificial Sequence: Synthetic coding sequence
atgagcctggtggacctgggcaagaagctgctggaggccgccagagccggccaggacgacgaggtgagaatcctgatggccaacggcgcccccttcaccaccgactggctgggcaccagccccctgcacctggccgcccagtacggccactacagcaccaccgaggtgctgctgagagccggcgtgagcagagacgccagaaccaaggtggacagaacccccctgcacatggccgccagcgagggccacgccagcatcgtggaggtgctgctgaagcacggcgccgacgtgaacgccaaggacatgctgaagatgaccgccctgcactgggccaccgagcacaaccaccaggaggtggtggagctgctgatcaagtacggcgccgacgtgcacacccagagcaagttctgcaagaccgccttcgacatcagcatcgacaacggcaacgaggacctggccgagatcctgcagatcgccatgcagaaccagatcaacaccaaccccgagagccccgacaccgtgaccatccacgccgccaccccccagttcatcatcggccccggcggcgtggtgaacctgaccgacgagaccggcgtgagcgccgtgcagttcggcaacagcagcaccagcgtgctggccaccctggccgccctggccgaggccagcgcccccctgagcaacagcagcgagacccccgtggtggccaccgaggaggtggtgaccgccgagagcgtggacggcgccatccagcaggtggtgagcagcggcggccagcaggtgatcaccatcgtgaccgacggcatccagctgggcaacctgcacagcatccccaccagcggcatcggccagcccatcatcgtgaccatgcccgacggccagcaggtgctgaccgtgcccgccaccgacatcgccgaggagaccgtgatcagcgaggagccccccgccaagagacagtgcatcgagatcatcgagaacagagtggagagcgccgagatcgaggtgagaagcctgctgcccggcgtgctgtgcagaagccaccccaagtag

SEQ ID NO: 82555 - DNA, 1152 bp, Artificial Sequence
  Description of Artificial Sequence: Synthetic coding sequence
atgagcctggtggacctgggcaagaagctgctggaggccgccagagccggccaggacgacgaggtgagaatcctgatggccaacggcgcccccttcaccaccgactggctgggcaccagccccctgcacctggccgcccagtacggccactacagcaccaccgaggtgctgctgagagccggcgtgagcagagacgccagaaccaaggtggacagaacccccctgcacatggccgccagcgagggccacgccagcatcgtggaggtgctgctgaagcacggcgccgacgtgaacgccaaggacatgctgaagatgaccgccctgcactgggccaccgagcacaaccaccaggaggtggtggagctgctgatcaagtacggcgccgacgtgcacacccagagcaagttctgcaagaccgccttcgacatcagcatcgacaacggcaacgaggacctggccgagatcctgcagatcgccatgcagaaccagatcaacaccaaccccgagagccccgacaccgtgaccatccacgccgccaccccccagttcatcatcggccccggcggcgtggtgaacctgaccgacgagaccggcgtgagcgccgtgcagttcggcaacagcagcaccagcgtgctggccaccctggccgccctggccgaggccagcgcccccctgagcaacagcagcgagacccccgtggtggccaccgaggaggtggtgaccgccgagagcgtggacggcgccatccagcaggtggtgagcagcggcggccagcaggtgatcaccatcgtgaccgacggcatccagctgggcaacctgcacagcatccccaccagcggcatcggccagcccatcatcgtgaccatgcccgacggccagcaggtgctgaccgtgcccgccaccgacatcgccgaggagaccgtgatcagcgaggagccccccgccaagagacagtgcatcgagatcatcgagaacagagtggagagcgccgagatcgaggagagagaggccctgcagaagcagctggacgaggccaacagagaggcccagaagtacagacagcagctgctgaagaaggagcaggaggccgaggcctacagacagaagctggaggccatgaccagactgcagaccaacaaggaggccgtgtag

SEQ ID NO: 82556 - DNA, 1047 bp, Artificial Sequence; identical to SEQ ID NO: 82554
  Description of Artificial Sequence: Synthetic coding sequence

SEQ ID NO: 82557 - DNA, 1083 bp, Artificial Sequence
  Description of Artificial Sequence: Synthetic coding sequence
atgagcctggtggacctgggcaagaagctgctggaggccgccagagccggccaggacgacgaggtgagaatcctgatggccaacggcgcccccttcaccaccgactggctgggcaccagccccctgcacctggccgcccagtacggccactacagcaccaccgaggtgctgctgagagccggcgtgagcagagacgccagaaccaaggtggacagaacccccctgcacatggccgccagcgagggccacgccagcatcgtggaggtgctgctgaagcacggcgccgacgtgaacgccaaggacatgctgaagatgaccgccctgcactgggccaccgagcacaaccaccaggaggtggtggagctgctgatcaagtacggcgccgacgtgcacacccagagcaagttctgcaagaccgccttcgacatcagcatcgacaacggcaacgaggacctggccgagatcctgcagatcgccatgcagaaccagatcaacaccaaccccgagagccccgacaccgtgaccatccacgccgccaccccccagttcatcatcggccccggcggcgtggtgaacctgaccggcctggtgagcagcgagaacagcagcaaggccaccgacgagaccggcgtgagcgccgtgcagttcggcaacagcagcaccagcgtgctggccaccctggccgccctggccgaggccagcgcccccctgagcaacagcagcgagacccccgtggtggccaccgaggaggtggtgaccgccgagagcgtggacggcgccatccagcaggtggtgagcagcggcggccagcaggtgatcaccatcgtgaccgacggcatccagctgggcaacctgcacagcatccccaccagcggcatcggccagcccatcatcgtgaccatgcccgacggccagcaggtgctgaccgtgcccgccaccgacatcgccgaggagaccgtgatcagcgaggagccccccgccaagagacagtgcatcgagatcatcgagaacagagtggagagcgccgagatcgaggtgagaagcctgctgcccggcgtgctgtgcagaagccaccccaagtag

SEQ ID NO: 82558 - DNA, 270 bp, Artificial Sequence
  Description of Artificial Sequence: Synthetic coding sequence
atgagcctggtggacctgggcaagaagctgctggaggccgccagagccggccaggacgacgaggtgagaatcctgatggccaacggcgcccccttcaccaccgactggctgggcaccagccccctgcacctggccgcccagtacggccactacagcaccaccgaggtgctgctgagagccggcgtgagcagagacgccagaaccaaggtggacagaacccccctgcacatggccgccagcgagggccacgccagcatcgtggaggtgtag

SEQ ID NO: 82559 - DNA, 270 bp, Artificial Sequence; identical to SEQ ID NO: 82558
  Description of Artificial Sequence: Synthetic coding sequence

SEQ ID NO: 82560 - DNA, 354 bp, Artificial Sequence
  Description of Artificial Sequence: Synthetic coding sequence
atgaagttcgtgtacaaggaggagcaccccttcgagaagagaagaagcgagggcgagaagatcagaaagaagtaccccgacagagtgcccgtgatcgtggagaaggcccccaaggccagaatcggcgacctggacaagaagaagtacctggtgcccagcgacctgaccgtgggccagttctacttcctgatcagaaagagaatccacctgagagccgaggacgccctgttcttcttcgtgaacaacgtgatcccccccaccagcgccaccatgggccagctgtaccaggagcaccacgaggaggacttcttcctgtacatcgcctacagcgacgagagcgtgtacggcctgtag

SEQ ID NO: 82561 - DNA, 354 bp, Artificial Sequence
  Description of Artificial Sequence: Synthetic coding sequence
atgaagttccagtacaaggaggaccaccccttcgagtacagaaagaaggagggcgagaagatcagaaagaagtaccccgacagagtgcccgtgatcgtggagaaggcccccaaggccagagtgcccgacctggacaagagaaagtacctggtgcccagcgacctgaccgtgggccagttctacttcctgatcagaaagagaatccacctgagacccgaggacgccctgttcttcttcgtgaacaacaccatcccccccaccagcgccaccatgggccagctgtacgaggacaaccacgaggaggactacttcctgtacgtggcctacagcgacgagagcgtgtacggcaagtag

SEQ ID NO: 82562 - DNA, 441 bp, Artificial Sequence
  Description of Artificial Sequence: Synthetic coding sequence
atgaagttccagtacaaggaggaccaccccttcgagtacagaaagaaggagggcgagaagatcagaaagaagtaccccgacagagtgcccgtgatcgtggagaaggcccccaaggccagagtgcccgacctggacaagagaaagtacctggtgcccagcgacctgaccgtgggccagttctacttcctgatcagaaagagaatccacctgagacccgaggacgccctgttcttcttcgtgaacaacaccatcccccccaccagcgccaccatgggccagctgtacgaggtgatggtgctggtggcccagtactggatgcccagcagcgccgtgtggcaccccctggccctggtgctggacgccctgatcacccacctgagaagcggcgccgagggcgtgatctaccccgaccccctgacctacggcagcgtgagactgtag

SEQ ID NO: 82563 - DNA, 441 bp, Artificial Sequence; identical to SEQ ID NO: 82562
  Description of Artificial Sequence: Synthetic coding sequence

SEQ ID NO: 82564 - DNA, 213 bp, Artificial Sequence
  Description of Artificial Sequence: Synthetic coding sequence
atgaagttccagtacaaggaggaccaccccttcgagtacagaaagaaggagggcgagaagatcagaaagaagtaccccgacagagtgcccgtgatcgtggagaaggcccccaaggccagagtgcccgacctggacaagagaaagtacctggtgcccagcgacctgaccgtgggccagttctacttcctgatcagaaagagaatccacctgtag

SEQ ID NO: 82565 - DNA, 354 bp, Artificial Sequence; identical to SEQ ID NO: 82561
  Description of Artificial Sequence: Synthetic coding sequence

SEQ ID NO: 82566 - DNA, 354 bp, Artificial Sequence
  Description of Artificial Sequence: Synthetic coding sequence
atgaagtggatgttcaaggaggaccacagcctggagcacagatgcgtggagagcgccaagatcagagccaagtaccccgacagagtgcccgtgatcgtggagaaggtgagcggcagccagatcgtggacatcgacaagagaaagtacctggtgcccagcgacatcaccgtggcccagttcatgtggatcatcagaaagagaatccagctgcccagcgagaaggccatcttcctgttcgtggacaagaccgtgccccagagcagcctgaccatgggccagctgtacgagaaggagaaggacgaggacggcttcctgtacgtggcctacagcggcgagaacaccttcggcttctag

SEQ ID NO: 82567 - DNA, 1344 bp, Artificial Sequence
  Description of Artificial Sequence: Synthetic coding sequence
atgcccgtgctgtacgacagactgctgaagctgaaggagatgttcaacagcaagttcggcagcatccccaagttctacgtgagagcccccggcagagtgaacatcatcggcgagcacatcgactactgcggctacagcgtgctgcccatggccgtggagcaggacgtgctgatcgccgtggagcccgtgaagacctacgccctgcagctggccaacaccaaccccctgtaccccgacttcagcaccagcgccaacaacatccagatcgacaagaccaagcccctgtggcacaactacttcctgtgcggcctgaagggcatccaggagcacttcggcctgagcaacctgaccggcatgaactgcctggtggacggcaacatcccccccagcagcggcctgagcagcagcagcgccctggtgtgctgcgccggcctggtgaccctgaccgtgctgggcagaaacctgagcaaggtggagctggccgagatctgcgccaagagcgagagatacatcggcaccgagggcggcggcatggaccagagcatcagcttcctggccgaggagggcaccgccaagctgatcgagttcagccccctgagagccaccgacgtgaagctgcccagcggcgccgtgttcgtgatcgccaacagctgcgtggagatgaacaaggccgccaccagccacttcaacatcagagtgatggagtgcagactggccgccaagctgctggccaagtacaagagcctgcagtgggacaaggtgctgagactggaggaggtgcaggccaagctgggcatcagcctggaggagatgctgctggtgaccgaggacgccctgcaccccgagccctacaaccccgaggagatctgcagatgcctgggcatcagcctggaggagctgagaacccagatcctgagccccaacacccaggacgtgctgatcttcaagctgtaccagagagccaagcacgtgtacagcgaggccgccagagtgctgcagttcaagaagatctgcgaggaggcccccgagaacatggtgcagctgctgggcgagctgatgaaccagagccacatgagctgcagagacatgtacgagtgcagctgccccgagctggaccagctggtggacatctgcagaaagttcggcgcccagggcagcagactgaccggcgccggctggggcggctgcaccgtgagcatggtgcccgccgacaagctgcccagcttcctggccaacgtgcacaaggcctactaccagagaagcgacggcagcctggcccccgagaagcagagcctgttcgccaccaagcccggcggcggcgccctggtgctgctggaggcctag

SEQ ID NO: 82568 - DNA, 1305 bp, Artificial Sequence
  Description of Artificial Sequence: Synthetic coding sequence
atgttcaacagcaagttcggcagcatccccaagttctacgtgagagcccccggcagagtgaacatcatcggcgagcacatcgactactgcggctacagcgtgctgcccatggccgtggagcaggacgtgctgatcgccgtggagcccgtgaagacctacgccctgcagctggccaacaccaaccccctgtaccccgacttcagcaccagcgccaacaacatccagatcgacaagaccaagcccctgtggcacaactacttcctgtgcggcctgaagggcatccaggagcacttcggcctgagcaacctgaccggcatgaactgcctggtggacggcaacatcccccccagcagcggcctgagcagcagcagcgccctggtgtgctgcgccggcctggtgaccctgaccgtgctgggcagaaacctgagcaaggtggagctggccgagatctgcgccaagagcgagagatacatcggcaccgagggcggcggcatggaccagagcatcagcttcctggccgaggagggcaccgccaagctgatcgagttcagccccctgagagccaccgacgtgaagctgcccagcggcgccgtgttcgtgatcgccaacagctgcgtggagatgaacaaggccgccaccagccacttcaacatcagagtgatggagtgcagactggccgccaagctgctggccaagtacaagagcctgcagtgggacaaggtgctgagactggaggaggtgcaggccaagctgggcatcagcctggaggagatgctgctggtgaccgaggacgccctgcaccccgagccctacaaccccgaggagatctgcagatgcctgggcatcagcctggaggagctgagaacccagatcctgagccccaacacccaggacgtgctgatcttcaagctgtaccagagagccaagcacgtgtacagcgaggccgccagagtgctgcagttcaagaagatctgcgaggaggcccccgagaacatggtgcagctgctgggcgagctgatgaaccagagccacatgagctgcagagacatgtacgagtgcagctgccccgagctggaccagctggtggacatctgcagaaagttcggcgcccagggcagcagactgaccggcgccggctggggcggctgcaccgtgagcatggtgcccgccgacaagctgcccagcttcctggccaacgtgcacaaggcctactaccagagaagcgacggcagcctggcccccgagaagcagagcctgttcgccaccaagcccggcggcggcgccctggtgctgctggaggcctag

SEQ ID NO: 82569 - DNA, 624 bp, Artificial Sequence
  Description of Artificial Sequence: Synthetic coding sequence
atgaactgcctggtggacggcaacatcccccccagcagcggcctgagcagcagcagcgccctggtgtgctgcgccggcctggtgaccctgaccgtgctgggcagaaacctgagcaaggtggagctggccgagatctgcgccaagagcgagagatacatcggcaccgagggcggcggcatggaccagagcatcagcttcctggccgaggagggcaccgccaagctgatcgagttcagccccctgagagccaccgacgtgaagctgcccagcggcgccgtgttcgtgatcgccaacagctgcgtggagatgaacaaggccgccaccagccacttcaacatcagagtgatggagtgcagactggccgccaagctgctggccaagtacaagagcctgcagtgggacaaggtgctgagactggaggaggtgcaggccaagctgggcatcagcctggaggagatgctgctggtgaccgaggacgccctgcaccccgagccctacaaccccgaggagatctgcagatgcctgggcatcagcctggaggagctgagaacccagatcctgagccccaacacccaggacgacggcgtggtgctgtacagacccggctggagcgccaccgcctag

SEQ ID NO: 82570 - DNA, 1305 bp, Artificial Sequence; identical to SEQ ID NO: 82568
  Description of Artificial Sequence: Synthetic coding sequence

SEQ ID NO: 82571 - DNA, 1305 bp, Artificial Sequence; identical to SEQ ID NO: 82568
  Description of Artificial Sequence: Synthetic coding sequence

SEQ ID NO: 82572 - DNA, 1377 bp, Artificial Sequence
  Description of Artificial Sequence: Synthetic coding sequence
atggccaccgagagccccgccaccagaagagtgcaggtggccgagcaccccagactgctgaagctgaaggagatgttcaacagcaagttcggcagcatccccaagttctacgtgagagcccccggcagagtgaacatcatcggcgagcacatcgactactgcggctacagcgtgctgcccatggccgtggagcaggacgtgctgatcgccgtggagcccgtgaagacctacgccctgcagctggccaacaccaaccccctgtaccccgacttcagcaccagcgccaacaacatccagatcgacaagaccaagcccctgtggcacaactacttcctgtgcggcctgaagggcatccaggagcacttcggcctgagcaacctgaccggcatgaactgcctggtggacggcaacatcccccccagcagcggcctgagcagcagcagcgccctggtgtgctgcgccggcctggtgaccctgaccgtgctgggcagaaacctgagcaaggtggagctggccgagatctgcgccaagagcgagagatacatcggcaccgagggcggcggcatggaccagagcatcagcttcctggccgaggagggcaccgccaagctgatcgagttcagccccctgagagccaccgacgtgaagctgcccagcggcgccgtgttcgtgatcgccaacagctgcgtggagatgaacaaggccgccaccagccacttcaacatcagagtgatggagtgcagactggccgccaagctgctggccaagtacaagagcctgcagtgggacaaggtgctgagactggaggaggtgcaggccaagctgggcatcagcctggaggagatgctgctggtgaccgaggacgccctgcaccccgagccctacaaccccgaggagatctgcagatgcctgggcatcagcctggaggagctgagaacccagatcctgagccccaacacccaggacgtgctgatcttcaagctgtaccagagagccaagcacgtgtacagcgaggccgccagagtgctgcagttcaagaagatctgcgaggaggcccccgagaacatggtgcagctgctgggcgagctgatgaaccagagccacatgagctgcagagacatgtacgagtgcagctgccccgagctggaccagctggtggacatctgcagaaagttcggcgcccagggcagcagactgaccggcgccggctggggcggctgcaccgtgagcatggtgcccgccgacaagctgcccagcttcctggccaacgtgcacaaggcctactaccagagaagcgacggcagcctggcccccgagaagcagagcctgttcgccaccaagcccggcggcggcgccctggtgctgctggaggcctag

SEQ ID NO: 82573 - DNA, 1272 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagaagcacagactgaagttcgccttccccaacggcagaaacgacttcgactaccccaccttcttcgccagaagcctggtgcaggactacagacccggcgcctgcttcaacatcatctgcaaccacatgagattccactacgacgaggtgagaggcctggtgcccaccaacgccatcttcatcaccgtgctgagagaccccgccagactgttcgagagcagcttccactacttcggccccgtggtgcccctgacctggaagctgagcgccggcgacaagctgaccgagttcctgcaggaccccgacagatactacgaccccaacggcttcaacgcccactacctgagaaacctgctgttcttcgacctgggctacgacaacagcctggaccccagcagcccccaggtgcaggagcacatcctggaggtggagagaagattccacctggtgctgctgcaggagtacttcgacgagagcctggtgctgctgaaggacctgctgtgctgggagctggaggacgtgctgtacttcaagctgaacgccagaagagacagccccgtgcccagactgagcggcgagctgtacggcagagccaccgcctggaacatgctggacagccacctgtacagacacttcaacgccagcttctggagaaaggtggaggccttcggcagagagagaatggccagagaggtggccgccctgagacacgccaacgagagaatgagaaccatctgcatcgacggcggccacgccgtggacgccgccgccatccaggacgaggccatgcagccctggcagcccctgggcaccaagagcatcctgggctacaacctgaagaagagcatcggccagagacacgcccagctgtgcagaagaatgctgacccccgagatccagtacctgatggacctgggcgccaacctgtgggtgaccaagctgtggaagttcatcagagacttcctgagatggtag

SEQ ID NO: 82574 - DNA, 1272 bp, Artificial Sequence; identical to SEQ ID NO: 82573
  Description of Artificial Sequence: Synthetic coding sequence

SEQ ID NO: 82575 - DNA, 1272 bp, Artificial Sequence; identical to SEQ ID NO: 82573
  Description of Artificial Sequence: Synthetic coding sequence

SEQ ID NO: 82576 - DNA, 1272 bp, Artificial Sequence; identical to SEQ ID NO: 82573
  Description of Artificial Sequence: Synthetic coding sequence

SEQ ID NO: 82577 - DNA, 1272 bp, Artificial Sequence; identical to SEQ ID NO: 82573
  Description of Artificial Sequence: Synthetic coding sequence

SEQ ID NO: 82578 - DNA, 1272 bp, Artificial Sequence; identical to SEQ ID NO: 82573
  Description of Artificial Sequence: Synthetic coding sequence

SEQ ID NO: 82579 - DNA, 258 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagtag

SEQ ID NO: 82580 - DNA, 513 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagaagcacagactgaagttcgccttccccaacggcagaaacgacttcgactaccccaccttcttcgccagaagcctggtgcaggactacagacccggcgcctgcttcaacatcatctgcaaccacatgagattccactacgacgaggtgagaggcctggtgcccaccaacgccatcttcatcaccgtgctgagagaccccgccagactgttctag

SEQ ID NO: 82581 - DNA, 450 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagaagcacagactgaagttcgccttccccaacggcagaaacgacttcgactaccccaccttcttcgccagaagcctggtgcaggactacagacccggcgcctgcttcaacatcatctgcaaccacatgagattccactacgacgaggtgtag

SEQ ID NO: 82582 - DNA, 300 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggctag

SEQ ID NO: 82583 - DNA, 312 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagaagcacagatag

SEQ ID NO: 82584 - DNA, 600 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagaagcacagactgaagttcgccttccccaacggcagaaacgacttcgactaccccaccttcttcgccagaagcctggtgcaggactacagacccggcgcctgcttcaacatcatctgcaaccacatgagattccactacgacgaggtgagaggcctggtgcccaccaacgccatcttcatcaccgtgctgagagaccccgccagactgttcgagagcagcttccactacttcggccccgtggtgcccctgacctggaagctgagcgccggcgacaagctgaccgagttcctgcaggactag

SEQ ID NO: 82585 - DNA, 840 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagaagcacagactgaagttcgccttccccaacggcagaaacgacttcgactaccccaccttcttcgccagaagcctggtgcaggactacagacccggcgcctgcttcaacatcatctgcaaccacatgagattccactacgacgaggtgagaggcctggtgcccaccaacgccatcttcatcaccgtgctgagagaccccgccagactgttcgagagcagcttccactacttcggccccgtggtgcccctgacctggaagctgagcgccggcgacaagctgaccgagttcctgcaggaccccgacagatactacgaccccaacggcttcaacgcccactacctgagaaacctgctgttcttcgacctgggctacgacaacagcctggaccccagcagcccccaggtgcaggagcacatcctggaggtggagagaagattccacctggtgctgctgcaggagtacttcgacgagagcctggtgctgctgaaggacctgctgtgctgggagctggaggacgtgctgtacttcaagctgaactag

SEQ ID NO: 82586 - DNA, 1272 bp, Artificial Sequence; identical to SEQ ID NO: 82573
  Description of Artificial Sequence: Synthetic coding sequence

SEQ ID NO: 82587 - DNA, 432 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagaagcacagactgaagttcgccttccccaacggcagaaacgacttcgactaccccaccttcttcgccagaagcctggtgcaggactacagacccggcgcctgcttcaacatcatctgcaaccacatgagatag

SEQ ID NO: 82588 - DNA, 231 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagatag

SEQ ID NO: 82589 - DNA, 288 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgtag

SEQ ID NO: 82590 - DNA, 216 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtag

SEQ ID NO: 82591 - DNA, 729 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagaagcacagactgaagttcgccttccccaacggcagaaacgacttcgactaccccaccttcttcgccagaagcctggtgcaggactacagacccggcgcctgcttcaacatcatctgcaaccacatgagattccactacgacgaggtgagaggcctggtgcccaccaacgccatcttcatcaccgtgctgagagaccccgccagactgttcgagagcagcttccactacttcggccccgtggtgcccctgacctggaagctgagcgccggcgacaagctgaccgagttcctgcaggaccccgacagatactacgaccccaacggcttcaacgcccactacctgagaaacctgctgttcttcgacctgggctacgacaacagcctggaccccagcagcccccaggtgcaggagcacatcctggaggtgtag

SEQ ID NO: 82592 - DNA, 303 bp, Artificial Sequence
  Description of Artificial Sequence: Synthetic coding sequence
atgctgcccccccagaagaagccctgggagagcatggccaagggcctggtgctgggcgccctgttcaccagcttcctgctgctggtgtacagctacgccgtgccccccctgcacgccggcctggccagcaccacccccgaggccgccgccagctgcagcccccccgccctggagcccgaggccgtgatcagagccaacggcagcgccggcgagtgccagcccagaagaaacatcgtgttcctgaagacccacaagaccgccagcagcaccctgctgaacatcctgttcagattcggccagtag

SEQ ID NO: 82593 - DNA, 1197 bp, Artificial Sequence
  Description of Artificial Sequence: Synthetic coding sequence
atgatgagcatgctgggcggcctgcagagatacttcagagtgatcctgctgctgctgctggccctgaccctgctgctgctggccggcttcctgcacagcgacctggagctggacacccccctgttcggcggccaggccgagggcccccccgtgaccaacatcatgttcctgaagacccacaagaccgccagcagcaccgtgctgaacatcctgtacagattcgccgagacccacaacctgagcgtggccctgcccgccggcagcagagtgcacctgggctacccctggctgttcctggccagatacgtggagggcgtgggcagccagcagagattcaacatcatgtgcaaccacctgagattcaacctgccccaggtgcagaaggtgatgcccaacgacaccttctacttcagcatcctgagaaaccccgtgttccagctggagagcagcttcatctactacaagacctacgcccccgccttcagaggcgcccccagcctggacgccttcctggccagccccagaaccttctacaacgacagcagacacctgagaaacgtgtacgccaagaacaacatgtggttcgacttcggcttcgaccccaacgcccagtgcgaggagggctacgtgagagccagaatcgccgaggtggagagaagattcagactggtgctgatcgccgagcacctggacgagagcctggtgctgctgagaagaagactgagatgggccctggacgacgtggtggccttcagactgaacagcagaagcgccagaagcgtggccagactgagccccgagaccagagagagagccagaagctggtgcgccctggactggagactgtacgagcacttcaacagaaccctgtgggcccagctgagagccgagctgggccccagaagactgagaggcgaggtggagagactgagagccagaagaagagagctggccagcctgtgcctgcaggacggcggcgccctgaagaaccacacccagatcagagaccccagactgagaccctaccagagcggcaaggccgacatcctgggctacaacctgagacccggcctggacaaccagaccctgggcgtgtgccagagactggtgatgcccgagctgcagtacatggccagactgtacgccctgcagttccccgagaagcccctgaagaacatccccttcctgggcgcctag

SEQ ID NO: 82594 - DNA, 1296 bp, Artificial Sequence
  Description of Artificial Sequence: Synthetic coding sequence
atgccccccatcctgcagagactgcagcaggccaccaagatgatgagcagaagaaagatcctgctgctggtgctgggctgcagcaccgtgagcctgctgatccaccagggcgcccagctgagctggtaccccaagctgttccccctgagctgcccccccctgagaaacagcccccccagacccaagcacatgaccgtggccttcctgaagacccacaagaccgccggcaccaccgtgcagaacatcctgttcagattcgccgagagacacaacctgaccgtggccctgccccaccccagctgcgagcaccagttctgctaccccagaaacttcagcgcccacttcgtgcaccccgccaccagacccccccacgtgctggccagccacctgagattcgacagagccgagctggagagactgatgccccccagcaccgtgtacgtgaccatcctgagagagcccgccgccatgttcgagagcctgttcagctactacaaccagtactgccccgccttcagaagagtgcccaacgccagcctggaggccttcctgagagcccccgaggcctactacagagccggcgagcacttcgccatgttcgcccacaacaccctggcctacgacctgggcggcgacaacgagagaagccccagagacgacgccgcctacctggccggcctgatcagacaggtggaggaggtgttcagcctggtgatgatcgccgagtacttcgacgagagcctggtgctgctgagaagactgctggcctgggacctggacgacgtgctgtacgccaagctgaacgccagagccgccagcagcagactggccgccatccccgccgccctggccagagccgccagaacctggaacgccctggacgccggcctgtacgaccacttcaacgccaccttctggagacacgtggccagagccggcagagcctgcgtggagagagaggccagagagctgagagaggccagacagagactgctgagaagatgcttcggcgacgagcccctgctgagacccgccgcccagatcagaaccaagcagctgcagccctggcagcccagcagaaaggtggacatcatgggctacgacctgcccggcggcggcgccggccccgccaccgaggcctgcctgaagctggccatgcccgaggtgcagtacagcaactacctgctgagaaagcagaagagaagaggcggcgccagagccagacccgagcccgtgctggacaaccccccccccagacccatcagagtgctgcccagaggcccccagggcccctag

SEQ ID NO: 82595 - DNA, 1296 bp, Artificial Sequence; identical to SEQ ID NO: 82594
  Description of Artificial Sequence: Synthetic coding sequence

SEQ ID NO: 82596 - DNA, 1461 bp, Artificial Sequence
  Description of Artificial Sequence: Synthetic coding sequence
atgggccccctgagccccgccagaaccctgagactgtggggccccagaagcctgggcgtggccctgggcgtgttcatgaccatcggcttcgccctgcagctgctgggcggccccttccagagaagactgcccggcctgcagctgagacagcccagcgcccccagcctgagacccgccctgcccagctgcccccccagacagagactggtgttcctgaagacccacaagagcggcagcagcagcgtgctgagcctgctgcacagatacggcgaccagcacggcctgagattcgccctgcccgccagataccagttcggctaccccaagctgttccaggccagcagagtgaagggctacagaccccagggcggcggcacccagctgcccttccacatcctgtgccaccacatgagattcaacctgaaggaggtgctgcaggtgatgcccagcgacagcttcttcttcagcatcgtgagagaccccgccgccctggccagaagcgccttcagctactacaagagcaccagcagcgccttcagaaagagccccagcctggccgccttcctggccaaccccagaggcttctacagacccggcgccagaggcgaccactacgccagaaacctgctgtggttcgacttcggcctgcccttcccccccgagaagagagccaagagaggcaacatccacccccccagagaccccaaccccccccagctgcaggtgctgcccagcggcgccggccccagagcccagaccctgaaccccaacgccctgatccaccccgtgagcaccgtgaccgaccacagaagccagatcagcagccccgccagcttcgacctgggcagcagcagcttcatccagtggggcctggcctggctggacagcgtgttcgacctggtgatggtggccgagtacttcgacgagagcctggtgctgctggccgacgccctgtgctggggcctggacgacgtggtgggcttcatgcacaacgcccaggccggccacaagcagggcctgagcaccgtgagcaacagcggcctgaccgccgaggacagacagctgaccgccagagccagagcctggaacaacctggactgggccctgtacgtgcacttcaacagaagcctgtgggccagaatcgagaagtacggccagggcagactgcagaccgccgtggccgagctgagagccagaagagaggccctggccaagcactgcctggtgggcggcgaggccagcgaccccaagtacatcaccgacagaagattcagacccttccagttcggcagcgccaaggtgctgggctacatcctgagaagcggcctgagcccccaggaccaggaggagtgcgagagactggccacccccgagctgcagtacaaggacaagctggacgccaagcagttcccccccaccgtgagcctgcccctgaagaccagcagacccctgagcccctag

SEQ ID NO: 82597 - DNA, 1461 bp, Artificial Sequence; identical to SEQ ID NO: 82596
  Description of Artificial Sequence: Synthetic coding sequence

SEQ ID NO: 82598 - DNA, 1275 bp, Artificial Sequence
  Description of Artificial Sequence: Synthetic coding sequence
atgacccccagaagccccaccagcgccttcagaagctgcaccgccgtgagcagctgcctgtgccccagcagctggccctggctgcacctgagcgtgaccagccccttccccgtgccccacggccccagcctgagctgccaggacgccgccgccctgggcaccagcgagcccggcggcggcagcggcagcctgcacgaccactggctgtgcacccccgccctgggcagagccctgcccgaggaggtgctgcaggtgatgcccagcgacagcttcttcttcagcatcgtgagagaccccgccgccctggccagaagcgccttcagctactacaagagcaccagcagcgccttcagaaagagccccagcctggccgccttcctggccaaccccagaggcttctacagacccggcgccagaggcgaccactacgccagaaacctgctgtggttcgacttcggcctgcccttcccccccgagaagagagccaagagaggcaacatccacccccccagagaccccaaccccccccagctgcaggtgctgcccagcggcgccggccccagagcccagaccctgaaccccaacgccctgatccaccccgtgagcaccgtgaccgaccacagaagccagatcagcagccccgccagcttcgacctgggcagcagcagcttcatccagtggggcctggcctggctggacagcgtgttcgacctggtgatggtggccgagtacttcgacgagagcctggtgctgctggccgacgccctgtgctggggcctggacgacgtggtgggcttcatgcacaacgcccaggccggccacaagcagggcctgagcaccgtgagcaacagcggcctgaccgccgaggacagacagctgaccgccagagccagagcctggaacaacctggactgggccctgtacgtgcacttcaacagaagcctgtgggccagaatcgagaagtacggccagggcagactgcagaccgccgtggccgagctgagagccagaagagaggccctggccaagcactgcctggtgggcggcgaggccagcgaccccaagtacatcaccgacagaagattcagacccttccagttcggcagcgccaaggtgctgggctacatcctgagaagcggcctgagcccccaggaccaggaggagtgcgagagactggccacccccgagctgcagtacaaggacaagctggacgccaagcagttcccccccaccgtgagcctgcccctgaagaccagcagacccctgagcccctag

SEQ ID NO: 82599 - DNA, 1641 bp, Artificial Sequence
  Description of Artificial Sequence: Synthetic coding sequence
atgcccggcttcctggtgagaatcctgcccctgctgctggtgctgctgctgctgggccccaccagaggcctgagaaacgccacccagagaatgttcgagatcgactacagcagagacagcttcctgaaggacggccagcccttcagatacatcagcggcagcatccactacagcagagtgcccagattctactggaaggacagactgctgaagatgaagatggccggcctgaacgccatccagaccctgcccggcagctgcggccaggtggtgggcagccccagcgcccaggacgaggccagccccctgagcgagtggagagccagctacaacagcgccggcagcaacatcaccgacgccttcctgagccagagaaagtgcgagcccaagggccccctgatcaacagcgagttctacaccggctggctggaccactggggccagccccacagcaccatcaagaccgaggccgtggccagcagcctgtacgacatcctggccagaggcgccagcgtgaacctgtacatgttcatcggcggcaccaacttcgcctactggaacggcgccaacagcccctacgccgcccagcccaccagctacgactacgacgcccccctgagcgaggccggcgacctgaccgagaagtacttcgccctgagaaacatcatccagaagttcgagaaggtgcccgagggccccatcccccccagcacccccaagttcgcctacggcaaggtgaccctggagaagctgaagaccgtgggcgccgccctggacatcctgtgccccagcggccccatcaagagcctgtaccccctgaccttcatccaggtgaagcagcactacggcttcgtgctgtacagaaccaccctgccccaggactgcagcaaccccgcccccctgagcagccccctgaacggcgtgcacgacagagcctacgtggccgtggacggcatcccccagggcgtgctggagagaaacaacgtgatcaccctgaacatcaccggcaaggccggcgccaccctggacctgctggtggagaacatgggcagagtgaactacggcgcctacatcaacgacttcaagggcctggtgagcaacctgaccctgagcagcaacatcctgaccgactggaccatcttccccctggacaccgaggacgccgtgtgcagccacctgggcggctggggccacagagacagcggccaccacgacgaggcctgggcccacaacagcagcaactacaccctgcccgccttctacatgggcaacttcagcatccccagcggcatccccgacctgccccaggacaccttcatccagttccccggctggaccaagggccaggtgtggatcaacggcttcaacctgggcagatactggcccgccagaggcccccagctgaccctgttcgtgccccagcacatcctgatgaccagcgcccccaacaccatcaccgtgctggagctggagtgggccccctgcagcagcgacgaccccgagctgtgcgccgtgaccttcgtggacagacccgtgatcggcagcagcgtgacctacgaccaccccagcaagcccgtggagaagagactgatgcccccccccccccagaagaacaaggacagctggctggaccacgtgtag

SEQ ID NO: 82600 - DNA, 1944 bp, Artificial Sequence
  Description of Artificial Sequence: Synthetic coding sequence
atgttcgagatcgactacagcagagacagcttcctgaaggacggccagcccttcagatacatcagcggcagcatccactacagcagagtgcccagattctactggaaggacagactgctgaagatgaagatggccggcctgaacgccatccagacctacgtgccctggaacttccacgagccctggcccggccagtaccagttcagcgaggaccacgacgtggagtacttcctgagactggcccacgagctgggcctgctggtgatcctgagacccggcccctacatctgcgccgagtgggagatgggcggcctgcccgcctggctgctggagaaggagagcatcctgctgagaagcagcgaccccgactacctggccgccgtggacaagtggctgggcgtgctgctgcccaagatgaagcccctgctgtaccagaacggcggccccgtgatcaccgtgcaggtggagaacgagtacggcagctacttcgcctgcgacttcgactacctgagattcctgcagaagagattcagacaccacctgggcgacgacgtggtgctgttcaccaccgacggcgcccacaagaccttcctgaagtgcggcgccctgcagggcctgtacaccaccgtggacttcggcaccggcagcaacatcaccgacgccttcctgagccagagaaagtgcgagcccaagggccccctgatcaacagcgagttctacaccggctggctggaccactggggccagccccacagcaccatcaagaccgaggccgtggccagcagcctgtacgacatcctggccagaggcgccagcgtgaacctgtacatgttcatcggcggcaccaacttcgcctactggaacggcgccaacagcccctacgccgcccagcccaccagctacgactacgacgcccccctgagcgaggccggcgacctgaccgagaagtacttcgccctgagaaacatcatccagaagttcgagaaggtgcccgagggccccatcccccccagcacccccaagttcgcctacggcaaggtgaccctggagaagctgaagaccgtgggcgccgccctggacatcctgtgccccagcggccccatcaagagcctgtaccccctgaccttcatccaggtgaagcagcactacggcttcgtgctgtacagaaccaccctgccccaggactgcagcaaccccgcccccctgagcagccccctgaacggcgtgcacgacagagcctacgtggccgtggacggcatcccccagggcgtgctggagagaaacaacgtgatcaccctgaacatcaccggcaaggccggcgccaccctggacctgctggtggagaacatgggcagagtgaactacggcgcctacatcaacgacttcaagggcctggtgagcaacctgaccctgagcagcaacatcctgaccgactggaccatcttccccctggacaccgaggacgccgtgtgcagccacctgggcggctggggccacagagacagcggccaccacgacgaggcctgggcccacaacagcagcaactacaccctgcccgccttctacatgggcaacttcagcatccccagcggcatccccgacctgccccaggacaccttcatccagttccccggctggaccaagggccaggtgtggatcaacggcttcaacctgggcagatactggcccgccagaggcccccagctgaccctgttcgtgccccagcacatcctgatgaccagcgcccccaacaccatcaccgtgctggagctggagtgggccccctgcagcagcgacgaccccgagctgtgcgccgtgaccttcgtggacagacccgtgatcggcagcagcgtgacctacgaccaccccagcaagcccgtggagaagagactgatgcccccccccccccagaagaacaaggacagctggctggaccacgtgtag

SEQ ID NO: 82601 - DNA, 2034 bp, Artificial Sequence
  Description of Artificial Sequence: Synthetic coding sequence
atgcccggcttcctggtgagaatcctgcccctgctgctggtgctgctgctgctgggccccaccagaggcctgagaaacgccacccagagaatgttcgagatcgactacagcagagacagcttcctgaaggacggccagcccttcagatacatcagcggcagcatccactacagcagagtgcccagattctactggaaggacagactgctgaagatgaagatggccggcctgaacgccatccagacctacgtgccctggaacttccacgagccctggcccggccagtaccagttcagcgaggaccacgacgtggagtacttcctgagactggcccacgagctgggcctgctggtgatcctgagacccggcccctacatctgcgccgagtgggagatgggcggcctgcccgcctggctgctggagaaggagagcatcctgctgagaagcagcgaccccgactacctggccgccgtggacaagtggctgggcgtgctgctgcccaagatgaagcccctgctgtaccagaacggcggccccgtgatcaccgtgcaggtggagaacgagtacggcagctacttcgcctgcgacttcgactacctgagattcctgcagaagagattcagacaccacctgggcgacgacgtggtgctgttcaccaccgacggcgcccacaagaccttcctgaagtgcggcgccctgcagggcctgtacaccaccgtggacttcggcaccggcagcaacatcaccgacgccttcctgagccagagaaagtgcgagcccaagggccccctgatcaacagcgagttctacaccggctggctggaccactggggccagccccacagcaccatcaagaccgaggccgtggccagcagcctgtacgacatcctggccagaggcgccagcgtgaacctgtacatgttcatcggcggcaccaacttcgcctactggaacggcgccaacagcccctacgccgcccagcccaccagctacgactacgacgcccccctgagcgaggccggcgacctgaccgagaagtacttcgccctgagaaacatcatccagaagttcgagaaggtgcccgagggccccatcccccccagcacccccaagttcgcctacggcaaggtgaccctggagaagctgaagaccgtgggcgccgccctggacatcctgtgccccagcggccccatcaagagcctgtaccccctgaccttcatccaggtgaagcagcactacggcttcgtgctgtacagaaccaccctgccccaggactgcagcaaccccgcccccctgagcagccccctgaacggcgtgcacgacagagcctacgtggccgtggacggcatcccccagggcgtgctggagagaaacaacgtgatcaccctgaacatcaccggcaaggccggcgccaccctggacctgctggtggagaacatgggcagagtgaactacggcgcctacatcaacgacttcaagggcctggtgagcaacctgaccctgagcagcaacatcctgaccgactggaccatcttccccctggacaccgaggacgccgtgtgcagccacctgggcggctggggccacagagacagcggccaccacgacgaggcctgggcccacaacagcagcaactacaccctgcccgccttctacatgggcaacttcagcatccccagcggcatccccgacctgccccaggacaccttcatccagttccccggctggaccaagggccaggtgtggatcaacggcttcaacctgggcagatactggcccgccagaggcccccagctgaccctgttcgtgccccagcacatcctgatgaccagcgcccccaacaccatcaccgtgctggagctggagtgggccccctgcagcagcgacgaccccgagctgtgcgccgtgaccttcgtggacagacccgtgatcggcagcagcgtgacctacgaccaccccagcaagcccgtggagaagagactgatgcccccccccccccagaagaacaaggacagctggctggaccacgtgtag

SEQ ID NO: 82602 - DNA, 2178 bp, Artificial Sequence
  Description of Artificial Sequence: Synthetic coding sequence
atgcccggcttcctggtgagaatcctgcccctgctgctggtgctgctgctgctgggccccaccagaggcctgagaagcagattcctgccctgggccttccacctgcccagacaggcccccaagagccagctgcccctgcacaagagaggcaccaagaccgcccccaacgagcacgccagcagcaacagaagcggcagaagaagaagaagacagcagtggaacgccacccagagaatgttcgagatcgactacagcagagacagcttcctgaaggacggccagcccttcagatacatcagcggcagcatccactacagcagagtgcccagattctactggaaggacagactgctgaagatgaagatggccggcctgaacgccatccagacctacgtgccctggaacttccacgagccctggcccggccagtaccagttcagcgaggaccacgacgtggagtacttcctgagactggcccacgagctgggcctgctggtgatcctgagacccggcccctacatctgcgccgagtgggagatgggcggcctgcccgcctggctgctggagaaggagagcatcctgctgagaagcagcgaccccgactacctggccgccgtggacaagtggctgggcgtgctgctgcccaagatgaagcccctgctgtaccagaacggcggccccgtgatcaccgtgcaggtggagaacgagtacggcagctacttcgcctgcgacttcgactacctgagattcctgcagaagagattcagacaccacctgggcgacgacgtggtgctgttcaccaccgacggcgcccacaagaccttcctgaagtgcggcgccctgcagggcctgtacaccaccgtggacttcggcaccggcagcaacatcaccgacgccttcctgagccagagaaagtgcgagcccaagggccccctgatcaacagcgagttctacaccggctggctggaccactggggccagccccacagcaccatcaagaccgaggccgtggccagcagcctgtacgacatcctggccagaggcgccagcgtgaacctgtacatgttcatcggcggcaccaacttcgcctactggaacggcgccaacagcccctacgccgcccagcccaccagctacgactacgacgcccccctgagcgaggccggcgacctgaccgagaagtacttcgccctgagaaacatcatccagaagttcgagaaggtgcccgagggccccatcccccccagcacccccaagttcgcctacggcaaggtgaccctggagaagctgaagaccgtgggcgccgccctggacatcctgtgccccagcggccccatcaagagcctgtaccccctgaccttcatccaggtgaagcagcactacggcttcgtgctgtacagaaccaccctgccccaggactgcagcaaccccgcccccctgagcagccccctgaacggcgtgcacgacagagcctacgtggccgtggacggcatcccccagggcgtgctggagagaaacaacgtgatcaccctgaacatcaccggcaaggccggcgccaccctggacctgctggtggagaacatgggcagagtgaactacggcgcctacatcaacgacttcaagggcctggtgagcaacctgaccctgagcagcaacatcctgaccgactggaccatcttccccctggacaccgaggacgccgtgtgcagccacctgggcggctggggccacagagacagcggccaccacgacgaggcctgggcccacaacagcagcaactacaccctgcccgccttctacatgggcaacttcagcatccccagcggcatccccgacctgccccaggacaccttcatccagttccccggctggaccaagggccaggtgtggatcaacggcttcaacctgggcagatactggcccgccagaggcccccagctgaccctgttcgtgccccagcacatcctgatgaccagcgcccccaacaccatcaccgtgctggagctggagtgggccccctgcagcagcgacgaccccgagctgtgcgccgtgaccttcgtggacagacccgtgatcggcagcagcgtgacctacgaccaccccagcaagcccgtggagaagagactgatgcccccccccccccagaagaacaaggacagctggctggaccacgtgtag

SEQ ID NO: 82603 - DNA, 2058 bp, Artificial Sequence
  Description of Artificial Sequence: Synthetic coding sequence
atggccgagtggctgctgagcgccagctggcagagaagagccaaggccatgaccgccgccgccggcagcgccggcagagccgccgtgcccctgctgctgtgcgccctgctggcccccggcggcgcctacgtgctggacgacagcgacggcctgggcagagagttcgacggcatcggcgccgtgagcggcggcggcgccaccagcagactgctggtgaactaccccgagccctacagaagccagatcctggactacctgttcaagcccaacttcggcgccagcctgcacatcctgaaggtggagatcggcggcgacggccagaccaccgacggcaccgagcccagccacatgcactacgccctggacgagaactacttcagaggctacgagtggtggctgatgaaggaggccaagaagagaaaccccaacatcaccctgatcggcctgccctggagcttccccggctggctgggcaagggcttcgactggccctacgtgaacctgcagctgaccgcctactacgtggtgacctggatcgtgggcgccaagagataccacgacctggacatcgactacatcggcatctggaacgagagaagctacaacgccaactacatcaagatcctgagaaagatgctgaactaccagggcctgcagagagtgaagatcatcgccagcgacaacctgtgggagagcatcagcgccagcatgctgctggacgccgagctgttcaaggtggtggacgtgatcggcgcccactaccccggcacccacagcgccaaggacgccaagctgaccggcaagaagctgtggagcagcgaggacttcagcaccctgaacagcgacatgggcgccggctgctggggcagaatcctgaaccagaactacatcaacggctacatgaccagcaccatcgcctggaacctggtggccagctactacgagcagctgccctacggcagatgcggcctgatgaccgcccaggagccctggagcggccactacgtggtggagagccccgtgtgggtgagcgcccacaccacccagttcacccagcccggctggtactacctgaagaccgtgggccacctggagaagggcggcagctacgtggccctgaccgacggcctgggcaacctgaccatcatcatcgagaccatgagccacaagcacagcaagtgcatcagacccttcctgccctacttcaacgtgagccagcagttcgccaccttcgtgctgaagggcagcttcagcgagatccccgagctgcaggtgtggtacaccaagctgggcaagaccagcgagagattcctgttcaagcagctggacagcctgtggctgctggacagcgacggcagcttcaccctgagcctgcacgaggacgagctgttcaccctgaccaccctgaccaccggcagaaagggcagctaccccctgccccccaagagccagcccttccccagcacctacaaggacgacttcaacgtggactaccccttcttcagcgaggcccccaacttcgccgaccagaccggcgtgttcgagtacttcaccaacatcgaggaccccggcgagcaccacttcaccctgagacaggtgctgaaccagagacccatcacctgggccgccgacgccagcaacaccatcagcatcatcggcgactacaactggaccaacctgaccatcaagtgcgacgtgtacatcgagacccccgacaccggcggcgtgttcatcgccggcagagtgaacaagggcggcatcctgatcagaagcgccagaggcatcttcttctggatcttcgccaacggcagctacagagtgaccggcgacctggccggctggatcatctacgccctgggcagagtggaggtgaccgccaagaagtggtacaccctgaccctgaccatcaagggccacttcaccagcggcatgctgaacgacaagagcctgtggaccgacatccccgtgaacttccccaagaacggctgggccgccatcggcacccacagcttcgagttcgcccagttcgacaacttcctggtggaggccaccagatag

SEQ ID NO: 82604 - DNA, 1989 bp, Artificial Sequence
  Description of Artificial Sequence: Synthetic coding sequence
atggccgagtggctgctgagcgccagctggcagagaagagccaaggccatgaccgccgccgccggcagcgccggcagagccgccgtgcccctgctgctgtgcgccctgctggcccccggcggcgcctacgtgctggacgacagcgacggcctgggcagagagttcgacggcatcggcgccgtgagcggcggcggccccaacttcggcgccagcctgcacatcctgaaggtggagatcggcggcgacggccagaccaccgacggcaccgagcccagccacatgcactacgccctggacgagaactacttcagaggctacgagtggtggctgatgaaggaggccaagaagagaaaccccaacatcaccctgatcggcctgccctggagcttccccggctggctgggcaagggcttcgactggccctacgtgaacctgcagctgaccgcctactacgtggtgacctggatcgtgggcgccaagagataccacgacctggacatcgactacatcggcatctggaacgagagaagctacaacgccaactacatcaagatcctgagaaagatgctgaactaccagggcctgcagagagtgaagatcatcgccagcgacaacctgtgggagagcatcagcgccagcatgctgctggacgccgagctgttcaaggtggtggacgtgatcggcgcccactaccccggcacccacagcgccaaggacgccaagctgaccggcaagaagctgtggagcagcgaggacttcagcaccctgaacagcgacatgggcgccggctgctggggcagaatcctgaaccagaactacatcaacggctacatgaccagcaccatcgcctggaacctggtggccagctactacgagcagctgccctacggcagatgcggcctgatgaccgcccaggagccctggagcggccactacgtggtggagagccccgtgtgggtgagcgcccacaccacccagttcacccagcccggctggtactacctgaagaccgtgggccacctggagaagggcggcagctacgtggccctgaccgacggcctgggcaacctgaccatcatcatcgagaccatgagccacaagcacagcaagtgcatcagacccttcctgccctacttcaacgtgagccagcagttcgccaccttcgtgctgaagggcagcttcagcgagatccccgagctgcaggtgtggtacaccaagctgggcaagaccagcgagagattcctgttcaagcagctggacagcctgtggctgctggacagcgacggcagcttcaccctgagcctgcacgaggacgagctgttcaccctgaccaccctgaccaccggcagaaagggcagctaccccctgccccccaagagccagcccttccccagcacctacaaggacgacttcaacgtggactaccccttcttcagcgaggcccccaacttcgccgaccagaccggcgtgttcgagtacttcaccaacatcgaggaccccggcgagcaccacttcaccctgagacaggtgctgaaccagagacccatcacctgggccgccgacgccagcaacaccatcagcatcatcggcgactacaactggaccaacctgaccatcaagtgcgacgtgtacatcgagacccccgacaccggcggcgtgttcatcgccggcagagtgaacaagggcggcatcctgatcagaagcgccagaggcatcttcttctggatcttcgccaacggcagctacagagtgaccggcgacctggccggctggatcatctacgccctgggcagagtggaggtgaccgccaagaagtggtacaccctgaccctgaccatcaagggccacttcaccagcggcatgctgaacgacaagagcctgtggaccgacatccccgtgaacttccccaagaacggctgggccgccatcggcacccacagcttcgagttcgcccagttcgacaacttcctggtggaggccaccagatag

SEQ ID NO: 82605 - DNA, 1980 bp, Artificial Sequence
  Description of Artificial Sequence: Synthetic coding sequence
atgctgggcaagagccacggcagagccacccacggccccctgcccctggccgacctgggcatccacctgccctgcgtgaaggtgctgcaccaggtgacccccgaggagaagcccgccgccaccagcagactgctggtgaactaccccgagccctacagaagccagatcctggactacctgttcaagcccaacttcggcgccagcctgcacatcctgaaggtggagatcggcggcgacggccagaccaccgacggcaccgagcccagccacatgcactacgccctggacgagaactacttcagaggctacgagtggtggctgatgaaggaggccaagaagagaaaccccaacatcaccctgatcggcctgccctggagcttccccggctggctgggcaagggcttcgactggccctacgtgaacctgcagctgaccgcctactacgtggtgacctggatcgtgggcgccaagagataccacgacctggacatcgactacatcggcatctggaacgagagaagctacaacgccaactacatcaagatcctgagaaagatgctgaactaccagggcctgcagagagtgaagatcatcgccagcgacaacctgtgggagagcatcagcgccagcatgctgctggacgccgagctgttcaaggtggtggacgtgatcggcgcccactaccccggcacccacagcgccaaggacgccaagctgaccggcaagaagctgtggagcagcgaggacttcagcaccctgaacagcgacatgggcgccggctgctggggcagaatcctgaaccagaactacatcaacggctacatgaccagcaccatcgcctggaacctggtggccagctactacgagcagctgccctacggcagatgcggcctgatgaccgcccaggagccctggagcggccactacgtggtggagagccccgtgtgggtgagcgcccacaccacccagttcacccagcccggctggtactacctgaagaccgtgggccacctggagaagggcggcagctacgtggccctgaccgacggcctgggcaacctgaccatcatcatcgagaccatgagccacaagcacagcaagtgcatcagacccttcctgccctacttcaacgtgagccagcagttcgccaccttcgtgctgaagggcagcttcagcgagatccccgagctgcaggtgtggtacaccaagctgggcaagaccagcgagagattcctgttcaagcagctggacagcctgtggctgctggacagcgacggcagcttcaccctgagcctgcacgaggacgagctgttcaccctgaccaccctgaccaccggcagaaagggcagctaccccctgccccccaagagccagcccttccccagcacctacaaggacgacttcaacgtggactaccccttcttcagcgaggcccccaacttcgccgaccagaccggcgtgttcgagtacttcaccaacatcgaggaccccggcgagcaccacttcaccctgagacaggtgctgaaccagagacccatcacctgggccgccgacgccagcaacaccatcagcatcatcggcgactacaactggaccaacctgaccatcaagtgcgacgtgtacatcgagacccccgacaccggcggcgtgttcatcgccggcagagtgaacaagggcggcatcctgatcagaagcgccagaggcatcttcttctggatcttcgccaacggcagctacagagtgaccggcgacctggccggctggatcatctacgccctgggcagagtggaggtgaccgccaagaagtggtacaccctgaccctgaccatcaagggccacttcaccagcggcatgctgaacgacaagagcctgtggaccgacatccccgtgaacttccccaagaacggctgggccgccatcggcacccacagcttcgagttcgcccagttcgacaacttcctggtggaggccaccagatag

SEQ ID NO: 82606 - DNA, 1425 bp, Artificial Sequence
  Description of Artificial Sequence: Synthetic coding sequence
atgctgaactaccagggcctgcagagagtgaagatcatcgccagcgacaacctgtgggagagcatcagcgccagcatgctgctggacgccgagctgttcaaggtggtggacgtgatcggcgcccactaccccggcacccacagcgccaaggacgccaagctgaccggcaagaagctgtggagcagcgaggacttcagcaccctgaacagcgacatgggcgccggctgctggggcagaatcctgaaccagaactacatcaacggctacatgaccagcaccatcgcctggaacctggtggccagctactacgagcagctgccctacggcagatgcggcctgatgaccgcccaggagccctggagcggccactacgtggtggagagccccgtgtgggtgagcgcccacaccacccagttcacccagcccggctggtactacctgaagaccgtgggccacctggagaagggcggcagctacgtggccctgaccgacggcctgggcaacctgaccatcatcatcgagaccatgagccacaagcacagcaagtgcatcagacccttcctgccctacttcaacgtgagccagcagttcgccaccttcgtgctgaagggcagcttcagcgagatccccgagctgcaggtgtggtacaccaagctgggcaagaccagcgagagattcctgttcaagcagctggacagcctgtggctgctggacagcgacggcagcttcaccctgagcctgcacgaggacgagctgttcaccctgaccaccctgaccaccggcagaaagggcagctaccccctgccccccaagagccagcccttccccagcacctacaaggacgacttcaacgtggactaccccttcttcagcgaggcccccaacttcgccgaccagaccggcgtgttcgagtacttcaccaacatcgaggaccccggcgagcaccacttcaccctgagacaggtgctgaaccagagacccatcacctgggccgccgacgccagcaacaccatcagcatcatcggcgactacaactggaccaacctgaccatcaagtgcgacgtgtacatcgagacccccgacaccggcggcgtgttcatcgccggcagagtgaacaagggcggcatcctgatcagaagcgccagaggcatcttcttctggatcttcgccaacggcagctacagagtgaccggcgacctggccggctggatcatctacgccctgggcagagtggaggtgaccgccaagaagtggtacaccctgaccctgaccatcaagggccacttcaccagcggcatgctgaacgacaagagcctgtggaccgacatccccgtgaacttccccaagaacggctgggccgccatcggcacccacagcttcgagttcgcccagttcgacaacttcctggtggaggccaccagatag

SEQ ID NO: 82607 - DNA, 1770 bp, Artificial Sequence
  Description of Artificial Sequence: Synthetic coding sequence
atgggcttcatggtggccgacctgtgggccaccagcagactgctggtgaactaccccgagccctacagaagccagatcctggactacctgttcaagcccaacttcggcgccagcctgcacatcctgaaggtggagatcggcggcgacggccagaccaccgacggcaccgagcccagccacatgcactacgccctggacgagaactacttcagaggctacgagtggtggctgatgaaggaggccaagaagagaaaccccaacatcaccctgatcggcctgccctggagcttccccggctggctgggcaagggcttcgactggccctacgtgaacctgcagctgaccgcctactacgtggtgacctggatcgtgggcgccaagagataccacgacctggacatcgactacatcggcatctggaacgagagaagctacaacgccaactacatcaagatcctgagaaagatgctgaactaccagggcctgcagagagtgaagatcatcgccagcgacaacctgtgggagagcatcagcgccagcatgctgctggacgccgagctgttcaaggtggtggacgtgatcggcgcccactaccccggcacccacagcgccaaggacgccaagctgaccggcaagaagctgtggagcagcgaggacttcagcaccctgaacagcgacatgggcgccggctgctggggcagaatcctgaaccagaactacatcaacggctacatgaccagcaccatcgcctggaacctggtggccagctactacgagcagctgccctacggcagatgcggcctgatgaccgcccaggagccctggagcggccactacgtggtggagagccccgtgtgggtgagcgcccacaccacccagttcacccagcccggctggtactacctgaagaccgtgggccacctggagaagggcggcagctacgtggccctgaccgacggcctgggcaacctgaccatcatcatcgagaccatgagccacaagcacagcaagtgcatcagacccttcctgccctacttcaacgtgagccagcagttcgccaccttcgtgctgaagggcagcttcagcgagatccccgagctgcaggtgtggtacaccaagctgggcaagaccagcgagagattcctgttcaagcagctggacagcctgtggctgctggacagcgacggcagcttcaccctgagcctgcacgaggacgagctgttcaccctgaccaccctgaccaccggcagaaagggcagctaccccctgccccccaagagccagcccttccccagcacctacaaggacgacttcaacgtggactaccccttcttcagcgaggcccccaacttcgccgaccagaccggcgtgttcgagtacttcaccaacatcgaggaccccggcgagcaccacttcaccctgagacaggtgctgaaccagagacccatcacctgggccgccgacgccagcaacaccatcagcatcatcggcgactacaactggaccaacctgaccatcaagtgcgacgtgtacatcgagacccccgacaccggcggcgtgttcatcgccggcagagtgaacaagggcggcatcctgatcagaagcgccagaggcatcttcttctggatcttcgccaacggcagctacagagtgaccggcgacctggccggctggatcatctacgccctgggcagagtggaggtgaccgccaagaagtggtacaccctgaccctgaccatcaaggtggccggcagaagaaagaagacctag

SEQ ID NO: 82608 - DNA, 372 bp, Artificial Sequence
  Description of Artificial Sequence: Synthetic coding sequence
atggccagaggcagcgccctgctgctggccagcctgctgctggccgccgccctgagcgccagcgccggcctgtggagccccgccaaggagaagagaggctggaccctgaacagcgccggctacctgctgggcccccacgccgtgggcaaccacagaagcttcagcgacaagaacggcctgaccagcaagagagagctgagacccgaggacgacatgaagcccggcagcttcgacagaagcatccccgagaacaacatcatgagaaccatcatcgagttcctgagcttcctgcacctgaaggaggccggcgccctggacagactgctggacctgcccgccgccgccagcagcgaggacatcgagagaagctag

SEQ ID NO: 82609 - DNA, 1050 bp, Artificial Sequence
  Description of Artificial Sequence: Synthetic coding sequence
atggagctggccgtgggcaacctgagcgagggcaacgccagctggcccgagccccccgcccccgagcccggccccctgttcggcatcggcgtggagaacttcgtgaccctggtggtgttcggcctgatcttcgccctgggcgtgctgggcaacagcctggtgatcaccgtgctggccagaagcaagcccggcaagcccagaagcaccaccaacctgttcatcctgaacctgagcatcgccgacctggcctacctgctgttctgcatccccttccaggccaccgtgtacgccctgcccacctgggtgctgggcgccttcatctgcaagttcatccactacttcttcaccgtgagcatgctggtgagcatcttcaccctggccgccatgagcgtggacagatacgtggccatcgtgcacagcagaagaagcagcagcctgagagtgagcagaaacgccctgctgggcgtgggctgcatctgggccctgagcatcgccatggccagccccgtggcctaccaccagggcctgttccaccccagagccagcaaccagaccttctgctgggagcagtggcccgaccccagacacaagaaggcctacgtggtgtgcaccttcgtgttcggctacctgctgcccctgctgctgatctgcttctgctacgccaaggtgctgaaccacctgcacaagaagctgaagaacatgagcaagaagagcgaggccagcaagaagaagaccgcccagaccgtgctggtggtggtggtggtgttcggcatcagctggctgccccaccacatcatccacctgtgggccgagttcggcgtgttccccctgacccccgccagcttcctgttcagaatcaccgcccactgcctggcctacagcaacagcagcgtgaaccccatcatctacgccttcctgagcgagaacttcagaaaggcctacaagcaggtgttcaagtgccacatcagaaaggacagccacctgagcgacaccaaggagagcaagagcagaatcgacaccccccccagcaccaactgcacccacgtgtag

SEQ ID NO: 82610 - DNA, 1164 bp, Artificial Sequence
  Description of Artificial Sequence: Synthetic coding sequence
atgaacgtgagcggctgccccggcgccggcaacgccagccaggccggcggcggcggcggctggcaccccgaggccgtgatcgtgcccctgctgttcgccctgatcttcctggtgggcaccgtgggcaacaccctggtgctggccgtgctgctgagaggcggccaggccgtgagcaccaccaacctgttcatcctgaacctgggcgtggccgacctgtgcttcatcctgtgctgcgtgcccttccaggccaccatctacaccctggacggctgggtgttcggcagcctgctgtgcaaggccgtgcacttcctgatcttcctgaccatgcacgccagcagcttcaccctggccgccgtgagcctggacagatacctggccatcagataccccctgcacagcagagagctgagaacccccagaaacgccctggccgccatcggcctgatctggggcctgagcctgctgttcagcggcccctacctgagctactacagacagagccagctggccaacctgaccgtgtgccaccccgcctggagcgcccccagaagaagagccatggacatctgcaccttcgtgttcagctacctgctgcccgtgctggtgctgggcctgacctacgccagaaccctgagatacctgtggagagccgtggaccccgtggccgccggcagcggcgccagaagagccaagagaaaggtgaccagaatgatcctgatcgtggccgccctgttctgcctgtgctggatgccccaccacgccctgatcctgtgcgtgtggttcggccagttccccctgaccagagccacctacgccctgagaatcctgagccacctggtgagctacgccaacagctgcgtgaaccccatcgtgtacgccctggtgagcaagcacttcagaaagggcttcagaaccatctgcgccggcctgctgggcagagcccccggcagagccagcggcagagtgtgcgccgccgccagaggcacccacagcggcagcgtgctggagagagagagcagcgacctgctgcacatgagcgaggccgccggcgccctgagaccctgccccggcgccagccagccctgcatcctggagccctgccccggccccagctggcagggccccaaggccggcgacagcatcctgaccgtggacgtggcctag

SEQ ID NO: 82611 - DNA, 1107 bp, Artificial Sequence
  Description of Artificial Sequence: Synthetic coding sequence
atggccgacgcccagaacatcagcctggacagccccggcagcgtgggcgccgtggccgtgcccgtggtgttcgccctgatcttcctgctgggcaccgtgggcaacggcctggtgctggccgtgctgctgcagcccggccccagcgcctggcaggagcccggcagcaccaccgacctgttcatcctgaacctggccgtggccgacctgtgcttcatcctgtgctgcgtgcccttccaggccaccatctacaccctggacgcctggctgttcggcgccctggtgtgcaaggccgtgcacctgctgatctacctgaccatgtacgccagcagcttcaccctggccgccgtgagcgtggacagatacctggccgtgagacaccccctgagaagcagagccctgagaacccccagaaacgccagagccgccgtgggcctggtgtggctgctggccgccctgttcagcgccccctacctgagctactacggcaccgtgagatacggcgccctggagctgtgcgtgcccgcctgggaggacgccagaagaagagccctggacgtggccaccttcgccgccggctacctgctgcccgtggccgtggtgagcctggcctacggcagaaccctgagattcctgtgggccgccgtgggccccgccggcgccgccgccgccgaggccagaagaagagccaccggcagagccggcagagccatgctggccgtggccgccctgtacgccctgtgctggggcccccaccacgccctgatcctgtgcttctggtacggcagattcgccttcagccccgccacctacgcctgcagactggccagccactgcctggcctacgccaacagctgcctgaaccccctggtgtacgccctggccagcagacacttcagagccagattcagaagactgtggccctgcggcagaagaagaagacacagagccagaagagccctgagaagagtgagacccgccagcagcggcccccccggctgccccggcgacgccagacccagcggcagactgctggccggcggcggccagggccccgagcccagagagggccccgtgcacggcggcgaggccgccagaggccccgagtag

SEQ ID NO: 82612 - DNA, 1959 bp, Artificial Sequence
  Description of Artificial Sequence: Synthetic coding sequence
atgggcaacctgcagagcgagcccagcgccggcggcggcagcagaaaggtgcagcccagcgacagagcccccgacagcagaagaaccagcctggtggagcccgagatgaccagccaggccatgagactgaccagaggcctgggcgtgtggttccccggcagcgccaccccccccggcctgatggtgcccagagagccccaggccagccccagcaccctgcccctgaccctggagagacccagccccgtgatgcccccccccgaggaggccgccgccgtgagcgcccccccccccgcccccgccggcaccctgctgcccggccccagcaagtggcagaagcccgccggcacccccgtgcccagaatcagaagactgctggaggccagccacagaggccagggcgacccccccagcctgagacccctgaagcccccccccccccccagacagctgagcgtgaaggacaccgtgcccagagcccccagccagttccccccccccctggagacctggaagccccccccccccctgcccagcgagagacagcccgccgacagaagaatcacccccgccctggccacccccgccagcccccccaccgagagccaggccggccccagaaaccagggccagaccgccggcagagccagaggcggcgcccccccccacgccggcgagggcgagatggcccagcccgccgacagcgagagcggcctgagcctgctgtgcaagatcaccttcaagagcagacccagcctggccccccccgccgccagcagcagcctggccgccaaggccagcctgggcggcggcggcggcggcggcctgttcgccgccagcggcgccatcagctacgccgaggtgctgaagcagggccccctgccccccggcgccgccagacccctgggcgaggtgagcagaggcgcccaggaggccgagggcggcgacggcgacggcgagggctgcagcggcccccccagcgcccccgccagccaggccagagccctgcccccccccccctacaccaccttccccggcagcaagcccaagttcgactgggtgagcgcccccgacggccccgagagacacttcagattcaacggcgccggcggcggcatcggcgcccccagaagaagagccgccgccctgagcggcccctggggcagccccccccccccccccgagcagatccacagcgcccccggccccagaagacccgcccccgccctgctggccccccccaccttcatcttccccgcccccaccaacggcgagcccatgagacccggcccccccggcctgcaggagctgccccccctgcccccccccacccccccccccaccctgcagccccccgccctgcagcccacccccctgcccgtggccccccccctgacccccggcctgggccacaaggagagcgccctggcccccaccgccgcccccgccctgccccccgccctggccgccgaccaggcccccgcccccagccccgcccccgcccccaccgtggccgagcccagcccccccgtgagcgcccccgcccccgccgccgcccccatcaagaccagaaccagaagaaacaagggcagcagagccgccagaggcgccaccagaaaggacggcctgcacggcgacggccccagagagagagccaccgccaccgtgcccgacagcagcggcggcggcggcggcggcagcggcgccagccagaccggcgccgccaacaccagagccgccagacactggctgcccttccaggtgctgaacagctgcccctgcaagtgctactgccaccaccagcccagacacagaagactgcccagaaacgtgagcgcctggctgagcaccagcaccaaccacctgggcgagcccccctgggtggccaccatcaagctgagcggcagcctggtggccaagctggagcactacgacctgcaggccacccacagcaactag

SEQ ID NO: 82613 - DNA, 675 bp, Artificial Sequence
  Description of Artificial Sequence: Synthetic coding sequence
atgggcaacctgcagagcgagcccagcgccggcggcggcagcagaaaggtgcagcccagcgacagagcccccgacagcagaagaaccagcctggtggagcccgagatgaccagccaggccatgagactgaccagaggcctgggcgtgtggttccccggcagcgccaccccccccggcctgatggtgcccagagagccccaggccagccccagcaccctgcccctgaccctggagagacccagccccgtgatgcccccccccgaggaggccgccgccgtgagcgcccccccccccgcccccgccggcaccctgctgcccggccccagcaagtggcagaagcccgccggcacccccgtgcccagaatcagaagactgctggaggccagccacagaggccagggcgacccccccagcctgagacccctgaagcccccccccccccccagacagctgagcgtgaaggacaccgtgcccagagcccccagccagttccccccccccctggagacctggaagccccccccccccctgcccagcgagagacagcccgccgacagaagaatcacccccgccctggccacccccgcctgcgtgagagccagaaccagaggctgcgcccaccaggacccccacgcccaggagcagggcttcccctgcagccccggcagagactag

SEQ ID NO: 82614 - DNA, 2094 bp, Artificial Sequence
  Description of Artificial Sequence: Synthetic coding sequence
atggccagactggtggccgtgtgcagagacggcgaggaggagttccccttcgagagaagacagatccccctgtacatcgacgacaccctgaccatggtgatggagttccccgacaacgtgctgaacctggacggccaccagaacaacggcgcccagctgaagcagttcatccagagacacggcatgctgaagcagcaggacctgagcatcgccatggtggtgaccagcagagaggtgctgagcgccctgagccagctggtgccctgcgtgggctgcagaagaagcgtggagagactgttcagccagctggtggagagcggcaaccccgccctggagcccctgaccgtgggccccaagggcgtgctgagcgtgaccagaagctgcatgaccgacgccaagaagctgtacaccctgttctacgtgcacggcagcaagctgaacgacatgatcgacgccatccccaagagcaagaagaacaagagatgccagctgcacagcctggacacccacaagcccaagcccctgggcggctgctggatggacgtgtgggagctgatgagccaggagtgcagagacgaggtggtgctgatcgacagcagctgcctgctggagaccctggagacctacctgagaaagcacagattctgcaccgactgcaagaacaaggtgctgagagcctacaacatcctgatcggcgagctggactgcagcaaggagaagggctactgcgccgccctgtacgagggcctgagatgctgcccccacgagagacacatccacgtgtgctgcgagaccgacttcatcgcccacctgctgggcagagccgagcccgagttcgccggcggcagaagagagagacacgccaagaccatcgacatcgcccaggaggaggtgctgacctgcctgggcatccacctgtacgagagactgcacagaatctggcagaagctgagagccgaggagcagacctggcagatgctgttctacctgggcgtggacgccctgagaaagagcttcgagatgaccgtggagaaggtgcagggcatcagcagactggagcagctgtgcgaggagttcagcgaggaggagagagtgagagagctgaagcaggagaagaagagacagaagagaaagaacagaagaaagaacaagtgcgtgtgcgacatccccacccccctgcagaccgccgacgagaaggaggtgagccaggagaaggagaccgacttcatcgagaacagcagctgcaaggcctgcggcagcaccgaggacggcaacacctgcgtggaggtgatcgtgaccaacgagaacaccagctgcacctgccccagcagcggcaacctgctgggcagccccaagatcaagaagggcctgagcccccactgcaacggcagcgactgcggctacagcagcagcatggagggcagcgagaccggcagcagagagggcagcgacgtggcctgcaccgagggcatctgcaaccacgacgagcacggcgacgacagctgcgtgcaccactgcgaggacaaggaggacgacggcgacagctgcgtggagtgctgggccaacagcgaggagaacgacaccaagggcaagaacaagaagaagaagaagaagagcaagatcctgaagtgcgacgagcacatccagaagctgggcagctgcatcaccgaccccggcaacagagagaccagcggcaacaccatgcacaccgtgttccacagagacaagaccaaggacacccaccccgagagctgctgcagcagcgagaagggcggccagcccctgccctggttcgagcacagaaagaacgtgccccagttcgccgagcccaccgagaccctgttcggccccgacagcggcaagggcgccaagagcctggtggagctgctggacgagagcgagtgcaccagcgacgaggagatcttcatcagccaggacgagatccagagcttcatggccaacaaccagagcttctacagcaacagagagcagtacagacagcacctgaaggagaagttcaacaagtactgcagactgaacgaccacaagagacccatctgcagcggctggctgaccaccgccggcgccaactag

SEQ ID NO: 82615 - DNA, 1548 bp, Artificial Sequence
  Description of Artificial Sequence: Synthetic coding sequence
atgagcagccccaacatctggagcaccggcagcagcgtgtacagcacccccgtgttcagccagaagatgaccgtgtggatcctgctgctgctgagcctgtaccccggcttcaccagccagaagagcgacgacgactacgaggactacgccagcaacaagacctgggtgctgacccccaaggtgcccgagggcgacgtgaccgtgatcctgaacaacctgctggagggctacgacaacaagctgagacccgacatcggcgtgaagcccaccctgatccacaccgacatgtacgtgaacagcatcggccccgtgaacgccatcaacatggagtacaccatcgacatcttcttcgcccagacctggtacgacagaagactgaagttcaacagcaccatcaaggtgctgagactgaacagcaacatggtgggcaagatctggatccccgacaccttcttcagaaacagcaagaaggccgacgcccactggatcaccacccccaacagaatgctgagaatctggaacgacggcagagtgctgtacaccctgagactgaccatcgacgccgagtgccagctgcagctgcacaacttccccatggacgagcacagctgccccctggagttcagcagctggagcagaagcatcgcccaggccggcatgtgcagcggcgtgatcagcgcccactacagcctgagattctggggcagcaccgacccccccaccctggccagcagagtggccggcatcagcgacggctaccccagagaggagatcgtgtaccagtggaagagaagcagcgtggaggtgggcgacaccagaagctggagactgtaccagttcagcttcgtgggcctgagaaacaccaccgaggtggtgaagaccaccagcggcgactacgtggtgatgagcgtgtacttcgacctgagcagaagaatgggctacttcaccatccagacctacatcccctgcaccctgatcgtggtgctgagctgggtgagcttctggatcaacaaggacgccgtgcccgccagaaccagcctgggcatcaccaccgtgctgaccatgaccaccctgagcaccatcgccagaaagagcctgcccaaggtgagctacgtgaccgccatggacctgttcgtgagcgtgtgcttcatcttcgtgttcagcgccctggtggagtacggcaccctgcactacttcgtgagcaacagaaagcccagcaaggacaaggacaagaagaagaagaaccccctgctgagaatgttcagcttcaaggcccccaccatcgacatcagacccagaagcgccaccatccagatgaacaacgccacccacctgcaggagagagacgaggagtacggctacgagtgcctggacggcaaggactgcgccagcttcttctgctgcttcgaggactgcagaaccggcgcctggagacacggcagaatccacatcagaatcgccaagatggacagctacgccagaatcttcttccccaccgccttctgcctgttcaacctggtgtactgggtgagctacctgtacctgtag

SEQ ID NO: 82616 - DNA, 762 bp, Artificial Sequence
  Description of Artificial Sequence: Synthetic coding sequence
atggcccccaagctgctgctgctgctgtgcctgttcagcggcctgcacgccagaagcagaaaggtggaggaggacgagtacgaggacagcagcagcaaccagaagtgggtgctggcccccaagagccaggacaccgacgtgaccctgatcctgaacaagctgctgagagagtacgacaagaagctgagacccgacatcggcatcaagcccaccgtgatcgacgtggacatctacgtgaacagcatcggccccgtgagcagcatcaacatggagtaccagatcgacatcttcttcgcccagacctggaccgacagcagactgagattcaacagcaccatgaagatcctgaccctgaacagcaacatggtgggcctgatctggatccccgacaccatcttcagaaacagcaagaccgccgaggcccactggatcaccacccccaaccagctgctgagaatctggaacgacggcaagatcctgtacaccctgagactgaccatcaacgccgagtgccagctgcagctgcacaacttccccatggacgagcacagctgccccctgatcttcagcagctacggctaccccaaggaggagatgatctacagatggagaaagaacagcgtggaggccgccgaccagaagagctggagactgtaccagttcgacttcatgggcctgagaaacaccaccgagatcgtgaccaccagcgccggcagaaacctgctgaaggaggcccagctgagcaaggccagagaggcctag

SEQ ID NO: 82617 - DNA, 1371 bp, Artificial Sequence
  Description of Artificial Sequence: Synthetic coding sequence
atgagaaagagccccggcctgagcgactgcctgtgggcctggatcctgctgctgagcaccctgaccggcagaagctacggccagcccagcctgcaggacgagctgaaggacaacaccaccgtgttcaccagaatcctggacagactgctggacggctacgacaacagactgagacccggcctgggcgagagagtgaccgaggtgaagaccgacatcttcgtgaccagcttcggccccgtgagcgaccacgacatggagtacaccatcgacgtgttcttcagacagagctggaaggacgagagactgaagttcaagggccccatgaccgtgctgagactgaacaacctgatggccagcaagatctggacccccgacaccttcttccacaacggcaagaagagcgtggcccacaacatgaccatgcccaacaagctgctgagaatcaccgaggacggcaccctgctgtacaccatgagactgaccgtgagagccgagtgccccatgcacctggaggacttccccatggacgcccacgcctgccccctgaagttcggcagctacgcctacaccagagccgaggtggtgtacgagtggaccagagagcccgccagaagcgtggtggtggccgaggacggcagcagactgaaccagtacgacctgctgggccagaccgtggacagcggcatcgtgcagagcagcaccggcgagtacgtggtgatgaccacccacttccacctgaagagaaagatcggctacttcgtgatccagacctacctgccctgcatcatgaccgtgatcctgagccaggtgagcttctggctgaacagagagagcgtgcccgccagaaccgtgttcggcgtgaccaccgtgctgaccatgaccaccctgagcatcagcgccagaaacagcctgcccaaggtggcctacgccaccgccatggactggttcatcgccgtgtgctacgccttcgtgttcagcgccctgatcgagttcgccaccgtgaactacttcaccaagagaggctacgcctgggacggcaagagcgtggtgcccgagaagcccaagaaggtgaaggaccccctgatcaagaagaacaacacctacgcccccaccgccaccagctacacccccaacctggccagaggcgaccccggcctggccaccatcgccaagagcgccaccatcgagcccaaggaggtgaagcccgagaccaagccccccgagcccaagaagaccttcaacagcgtgagcaagatcgacagactgagcagaatcgccttccccctgctgttcggcatcttcaacctggtgtactgggccacctacctgaacagagagccccagctgaaggcccccaccccccaccagtag

SEQ ID NO: 82618 - DNA, 1371 bp, Artificial Sequence; identical to SEQ ID NO: 82617
  Description of Artificial Sequence: Synthetic coding sequence

SEQ ID NO: 82619 - DNA, 1371 bp, Artificial Sequence; identical to SEQ ID NO: 82617
  Description of Artificial Sequence: Synthetic coding sequence

SEQ ID NO: 82620 - DNA, 1371 bp, Artificial Sequence; identical to SEQ ID NO: 82617
  Description of Artificial Sequence: Synthetic coding sequence

SEQ ID NO: 82621 - DNA, 1371 bp, Artificial Sequence; identical to SEQ ID NO: 82617
  Description of Artificial Sequence: Synthetic coding sequence

SEQ ID NO: 82622 - DNA, 1371 bp, Artificial Sequence; identical to SEQ ID NO: 82617
  Description of Artificial Sequence: Synthetic coding sequence

SEQ ID NO: 82623 - DNA, 372 bp, Artificial Sequence
  Description of Artificial Sequence: Synthetic coding sequence
atgagaaagagccccggcctgagcgactgcctgtgggcctggatcctgctgctgagcaccctgaccggcagaagctacggccagcccagcctgcaggacgagctgaaggacaacaccaccgtgttcaccagaatcctggacagactgctggacggctacgacaacagactgagacccggcctgggcgagagagtgaccgaggtgaagaccgacatcttcgtgaccagcttcggccccgtgagcgaccacgacatggagtacaccatcgacgtgttcttcagacagagctggaaggacgagagactgaagttcaagggccccatgaccgtgctgagactgaacaacctgatggccagcaagatctggacctag

SEQ ID NO: 82624 - DNA, 1356 bp, Artificial Sequence
  Description of Artificial Sequence: Synthetic coding sequence
atgaagaccaagctgaacatctacaacatgcagttcctgctgttcgtgttcctggtgtgggaccccgccagactggtgctggccaacatccaggaggacgaggccaagaacaacatcaccatcttcaccagaatcctggacagactgctggacggctacgacaacagactgagacccggcctgggcgacagcatcaccgaggtgttcaccaacatctacgtgaccagcttcggccccgtgagcgacaccgacatggagtacaccatcgacgtgttcttcagacagaagtggaaggacgagagactgaagttcaagggccccatgaacatcctgagactgaacaacctgatggccagcaagatctggacccccgacaccttcttccacaacggcaagaagagcgtggcccacaacatgaccatgcccaacaagctgctgagaatccaggacgacggcaccctgctgtacaccatgagactgaccgtgcaggccgagtgccccatgcacctggaggacttccccatggacgcccacagctgccccctgaagttcggcagctacgcctacaccaccagcgaggtgacctacatctggacctacaacgccagcgacagcgtgcaggtggcccccgacggcagcagactgaaccagtacgacctgctgggccagagcatcggcaaggagaccatcaagagcagcaccggcgagtacaccgtgatgaccgcccacttccacctgaagagaaagatcggctacttcgtgatccagacctacctgccctgcatcatgaccgtgatcctgagccaggtgagcttctggctgaacagagagagcgtgcccgccagaaccgtgttcggcgtgaccaccgtgctgaccatgaccaccctgagcatcagcgccagaaacagcctgcccaaggtggcctacgccaccgccatggactggttcatcgccgtgtgctacgccttcgtgttcagcgccctgatcgagttcgccaccgtgaactacttcaccaagagaggctgggcctgggacggcaagagcgtggtgaacgacaagaagaaggagaaggccagcgtgatgatccagaacaacgcctacgccgtggccgtggccaactacgcccccaacctgagcaaggaccccgtgctgagcaccatcagcaagagcgccaccacccccgagcccaacaagaagcccgagaacaagcccgccgaggccaagaagaccttcaacagcgtgagcaagatcgacagaatgagcagaatcgtgttccccgtgctgttcggcaccttcaacctggtgtactgggccacctacctgaacagagagcccgtgctgggcgtgagcccctag

SEQ ID NO: 82625 - DNA, 1356 bp, Artificial Sequence; identical to SEQ ID NO: 82624
  Description of Artificial Sequence: Synthetic coding sequence

SEQ ID NO: 82626 - DNA, 459 bp, Artificial Sequence
  Description of Artificial Sequence: Synthetic coding sequence
atgaagaccaagctgaacatctacaacatgcagttcctgctgttcgtgttcctggtgtgggaccccgccagactggtgctggccaacatccaggaggacgaggccaagaacaacatcaccatcttcaccagaatcctggacagactgctggacggctacgacaacagactgagacccggcctgggcgacagcatcaccgaggtgttcaccaacatctacgtgaccagcttcggccccgtgagcgacaccgacatggagtacaccatcgacgtgttcttcagacagaagtggaaggacgagagactgaagttcaagggccccatgaacatcctgagactgaacaacctgatggccagcaagatctggacccccgacaccttcttccacaacggcaagaagagcgtggcccacaacatgaccatgcccaacaagctgctgagaatccaggacgacggctag

SEQ ID NO: 82627 - DNA, 414 bp, Artificial Sequence
  Description of Artificial Sequence: Synthetic coding sequence
atgaagaccaagctgaacatctacaacatgcagttcctgctgttcgtgttcctggtgtgggaccccgccagactggtgctggccaacatccaggaggacgaggccaagaacaacatcaccatcttcaccagaatcctggacagactgctggacggctacgacaacagactgagacccggcctgggcgacagcatcaccgaggtgttcaccaacatctacgtgaccagcttcggccccgtgagcgacaccgacatggagtacaccatcgacgtgttcttcagacagaagtggaaggacgagagactgaagttcaagggccccatgaacatcctgagactgaacaacctgatggccagcaagatctggacccccgacaccttcttccacaacggcaagaagagcgtggcccactag

SEQ ID NO: 82628 - DNA, 1536 bp, Artificial Sequence
  Description of Artificial Sequence: Synthetic coding sequence
atgaagaccaagctgaacatctacaacatgcagttcctgctgttcgtgttcctggtgtgggaccccgccagactggtgctggccaacatccaggaggacgaggccaagaacaacatcaccatcttcaccagaatcctggacagactgctggacggctacgacaacagactgagacccggcctgggcgacagcatcaccgaggtgttcaccaacatctacgtgaccagcttcggccccgtgagcgacaccgacatggagtacaccatcgacgtgttcttcagacagaagtggaaggacgagagactgaagttcaagggccccatgaacatcctgagactgaacaacctgatggccagcaagatctggacccccgacaccttcttccacaacggcaagaagagcgtggcccacaacatgaccatgcccaacaagctgctgagaatccaggacgacggcaccctgctgtacaccatgagactgaccgtgcaggccgagtgccccatgcacctggaggacttccccatggacgcccacagctgccccctgaagttcggcagctacgcctacaccaccagcgaggtgacctacatctggacctacaacgccagcgacagcgtgcaggtggcccccgacggcagcagactgaaccagtacgacctgctgggccagagcatcggcaaggagaccatcaagagcagcaccggcgagtacaccgtgatgaccgcccacttccacctgaagagaaagatcggctacttcgtgatccagacctacctgccctgcatcatgaccgtgatcctgagccaggtgagcttctggctgaacagagagagcgtgcccgccagaaccgtgttcggcgtgaccaccgtgctgaccatgaccaccctgagcatcagcgccagaaacagcctgcccaaggtggcctacgccaccgccatggactggttcatcgccgtgtgctacgccttcgtgttcagcgccctgatcgagttcgccaccgtgaactacttcaccaagagaggctgggcctgggacggcaagagcgtggtgaacgacaagagccccagcatcaaggccgagggcatcaccctgacctacaacagcgtgaaggccatcctgcagggcgccaagctgatctggagcaagtacatcgccttcagctggcccagcctgttccaggagaagaccctggagtacctggagaagtggatggactgcctgaccttcaagcagagcagcaagaaggagaaggccagcgtgatgatccagaacaacgcctacgccgtggccgtggccaactacgcccccaacctgagcaaggaccccgtgctgagcaccatcagcaagagcgccaccacccccgagcccaacaagaagcccgagaacaagcccgccgaggccaagaagaccttcaacagcgtgagcaagatcgacagaatgagcagaatcgtgttccccgtgctgttcggcaccttcaacctggtgtactgggccacctacctgaacagagagcccgtgctgggcgtgagcccctag

SEQ ID NO: 82629 - DNA, 1356 bp, Artificial Sequence; identical to SEQ ID NO: 82624
  Description of Artificial Sequence: Synthetic coding sequence

SEQ ID NO: 82630 - DNA, 1356 bp, Artificial Sequence; identical to SEQ ID NO: 82624
  Description of Artificial Sequence: Synthetic coding sequence

SEQ ID NO: 82631 - DNA, 1104 bp, Artificial Sequence
  Description of Artificial Sequence: Synthetic coding sequence
atgaagaccaagctgaacatctacaacatgcagttcctgctgttcgtgttcctggtgtgggaccccgccagactggtgctggccaacatccaggaggacgaggccaagaacaacatcaccatcttcaccagaatcctggacagactgctggacggctacgacaacagactgagacccggcctgggcgacagcatcaccgaggtgttcaccaacatctacgtgaccagcttcggccccgtgagcgacaccgacatggagtacaccatcgacgtgttcttcagacagaagtggaaggacgagagactgaagttcaagggccccatgaacatcctgagactgaacaacctgatggccagcaagatctggacccccgacaccttcttccacaacggcaagaagagcgtggcccacaacatgaccatgcccaacaagctgctgagaatccaggacgacggcaccctgctgtacaccatgagactgaccgtgcaggccgagtgccccatgcacctggaggacttccccatggacgcccacagctgccccctgaagttcggcagctacgcctacaccaccagcgaggtgacctacatctggacctacaacgccagcgacagcgtgcaggtggcccccgacggcagcagactgaaccagtacgacctgctgggccagagcatcggcaaggagaccatcaagagcagcaccggcgagtacaccgtgatgaccgcccacttccacctgaagagaaagatcggctacttcgtgatccagacctacctgccctgcatcatgaccgtgatcctgagccaggtgagcttctggctgaacagagagagcgtgcccgccagaaccgtgttcggcgtgaccaccgtgctgaccatgaccaccctgagcatcagcgccagaaacagcctgcccaaggtggcctacgccaccgccatggactggttcatcgccgtgtgctacgccttcgtgttcagcgccctgatcgagttcgccaccgtgaactacttcaccaagagaggctgggcctgggacggcaagagcgtggtgaacgacaaggtgagcgagagcttcagagtgatcatcatcaagaagatcccctag

SEQ ID NO: 82632 - DNA, 1371 bp, Artificial Sequence
  Description of Artificial Sequence: Synthetic coding sequence
atgagactgaagatcaccctgcccagcctgagagagttcctgaccgacttctggatggtgaccatcatcggcctggaccaggactgggaggagtacaccatcgacgtgttcttcagacagaagtggaaggacgagagactgaagttcaagggccccatgaacatcctgagactgaacaacctgatggccagcaagatctggacccccgacaccttcttccacaacggcaagaagagcgtggcccacaacatgaccatgcccaacaagctgctgagaatccaggacgacggcaccctgctgtacaccatgagactgaccgtgcaggccgagtgccccatgcacctggaggacttccccatggacgcccacagctgccccctgaagttcggcagctacgcctacaccaccagcgaggtgacctacatctggacctacaacgccagcgacagcgtgcaggtggcccccgacggcagcagactgaaccagtacgacctgctgggccagagcatcggcaaggagaccatcaagagcagcaccggcgagtacaccgtgatgaccgcccacttccacctgaagagaaagatcggctacttcgtgatccagacctacctgccctgcatcatgaccgtgatcctgagccaggtgagcttctggctgaacagagagagcgtgcccgccagaaccgtgttcggcgtgaccaccgtgctgaccatgaccaccctgagcatcagcgccagaaacagcctgcccaaggtggcctacgccaccgccatggactggttcatcgccgtgtgctacgccttcgtgttcagcgccctgatcgagttcgccaccgtgaactacttcaccaagagaggctgggcctgggacggcaagagcgtggtgaacgacaagagccccagcatcaaggccgagggcatcaccctgacctacaacagcgtgaaggccatcctgcagggcgccaagctgatctggagcaagtacatcgccttcagctggcccagcctgttccaggagaagaccctggagtacctggagaagtggatggactgcctgaccttcaagcagagcagcaagaaggagaaggccagcgtgatgatccagaacaacgcctacgccgtggccgtggccaactacgcccccaacctgagcaaggaccccgtgctgagcaccatcagcaagagcgccaccacccccgagcccaacaagaagcccgagaacaagcccgccgaggccaagaagaccttcaacagcgtgagcaagatcgacagaatgagcagaatcgtgttccccgtgctgttcggcaccttcaacctggtgtactgggccacctacctgaacagagagcccgtgctgggcgtgagcccctag

SEQ ID NO: 82633 - DNA, 1479 bp, Artificial Sequence
  Description of Artificial Sequence: Synthetic coding sequence
atgatcatcacccagaccagccactgctacatgaccagcctgggcatcctgttcctgatcaacatcctgcccggcaccaccggccagggcgagagcagaagacaggagcccggcgacttcgtgaagcaggacatcggcggcctgagccccaagcacgcccccgacatccccgacgacagcaccgacaacatcaccatcttcaccagaatcctggacagactgctggacggctacgacaacagactgagacccggcctgggcgacgccgtgaccgaggtgaagaccgacatctacgtgaccagcttcggccccgtgagcgacaccgacatggagtacaccatcgacgtgttcttcagacagacctggcacgacgagagactgaagttcgacggccccatgaagatcctgcccctgaacaacctgctggccagcaagatctggacccccgacaccttcttccacaacggcaagaagagcgtggcccacaacatgaccacccccaacaagctgctgagactggtggacaacggcaccctgctgtacaccatgagactgaccatccacgccgagtgccccatgcacctggaggacttccccatggacgtgcacgcctgccccctgaagttcggcagctacgcctacaccaccgccgaggtggtgtacagctggaccctgggcaagaacaagagcgtggaggtggcccaggacggcagcagactgaaccagtacgacctgctgggccacgtggtgggcaccgagatcatcagaagcagcaccggcgagtacgtggtgatgaccacccacttccacctgaagagaaagatcggctacttcgtgatccagacctacctgccctgcatcatgaccgtgatcctgagccaggtgagcttctggctgaacagagagagcgtgcccgccagaaccgtgttcggcgtgaccaccgtgctgaccatgaccaccctgagcatcagcgccagaaacagcctgcccaaggtggcctacgccaccgccatggactggttcatcgccgtgtgctacgccttcgtgttcagcgccctgatcgagttcgccaccgtgaactacttcaccaagagaagctgggcctgggagggcaagaaggtgcccgaggccctggagatgaagaagaagacccccgccgcccccgccaagaagaccagcaccaccttcaacatcgtgggcaccacctaccccatcaacctggccaaggacaccgagttcagcaccatcagcaagggcgccgcccccagcgccagcagcacccccaccatcatcgccagccccaaggccacctacgtgcaggacagccccaccgagaccaagacctacaacagcgtgagcaaggtggacaagatcagcagaatcatcttccccgtgctgttcgccatcttcaacctggtgtactgggccacctacgtgaacagagagagcgccatcaagggcatgatcagaaagcagtag

SEQ ID NO: 82634 - DNA, 1479 bp, Artificial Sequence; identical to SEQ ID NO: 82633
  Description of Artificial Sequence: Synthetic coding sequence

SEQ ID NO: 82635 - DNA, 339 bp, Artificial Sequence
  Description of Artificial Sequence: Synthetic coding sequence
gagtacaccatcgacgtgttcttcagacagacctggcacgacgagagactgaagttcgacggccccatgaagatcctgcccctgaacaacctgctggccagcaagatctggacccccgacaccttcttccacaacggcaagaagagcgtggcccacaacatgaccacccccaacaagctgctgagactggtggacaacggcaccctgctgtacaccatgagaatcgaggaggtgcagaagcacagaagcatgatgaagcccagcgtgagctacaccgtggccccctggatccaggagggcggccccggcggcagacacagactgaagatggagaagtag

SEQ ID NO: 82636 - DNA, 1479 bp, Artificial Sequence; identical to SEQ ID NO: 82633
  Description of Artificial Sequence: Synthetic coding sequence

SEQ ID NO: 82637 - DNA, 1665 bp, Artificial Sequence
  Description of Artificial Sequence: Synthetic coding sequence
atggtgagcgccaagaaggtgcccgccatcgccctgagcgccggcgtgagcttcgccctgctgagattcctgtgcctggccgtgtgcctgaacgagagccccggccagaaccagaaggaggagaagctgtgcaccgagaacttcaccagaatcctggacagcctgctggacggctacgacaacagactgagacccggcttcggcggccccgtgaccgaggtgaagaccgacatctacgtgaccagcttcggccccgtgagcgacgtggagatggagtacaccatggacgtgttcttcagacagacctggatcgacaagagactgaagtacgacggccccatcgagatcctgagactgaacaacatgatggtgaccaaggtgtggacccccgacaccttcttcagaaacggcaagaagagcgtgagccacaacatgaccgcccccaacaagctgttcagaatcatgagaaacggcaccatcctgtacaccatgagactgaccatcagcgccgagtgccccatgagactggtggacttccccatggacggccacgcctgccccctgaagttcggcagctacgcctaccccaagagcgagatgatctacacctggaccaagggccccgagaagagcgtggaggtgcccaaggagagcagcagcctggtgcagtacgacctgatcggccagaccgtgagcagcgagaccatcaagagcatcaccggcgagtacatcgtgatgaccgtgtacttccacctgagaagaaagatgggctacttcatgatccagacctacatcccctgcatcatgaccgtgatcctgagccaggtgagcttctggatcaacaaggagagcgtgcccgccagaaccgtgttcggcatcaccaccgtgctgaccatgaccaccctgagcatcagcgccagacacagcctgcccaaggtgagctacgccaccgccatggactggttcatcgccgtgtgcttcgccttcgtgttcagcgccctgatcgagttcgccgccgtgaactacttcaccaacatccagatggagaaggccaagagaaagaccagcaagcccccccaggaggtgcccgccgcccccgtgcagagagagaagcaccccgaggcccccctgcagaacaccaacgccaacctgaacatgagaaagagaaccaacgccctggtgcacagcgagagcgacgtgggcaacagaaccgaggtgggcaaccacagcagcaagagcagcaccgtggtgcaggagagcagcaagggcacccccagaagctacctggccagcagccccaaccccttcagcagagccaacgccgccgagaccatcagcgccgccagagccctgcccagcgccagccccaccagcatcagaaccggctacatgcccagaaaggccagcgtgggcagcgccagcaccagacacgtgttcggcagcagactgcagagaatcaagaccaccgtgaacaccatcggcgccaccggcaagctgagcgccacccccccccccagcgcccccccccccagcggcagcggcaccagcaagatcgacaagtacgccagaatcctgttccccgtgaccttcggcgccttcaacatggtgtactgggtggtgtacctgagcaaggacaccatggagaagagcgagagcctgatgtag

SEQ ID NO: 82638 - DNA, 1389 bp, Artificial Sequence
  Description of Artificial Sequence: Synthetic coding sequence
atggacaacggcatgttcagcggcttcatcatgatcaagaacctgctgctgttctgcatcagcatgaacctgagcagccacttcggcttcagccagatgcccaccagcagcgtgaaggacgagaccaacgacaacatcaccatcttcaccagaatcctggacggcctgctggacggctacgacaacagactgagacccggcctgggcgagagaatcacccaggtgagaaccgacatctacgtgaccagcttcggccccgtgagcgacaccgagatggagtacaccatcgacgtgttcttcagacagagctggaaggacgagagactgagattcaagggccccatgcagagactgcccctgaacaacctgctggccagcaagatctggacccccgacaccttcttccacaacggcaagaagagcatcgcccacaacatgaccacccccaacaagctgctgagactggaggacgacggcaccctgctgtacaccatgagactgaccatcagcgccgagtgccccatgcagctggaggacttccccatggacgcccacgcctgccccctgaagttcggcagctacgcctaccccaacagcgaggtggtgtacgtgtggaccaacggcagcaccaagagcgtggtggtggccgaggacggcagcagactgaaccagtaccacctgatgggccagaccgtgggcaccgagaacatcagcaccagcaccggcgagtacaccatcatgaccgcccacttccacctgaagagaaagatcggctacttcgtgatccagacctacctgccctgcatcatgaccgtgatcctgagccaggtgagcttctggctgaacagagagagcgtgcccgccagaaccgtgttcggcgtgaccaccgtgctgaccatgaccaccctgagcatcagcgccagaaacagcctgcccaaggtggcctacgccaccgccatggactggttcatcgccgtgtgctacgccttcgtgttcagcgccctgatcgagttcgccaccgtgaactacttcaccaagagaggctgggcctgggacggcaagaaggccctggaggccgccaagatcaagaagaagagagaggtgatcctgaacaagagcaccaacgccttcaccaccggcaagatgagccacccccccaacatccccaaggagcagacccccgccggcaccagcaacaccaccagcgtgagcgtgaagcccagcgaggagaagaccagcgagagcaagaagacctacaacagcatcagcaagatcgacaagatgagcagaatcgtgttccccgtgctgttcggcaccttcaacctggtgtactgggccacctacctgaacagagagcccgtgatcaagggcgccgccagccccaagtag

SEQ ID NO: 82639 - DNA, 1389 bp, Artificial Sequence; identical to SEQ ID NO: 82638
  Description of Artificial Sequence: Synthetic coding sequence

SEQ ID NO: 82640 - DNA, 1389 bp, Artificial Sequence; identical to SEQ ID NO: 82638
  Description of Artificial Sequence: Synthetic coding sequence

SEQ ID NO: 82641 - DNA, 261 bp, Artificial Sequence
  Description of Artificial Sequence: Synthetic coding sequence
atggacaacggcatgttcagcggcttcatcatgatcaagaacctgctgctgttctgcatcagcatgaacctgagcagccacttcggcttcagccagatgcccaccagcagcgtgaaggacgagaccaacgacaacatcaccatcttcaccagaatcctggacggcctgctggacggctacgacaacagactgagacccggcctgggcgagagaatcacccaggtgagaaccgacatctacgtgaccagcttcggcccctag

SEQ ID NO: 82642 - DNA, 450 bp, Artificial Sequence
  Description of Artificial Sequence: Synthetic coding sequence
atggacaacggcatgttcagcggcttcatcatgatcaagaacctgctgctgttctgcatcagcatgaacctgagcagccacttcggcttcagccagatgcccaccagcagcgtgaaggacgagaccaacgacaacatcaccatcttcaccagaatcctggacggcctgctggacggctacgacaacagactgagacccggcctgggcgagagaatcacccaggtgagaaccgacatctacgtgaccagcttcggccccgtgagcgacaccgagatggagtacaccatcgacgtgttcttcagacagagctggaaggacgagagactgagattcaagggccccatgcagagactgcccctgaacaacctgctggccagcaagatctggacccccgacaccttcttccacaacggcaagaagagcatcgcccacaacatgaccaccccctag

SEQ ID NO: 82643 - DNA, 501 bp, Artificial Sequence
  Description of Artificial Sequence: Synthetic coding sequence
atggacaacggcatgttcagcggcttcatcatgatcaagaacctgctgctgttctgcatcagcatgaacctgagcagccacttcggcttcagccagatgcccaccagcagcgtgaaggacgagaccaacgacaacatcaccatcttcaccagaatcctggacggcctgctggacggctacgacaacagactgagacccggcctgggcgagagaatcacccaggtgagaaccgacatctacgtgaccagcttcggccccgtgagcgacaccgagatggagtacaccatcgacgtgttcttcagacagagctggaaggacgagagactgagattcaagggccccatgcagagactgcccctgaacaacctgctggccagcaagatctggacccccgacaccttcttccacaacggcaagaagagcatcgcccacaacatgaccacccccaacaagctgctgagactggaggacgacggcaccctgctgtacaccatgagatag

SEQ ID NO: 82644 - DNA, 51 bp, Artificial Sequence
  Description of Artificial Sequence: Synthetic coding sequence
atggacaacggcatgttcagcggcttcatcatgatcaagaacctgctgtag

SEQ ID NO: 82645 - DNA, 1362 bp, Artificial Sequence
  Description of Artificial Sequence: Synthetic coding sequence
atggccagcagcctgccctggctgtgcatcatcctgtggctggagaacgccctgggcaagctggaggtggagggcaacttctacagcgagaacgtgagcagaatcctggacaacctgctggagggctacgacaacagactgagacccggcttcggcggcgccgtgaccgaggtgaagaccgacatctacgtgaccagcttcggccccgtgagcgacgtggagatggagtacaccatggacgtgttcttcagacagacctggaccgacgagagactgaagttcggcggccccaccgagatcctgagcctgaacaacctgatggtgagcaagatctggacccccgacaccttcttcagaaacggcaagaagagcatcgcccacaacatgaccacccccaacaagctgttcagaatcatgcagaacggcaccatcctgtacaccatgagactgaccatcaacgccgactgccccatgagactggtgaacttccccatggacggccacgcctgccccctgaagttcggcagctacgcctaccccaagagcgagatcatctacacctggaagaagggccccctgtacagcgtggaggtgcccgaggagagcagcagcctgctgcagtacgacctgatcggccagaccgtgagcagcgagaccatcaagagcaacaccggcgagtacgtgatcatgaccgtgtacttccacctgcagagaaagatgggctacttcatgatccagatctacaccccctgcatcatgaccgtgatcctgagccaggtgagcttctggatcaacaaggagagcgtgcccgccagaaccgtgttcggcatcaccaccgtgctgaccatgaccaccctgagcatcagcgccagacacagcctgcccaaggtgagctacgccaccgccatggactggttcatcgccgtgtgcttcgccttcgtgttcagcgccctgatcgagttcgccgccgtgaactacttcaccaacctgcagacccagaaggccaagagaaaggcccagttcgccgccccccccaccgtgaccatcagcaaggccaccgagcccctggaggccgagatcgtgctgcaccccgacagcaagtaccacctgaagaagagaatcaccagcctgagcctgcccatcgtgagcagcagcgaggccaacaaggtgctgaccagagcccccatcctgcagagcacccccgtgacccccccccccctgagccccgccttcggcggcaccagcaagatcgaccagtacagcagaatcctgttccccgtggccttcgccggcttcaacctggtgtactgggtggtgtacctgagcaaggacaccatggaggtgagcagcagcgtggagtag

SEQ ID NO: 82646 - DNA, 1332 bp, Artificial Sequence
  Description of Artificial Sequence: Synthetic coding sequence
atggccagcagcctgccctggctgtgcatcatcctgtggctggagaacgccctgggcaagctggaggtggagggcaacttctacagcgagaacgtgagcagaatcctggacaacctgctggagggctacgacaacagactgagacccggcttcggcggcgccgtgaccgaggtgaagaccgacatctacgtgaccagcttcggccccgtgagcgacgtggagatgacctggaccgacgagagactgaagttcggcggccccaccgagatcctgagcctgaacaacctgatggtgagcaagatctggacccccgacaccttcttcagaaacggcaagaagagcatcgcccacaacatgaccacccccaacaagctgttcagaatcatgcagaacggcaccatcctgtacaccatgagactgaccatcaacgccgactgccccatgagactggtgaacttccccatggacggccacgcctgccccctgaagttcggcagctacgcctaccccaagagcgagatcatctacacctggaagaagggccccctgtacagcgtggaggtgcccgaggagagcagcagcctgctgcagtacgacctgatcggccagaccgtgagcagcgagaccatcaagagcaacaccggcgagtacgtgatcatgaccgtgtacttccacctgcagagaaagatgggctacttcatgatccagatctacaccccctgcatcatgaccgtgatcctgagccaggtgagcttctggatcaacaaggagagcgtgcccgccagaaccgtgttcggcatcaccaccgtgctgaccatgaccaccctgagcatcagcgccagacacagcctgcccaaggtgagctacgccaccgccatggactggttcatcgccgtgtgcttcgccttcgtgttcagcgccctgatcgagttcgccgccgtgaactacttcaccaacctgcagacccagaaggccaagagaaaggcccagttcgccgccccccccaccgtgaccatcagcaaggccaccgagcccctggaggccgagatcgtgctgcaccccgacagcaagtaccacctgaagaagagaatcaccagcctgagcctgcccatcgtgagcagcagcgaggccaacaaggtgctgaccagagcccccatcctgcagagcacccccgtgacccccccccccctgagccccgccttcggcggcaccagcaagatcgaccagtacagcagaatcctgttccccgtggccttcgccggcttcaacctggtgtactgggtggtgtacctgagcaaggacaccatggaggtgagcagcagcgtggagtag

SEQ ID NO: 82647 - DNA, 1425 bp, Artificial Sequence
  Description of Artificial Sequence: Synthetic coding sequence
atgtggaccgtgcagaacagagagagcctgggcctgctgagcttccccgtgatgatcaccatggtgtgctgcgcccacagcaccaacgagcccagcaacatgagctacgtgaaggagaccgtggacagactgctgaagggctacgacatcagactgagacccgacttcggcggcccccccgtggacgtgggcatgagaatcgacgtggccagcatcgacatggtgagcgaggtgaacatggactacaccctgaccatgtacttccagcagagctggaaggacaagagactgagctacagcggcatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggaacggcggcgagggcgccgtgaccggcgtgaacaagatcgagctgccccagttcagcatcgtggactacaagatggtgagcaagaaggtggagttcaccaccggcgcctaccccagactgagcctgagcttcagactgaagagaaacatcggctacttcatcctgcagacctacatgcccagcaccctgatcaccatcctgagctgggtgagcttctggatcaactacgacgccagcgccgccagagtggccctgggcatcaccaccgtgctgaccatgaccaccatcagcacccacctgagagagaccctgcccaagatcccctacgtgaaggccatcgacatctacctgatgggctgcttcgtgttcgtgttcctggccctgctggagtacgccttcgtgaactacatcttcttcggcaagggcccccagaagaagggcgccagcaagcaggaccagagcgccaacgagaagaacaagctggagatgaacaaggtgcaggtggacgcccacggcaacatcctgctgagcaccctggagatcagaaacgagaccagcggcagcgaggtgctgaccagcgtgagcgaccccaaggccaccatgtacagctacgacagcgccagcatccagtacagaaagcccctgagcagcagagaggcctacggcagagccctggacagacacggcgtgcccagcaagggcagaatcagaagaagagccagccagctgaaggtgaagatccccgacctgaccgacgtgaacagcatcgacaagtggagcagaatgttcttccccatcaccttcagcctgttcaacgtggtgtactggctgtactacgtgcactag

SEQ ID NO: 82648 - DNA, 1215 bp, Artificial Sequence
  Description of Artificial Sequence: Synthetic coding sequence
atgaccttcgcctgcggcagaaccagcgaggactacaccctgaccatgtacttccagcagagctggaaggacaagagactgagctacagcggcatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggaacggcggcgagggcgccgtgaccggcgtgaacaagatcgagctgccccagttcagcatcgtggactacaagatggtgagcaagaaggtggagttcaccaccggcgcctaccccagactgagcctgagcttcagactgaagagaaacatcggctacttcatcctgcagacctacatgcccagcaccctgatcaccatcctgagctgggtgagcttctggatcaactacgacgccagcgccgccagagtggccctgggcatcaccaccgtgctgaccatgaccaccatcagcacccacctgagagagaccctgcccaagatcccctacgtgaaggccatcgacatctacctgatgggctgcttcgtgttcgtgttcctggccctgctggagtacgccttcgtgaactacatcttcttcggcaagggcccccagaagaagggcgccagcaagcaggaccagagcgccaacgagaagaacaagctggagatgaacaaggtgcaggtggacgcccacggcaacatcctgctgagcaccctggagatcagaaacgagaccagcggcagcgaggtgctgaccagcgtgagcgaccccaaggccaccatgtacagctacgacagcgccagcatccagtacagaaagcccctgagcagcagagaggcctacggcagagccctggacagacacggcgtgcccagcaagggcagaatcagaagaagagccagccagctgaaggtgaagatccccgacctgaccgacgtgaacagcatcgacaagtggagcagaatgttcttccccatcaccttcagcctgttcaacgtggtgtactggctgtactacgtgcactag

SEQ ID NO: 82649 - DNA, 1539 bp, Artificial Sequence
  Description of Artificial Sequence: Synthetic coding sequence
atgtggagagtgagaaagagaggctacttcggcatctggagcttccccctgatcatcgccgccgtgtgcgcccagagcgtgaacgaccccagcaacatgagcctggtgaaggagaccgtggacagactgctgaagggctacgacatcagactgagacccgacttcggcggcccccccgtggccgtgggcatgaacatcgacatcgccagcatcgacatggtgagcgaggtgaacatggactacaccctgaccatgtacttccagcaggcctggagagacaagagactgagctacaacgtgatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggagaggcgacgacaacgccgtgaccggcgtgaccaagatcgagctgccccagttcagcatcgtggactacaagctgatcaccaagaaggtggtgttcagcaccggcagctaccccagactgagcctgagcttcaagctgaagagaaacatcggctacttcatcctgcagacctacatgcccagcatcctgatcaccatcctgagctgggtgagcttctggatcaactacgacgccagcgccgccagagtggccctgggcatcaccaccgtgctgaccatgaccaccatcaacacccacctgagagagaccctgcccaagatcccctacgtgaaggccatcgacatgtacctgatgggctgcttcgtgttcgtgttcatggccctgctggagtacgccctggtgaactacatcttcttcggcagaggcccccagagacagaagaaggccgccgagaaggccgccagcgccaacaacgagaagatgagactggacgtgaacaagatcttctacaaggacatcaagcagaacggcacccagtacagaagcctgtgggaccccaccggcaacctgagccccaccagaagaaccaccaactacgacttcagcctgtacaccatggacccccacgagaacatcctgctgagcaccctggagatcaagaacgagatggccaccagcgaggccgtgatgggcctgggcgaccccagaagcaccatgctggcctacgacgccagcagcatccagtacagaaaggccggcctgcccagacacagcttcggcagaaacgccctggagagacacgtggcccagaagaagagcagactgagaagaagagccagccagctgaagatcaccatccccgacctgaccgacgtgaacgccatcgacagatggagcagaatcttcttccccgtggtgttcagcttcttcaacatcgtgtactggctgtactacgtgaactag

SEQ ID NO: 82650 - DNA, 1425 bp, Artificial Sequence
  Description of Artificial Sequence: Synthetic coding sequence
atgtggagagtgagaaagagaggctacttcggcatctggagcttccccctgatcatcgccgccgtgtgcgcccagagcgtgaacgaccccagcaacatgagcctggtgaaggagaccgtggacagactgctgaagggctacgacatcagactgagacccgacttcggcggcccccccgtggccgtgggcatgaacatcgacatcgccagcatcgacatggtgagcgaggtgaacatggactacaccctgaccatgtacttccagcaggcctggagagacaagagactgagctacaacgtgatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggagaggcgacgacaacgccgtgaccggcgtgaccaagatcgagctgccccagttcagcatcgtggactacaagctgatcaccaagaaggtggtgttcagcaccggcagctaccccagactgagcctgagcttcaagctgaagagaaacatcggctacttcatcctgcagacctacatgcccagcatcctgatcaccatcctgagctgggtgagcttctggatcaactacgacgccagcgccgccagagtggccctgggcatcaccaccgtgctgaccatgaccaccatcaacacccacctgagagagaccctgcccaagatcccctacgtgaaggccatcgacatgtacctgatgggctgcttcgtgttcgtgttcatggccctgctggagtacgccctggtgaactacatcttcttcggcagaggcccccagagacagaagaaggccgccgagaaggccgccagcgccaacaacgagaagatgagactggacgtgaacaagatggacccccacgagaacatcctgctgagcaccctggagatcaagaacgagatggccaccagcgaggccgtgatgggcctgggcgaccccagaagcaccatgctggcctacgacgccagcagcatccagtacagaaaggccggcctgcccagacacagcttcggcagaaacgccctggagagacacgtggcccagaagaagagcagactgagaagaagagccagccagctgaagatcaccatccccgacctgaccgacgtgaacgccatcgacagatggagcagaatcttcttccccgtggtgttcagcttcttcaacatcgtgtactggctgtactacgtgaactag

SEQ ID NO: 82651 - DNA, 1539 bp, Artificial Sequence; identical to SEQ ID NO: 82649
  Description of Artificial Sequence: Synthetic coding sequence

SEQ ID NO: 82652 - DNA, 945 bp, Artificial Sequence
  Description of Artificial Sequence: Synthetic coding sequence
atgatggacctgagaagataccccctggacgagcagaactgcaccctggagatcgagagctacggctacaccaccgacgacatcgagttctactggagaggcgacgacaacgccgtgaccggcgtgaccaagatcgagctgccccagttcagcatcgtggactacaagctgatcaccaagaaggtggtgttcagcaccggcagctaccccagactgagcctgagcttcaagctgaagagaaacatcggctacttcatcctgcagacctacatgcccagcatcctgatcaccatcctgagctgggtgagcttctggatcaactacgacgccagcgccgccagagtggccctgggcatcaccaccgtgctgaccatgaccaccatcaacacccacctgagagagaccctgcccaagatcccctacgtgaaggccatcgacatgtacctgatgggctgcttcgtgttcgtgttcatggccctgctggagtacgccctggtgaactacatcttcttcggcagaggcccccagagacagaagaaggccgccgagaaggccgccagcgccaacaacgagaagatgagactggacgtgaacaagatggacccccacgagaacatcctgctgagcaccctggagatcaagaacgagatggccaccagcgaggccgtgatgggcctgggcgaccccagaagcaccatgctggcctacgacgccagcagcatccagtacagaaaggccggcctgcccagacacagcttcggcagaaacgccctggagagacacgtggcccagaagaagagcagactgagaagaagagccagccagctgaagatcaccatccccgacctgaccgacgtgaacgccatcgacagatggagcagaatcttcttccccgtggtgttcagcttcttcaacatcgtgtactggctgtactacgtgaactag

SEQ ID NO: 82653 - DNA, 1236 bp, Artificial Sequence
  Description of Artificial Sequence: Synthetic coding sequence
atgaacatcgacatcgccagcatcgacatggtgagcgaggtgaacatggactacaccctgaccatgtacttccagcaggcctggagagacaagagactgagctacaacgtgatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggagaggcgacgacaacgccgtgaccggcgtgaccaagatcgagctgccccagttcagcatcgtggactacaagctgatcaccaagaaggtggtgttcagcaccggcagctaccccagactgagcctgagcttcaagctgaagagaaacatcggctacttcatcctgcagacctacatgcccagcatcctgatcaccatcctgagctgggtgagcttctggatcaactacgacgccagcgccgccagagtggccctgggcatcaccaccgtgctgaccatgaccaccatcaacacccacctgagagagaccctgcccaagatcccctacgtgaaggccatcgacatgtacctgatgggctgcttcgtgttcgtgttcatggccctgctggagtacgccctggtgaactacatcttcttcggcagaggcccccagagacagaagaaggccgccgagaaggccgccagcgccaacaacgagaagatgagactggacgtgaacaagatggacccccacgagaacatcctgctgagcaccctggagatcaagaacgagatggccaccagcgaggccgtgatgggcctgggcgaccccagaagcaccatgctggcctacgacgccagcagcatccagtacagaaaggccggcctgcccagacacagcttcggcagaaacgccctggagagacacgtggcccagaagaagagcagactgagaagaagagccagccagctgaagatcaccatccccgacctgaccgacgtgaacgccatcgacagatggagcagaatcttcttccccgtggtgttcagcttcttcaacatcgtgtactggctgtactacgtgaactag

SEQ ID NO: 82654 - DNA, 1425 bp, Artificial Sequence; identical to SEQ ID NO: 82650
  Description of Artificial Sequence: Synthetic coding sequence

SEQ ID NO: 82655 - DNA, 1422 bp, Artificial Sequence
  Description of Artificial Sequence: Synthetic coding sequence
atgtgcagcggcctgctggagctgctgctgcccatctggctgagctggaccctgggcaccagaggcagcgagcccagaagcgtgaacgaccccggcaacatgagcttcgtgaaggagaccgtggacaagctgctgaagggctacgacatcagactgagacccgacttcggcggcccccccgtgtgcgtgggcatgaacatcgacatcgccagcatcgacatggtgagcgaggtgaacatggactacaccctgaccatgtacttccagcagtactggagagacaagagactggcctacagcggcatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggagaggcggcgacaaggccgtgaccggcgtggagagaatcgagctgccccagttcagcatcgtggagcacagactggtgagcagaaacgtggtgttcgccaccggcgcctaccccagactgagcctgagcttcagactgaagagaaacatcggctacttcatcctgcagacctacatgcccagcatcctgatcaccatcctgagctgggtgagcttctggatcaactacgacgccagcgccgccagagtggccctgggcatcaccaccgtgctgaccatgaccaccatcaacacccacctgagagagaccctgcccaagatcccctacgtgaaggccatcgacatgtacctgatgggctgcttcgtgttcgtgttcctggccctgctggagtacgccttcgtgaactacatcttcttcggcagaggcccccagagacagaagaagctggccgagaagaccgccaaggccaagaacgacagaagcaagagcgagagcaacagagtggacgcccacggcaacatcctgctgaccagcctggaggtgcacaacgagatgaacgaggtgagcggcggcatcggcgacaccagaaacagcgccatcagcttcgacaacagcggcatccagtacagaaagcagagcatgcccagagagggccacggcagattcctgggcgacagaagcctgccccacaagaagacccacctgagaagaagaagcagccagctgaagatcaagatccccgacctgaccgacgtgaacgccatcgacagatggagcagaatcgtgttccccttcaccttcagcctgttcaacctggtgtactggctgtactacgtgaactag

SEQ ID NO: 82656 - DNA, 1422 bp, Artificial Sequence
  Description of Artificial Sequence: Synthetic coding sequence
atgtggggcctggccggcggcagactgttcggcatcttcagcgcccccgtgctggtggccgtggtgtgctgcgcccagagcgtgaacgaccccggcaacatgagcttcgtgaaggagaccgtggacaagctgctgaagggctacgacatcagactgagacccgacttcggcggcccccccgtgtgcgtgggcatgaacatcgacatcgccagcatcgacatggtgagcgaggtgaacatggactacaccctgaccatgtacttccagcagtactggagagacaagagactggcctacagcggcatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggagaggcggcgacaaggccgtgaccggcgtggagagaatcgagctgccccagttcagcatcgtggagcacagactggtgagcagaaacgtggtgttcgccaccggcgcctaccccagactgagcctgagcttcagactgaagagaaacatcggctacttcatcctgcagacctacatgcccagcatcctgatcaccatcctgagctgggtgagcttctggatcaactacgacgccagcgccgccagagtggccctgggcatcaccaccgtgctgaccatgaccaccatcaacacccacctgagagagaccctgcccaagatcccctacgtgaaggccatcgacatgtacctgatgggctgcttcgtgttcgtgttcctggccctgctggagtacgccttcgtgaactacatcttcttcggcagaggcccccagagacagaagaagctggccgagaagaccgccaaggccaagaacgacagaagcaagagcgagagcaacagagtggacgcccacggcaacatcctgctgaccagcctggaggtgcacaacgagatgaacgaggtgagcggcggcatcggcgacaccagaaacagcgccatcagcttcgacaacagcggcatccagtacagaaagcagagcatgcccagagagggccacggcagattcctgggcgacagaagcctgccccacaagaagacccacctgagaagaagaagcagccagctgaagatcaagatccccgacctgaccgacgtgaacgccatcgacagatggagcagaatcgtgttccccttcaccttcagcctgttcaacctggtgtactggctgtactacgtgaactag

SEQ ID NO: 82657 - DNA, 1209 bp, Artificial Sequence
  Description of Artificial Sequence: Synthetic coding sequence
atgtgggccacctaccagaccgaggaggactacaccctgaccatgtacttccagcagtactggagagacaagagactggcctacagcggcatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggagaggcggcgacaaggccgtgaccggcgtggagagaatcgagctgccccagttcagcatcgtggagcacagactggtgagcagaaacgtggtgttcgccaccggcgcctaccccagactgagcctgagcttcagactgaagagaaacatcggctacttcatcctgcagacctacatgcccagcatcctgatcaccatcctgagctgggtgagcttctggatcaactacgacgccagcgccgccagagtggccctgggcatcaccaccgtgctgaccatgaccaccatcaacacccacctgagagagaccctgcccaagatcccctacgtgaaggccatcgacatgtacctgatgggctgcttcgtgttcgtgttcctggccctgctggagtacgccttcgtgaactacatcttcttcggcagaggcccccagagacagaagaagctggccgagaagaccgccaaggccaagaacgacagaagcaagagcgagagcaacagagtggacgcccacggcaacatcctgctgaccagcctggaggtgcacaacgagatgaacgaggtgagcggcggcatcggcgacaccagaaacagcgccatcagcttcgacaacagcggcatccagtacagaaagcagagcatgcccagagagggccacggcagattcctgggcgacagaagcctgccccacaagaagacccacctgagaagaagaagcagccagctgaagatcaagatccccgacctgaccgacgtgaacgccatcgacagatggagcagaatcgtgttccccttcaccttcagcctgttcaacctggtgtactggctgtactacgtgaactag

SEQ ID NO: 82658 - DNA, 1167 bp, Artificial Sequence
  Description of Artificial Sequence: Synthetic coding sequence
atgtacttccagcagtactggagagacaagagactggcctacagcggcatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggagaggcggcgacaaggccgtgaccggcgtggagagaatcgagctgccccagttcagcatcgtggagcacagactggtgagcagaaacgtggtgttcgccaccggcgcctaccccagactgagcctgagcttcagactgaagagaaacatcggctacttcatcctgcagacctacatgcccagcatcctgatcaccatcctgagctgggtgagcttctggatcaactacgacgccagcgccgccagagtggccctgggcatcaccaccgtgctgaccatgaccaccatcaacacccacctgagagagaccctgcccaagatcccctacgtgaaggccatcgacatgtacctgatgggctgcttcgtgttcgtgttcctggccctgctggagtacgccttcgtgaactacatcttcttcggcagaggcccccagagacagaagaagctggccgagaagaccgccaaggccaagaacgacagaagcaagagcgagagcaacagagtggacgcccacggcaacatcctgctgaccagcctggaggtgcacaacgagatgaacgaggtgagcggcggcatcggcgacaccagaaacagcgccatcagcttcgacaacagcggcatccagtacagaaagcagagcatgcccagagagggccacggcagattcctgggcgacagaagcctgccccacaagaagacccacctgagaagaagaagcagccagctgaagatcaagatccccgacctgaccgacgtgaacgccatcgacagatggagcagaatcgtgttccccttcaccttcagcctgttcaacctggtgtactggctgtactacgtgaactag

SEQ ID NO: 82659 - DNA, 417 bp, Artificial Sequence
  Description of Artificial Sequence: Synthetic coding sequence
atgtacttccagcagtactggagagacaagagactggcctacagcggcatccccctgaacctgaccctggacaacagagtggccgaccagctgtgggtgcccgacacctacttcctgaacgacaagaagagcttcgtgcacggcgtgaccgtgaagaacagaatgatcagactgcaccccgacggcaccgtgctgtacggcctgagaatcaccaccaccgccgcctgcatgatggacctgagaagataccccctggacgagcagaactgcaccctggagatcgagagctacggctacaccaccgacgacatcgagttctactggagaggcggcgacaaggccgtgaccggcgtggagagaatcgagctgccccagttcagcatcgtggagcacagactggtgagcagaaacgtgtag

SEQ ID NO: 82660 - DNA, 1359 bp, Artificial Sequence
  Description of Artificial Sequence: Synthetic coding sequence
atggacgcccccgccagactgctggcccccctgctgctgctgtgcgcccagcagctgagaggcaccagagccatgaacgacatcggcgactacgtgggcagcaacctggagatcagctggctgcccaacctggacggcctgatcgccggctacgccagaaacttcagacccggcatcggcggcccccccgtgaacgtggccctggccctggaggtggccagcatcgaccacatcagcgaggccaacatggagtacaccatgaccgtgttcctgcaccagagctggagagacagcagactgagctacaaccacaccaacgagaccctgggcctggacagcagattcgtggacaagctgtggctgcccgacaccttcatcgtgaacgccaagagcgcctggttccacgacgtgaccgtggagaacaagctgatcagactgcagcccgacggcgtgatcctgtacagcatcagaatcaccagcaccgtggcctgcgacatggacctggccaagtaccccatggacgagcaggagtgcatgctggacctggagagctacggctacagcagcgaggacatcgtgtactactggagcgagagccaggagcacatccacggcctggacaagctgcagctggcccagttcaccatcaccagctacagattcaccaccgagctgatgaacttcaagagcgccggccagttccccagactgagcctgcacttccacctgagaagaaacagaggcgtgtacatcatccagagctacatgcccagcgtgctgctggtggccatgagctgggtgagcttctggatcagccaggccgccgtgcccgccagagtgagcctgggcatcaccaccgtgctgaccatgaccaccctgatggtgagcgccagaagcagcctgcccagagccagcgccatcaaggccctggacgtgtacttctggatctgctacgtgttcgtgttcgccgccctggtggagtacgccttcgcccacttcaacgccgactacagaaagaagcagaaggccaaggtgaaggtgagcagacccagagccgagatggacgtgagaaacgccatcgtgctgttcagcctgagcgccgccggcgtgacccaggagctggccatcagcagaagacagagaagagtgcccggcaacctgatgggcagctacagaagcgtgggcgtggagaccggcgagaccaagaaggagggcgccgccagaagcggcggccagggcggcatcagagccagactgagacccatcgacgccgacaccatcgacatctacgccagagccgtgttccccgccgccttcgccgccgtgaacgtgatctactgggccgcctacgccatgtag

SEQ ID NO: 82661 - DNA, 1521 bp, Artificial Sequence
  Description of Artificial Sequence: Synthetic coding sequence
atgctgagcaaggtgctgcccgtgctgctgggcatcctgctgatcctgcagagcagagtggagggcccccagaccgagagcaagaacgaggccagcagcagagacgtggtgtacggcccccagccccagcccctggagaaccagctgctgagcgaggagaccaagagcaccgagaccgagaccggcagcagagtgggcaagctgcccgaggccagcagaatcctgaacaccatcctgagcaactacgaccacaagctgagacccggcatcggcgagaagcccaccgtggtgaccgtggagatcagcgtgaacagcctgggccccctgagcatcctggacatggagtacaccatcgacatcatcttcagccagacctggtacgacgagagactgtgctacaacgacaccttcgagagcctggtgctgaacggcaacgtggtgagccagctgtggatccccgacaccttcttcagaaacagcaagagaacccacgagcacgagatcaccatgcccaaccagatggtgagaatctacaaggacggcaaggtgctgtacaccatcagaatgaccatcgacgccggctgcagcctgcacatgctgagattccccatggacagccacagctgccccctgagcttcagcagcttcagctaccccgagaacgagatgatctacaagtgggagaacttcaagctggagatcaacgagaagaacagctggaagctgttccagttcgacttcaccggcgtgagcaacaagaccgagatcatcaccacccccgtgggcgacttcatggtgatgaccatcttcttcaacgtgagcagaagattcggctacgtggccttccagaactacgtgcccagcagcgtgaccaccatgctgagctgggtgagcttctggatcaagaccgagagcgcccccgccagaaccagcctgggcatcaccagcgtgctgaccatgaccaccctgggcaccttcagcagaaagaacttccccagagtgagctacatcaccgccctggacttctacatcgccatctgcttcgtgttctgcttctgcgccctgctggagttcgccgtgctgaacttcctgatctacaaccagaccaaggcccacgccagccccaagctgagacaccccagaatcaacagcagagcccacgccagaaccagagccagaagcagagcctgcgccagacagcaccaggaggccttcgtgtgccagatcgtgaccaccgagggcagcgacggcgaggagagacccagctgcagcgcccagcagccccccagccccggcagccccgagggccccagaagcctgtgcagcaagctggcctgctgcgagtggtgcaagagattcaagaagtacttctgcatggtgcccgactgcgagggcagcacctggcagcagggcagactgtgcatccacgtgtacagactggacaactacagcagagtggtgttccccgtgaccttcttcttcttcaacgtgctgtactggctggtgtgcctgaacctgtag

SEQ ID NO: 82662 - DNA, 420 bp, Artificial Sequence
  Description of Artificial Sequence: Synthetic coding sequence
atgagaagcccctgccccaccagatggagcgccagcaccagaatggccagatgctgcacccagctggtgagctaccccgagaacgagatgatctacaagtgggagaacttcaagctggagatcaacgagaagaacagctggaagctgttccagttcgacttcaccggcgtgagcaacaagaccgagatcatcaccacccccgtgggcgacctgaacgaggagcccagagacctgcccagagtggcccccagagccaccctggagaccctgttcacccaccccgaccaggtgcagggcagcgagggcaccgccctgatcgtgagcagaatgtggatggagcccgtgacccagcccgccatctgcagagagagacacctggtgctgctgcccttcaagatccccagacaggaggacttctag

SEQ ID NO: 82663 - DNA, 1398 bp, Artificial Sequence
  Description of Artificial Sequence: Synthetic coding sequence
atgggccccctgaaggccttcctgttcagccccttcctgctgagaagccagagcagaggcgtgagactggtgttcctgctgctgaccctgcacctgggcaactgcgtggacaaggccgacgacgaggacgacgaggacctgaccgtgaacaagacctgggtgctggcccccaagatccacgagggcgacatcacccagatcctgaacagcctgctgcagggctacgacaacaagctgagacccgacatcggcgtgagacccaccgtgatcgagaccgacgtgtacgtgaacagcatcggccccgtggaccccatcaacatggagtacaccatcgacatcatcttcgcccagacctggttcgacagcagactgaagttcaacagcaccatgaaggtgctgatgctgaacagcaacatggtgggcaagatctggatccccgacaccttcttcagaaacagcagaaagagcgacgcccactggatcaccacccccaacagactgctgagaatctggaacgacggcagagtgctgtacaccctgagactgaccatcaacgccgagtgctacctgcagctgcacaacttccccatggacgagcacagctgccccctggagttcagcagctacggctaccccaagaacgagatcgagtacaagtggaagaagcccagcgtggaggtggccgaccccaagtactggagactgtaccagttcgccttcgtgggcctgagaaacagcaccgagatcacccacaccatcagcggcgactacgtgatcatgaccatcttcttcgacctgagcagaagaatgggctacttcaccatccagacctacatcccctgcatcctgaccgtggtgctgagctgggtgagcttctggatcaacaaggacgccgtgcccgccagaaccagcctgggcatcaccaccgtgctgaccatgaccaccctgagcaccatcgccagaaagagcctgcccaaggtgagctacgtgaccgccatggacctgttcgtgagcgtgtgcttcatcttcgtgttcgccgccctgatggagtacggcaccctgcactacttcaccagcaaccagaagggcaagaccgccaccaaggacagaaagctgaagaacaaggccagcatgacccccggcctgcaccccggcagcaccctgatccccatgaacaacatcagcgtgccccaggaggacgactacggctaccagtgcctggagggcaaggactgcgccagcttcttctgctgcttcgaggactgcagaaccggcagctggagagagggcagaatccacatcagaatcgccaagatcgacagctacagcagaatcttcttccccaccgccttcgccctgttcaacctggtgtactgggtgggctacctgtacctgtag

SEQ ID NO: 82664 - DNA, 1260 bp, Artificial Sequence
  Description of Artificial Sequence: Synthetic coding sequence
atgggccccctgaaggccttcctgttcagccccttcctgctgagaagccagagcagaggcgtgagactggtgttcctgctgctgaccctgcacctgggcaactgcgtggacaaggccgacgacgaggacgacgaggacctgaccgtgaacaagacctgggtgctggcccccaagatccacgagggcgacatcacccagatcctgaacagcctgctgcagggctacgacaacaagctgagacccgacatcggcgtgagacccaccgtgatcgagaccgacgtgtacgtgaacagcatcggccccgtggaccccatcaacatggagtacaccatcgacatcatcttcgcccagacctggttcgacagcagactgaagttcaacagcaccatgaaggtgctgatgctgaacagcaacatggtgggcaagatctggatccccgacaccttcttcagaaacagcagaaagagcgacgcccactggatcaccacccccaacagactgctgagaatctggaacgacggcagagtgctgtacaccctgagactgaccatcaacgccgagtgctacctgcagctgcacaacttccccatggacgagcacagctgccccctggagttcagcagctacggctaccccaagaacgagatcgagtacaagtggaagaagcccagcgtggaggtggccgaccccaagtactggagactgtaccagttcgccttcgtgggcctgagaaacagcaccgagatcacccacaccatcagcggcgactacgtgatcatgaccatcttcttcgacctgagcagaagaatgggctacttcaccatccagacctacatcccctgcatcctgaccgtggtgctgagctgggtgagcttctggatcaacaaggacgccgtgcccgccagaaccagcctgggcatcaccaccgtgctgaccatgaccaccctgagcaccatcgccagaaagagcctgcccaaggtgagctacgtgaccgccatggacctgttcgtgagcgtgtgcttcatcttcgtgttcgccgccctgatggagtacggcaccctgcactacttcaccagcaaccagaagggcaagaccgccaccaaggacagaaagctgaagaacaaggccagcatgacccccggcctgcaccccggcagcaccctgatccccatgaacaacatcagcgtgccccaggaggacgactacggctaccagtgcctggagggcagaaaggacacccacacccactgccagaactag

SEQ ID NO: 82665 - DNA, 1428 bp, Artificial Sequence
  Description of Artificial Sequence: Synthetic coding sequence
atgagcagccccaacatctggagcaccggcagcagcgtgtacagcacccccgtgttcagccagaagatgaccgtgtggatcctgctgctgctgagcctgtaccccggcttcaccagccagaagagcgacgacgactacgaggactacgccagcaacaagacctgggtgctgacccccaaggtgcccgagggcgacgtgaccgtgatcctgaacaacctgctggagggctacgacaacaagctgagacccgacatcggcgtgaagcccaccctgatccacaccgacatgtacgtgaacagcatcggccccgtgaacgccatcaacatggagtacaccatcgacatcttcttcgcccagacctggtacgacagaagactgaagttcaacagcaccatcaaggtgctgagactgaacagcaacatggtgggcaagatctggatccccgacaccttcttcagaaacagcaagaaggccgacgcccactggatcaccacccccaacagaatgctgagaatctggaacgacggcagagtgctgtacaccctgagactgaccatcgacgccgagtgccagctgcagctgcacaacttccccatggacgagcacagctgccccctggagttcagcagctacggctaccccagagaggagatcgtgtaccagtggaagagaagcagcgtggaggtgggcgacaccagaagctggagactgtaccagttcagcttcgtgggcctgagaaacaccaccgaggtggtgaagaccaccagcggcgactacgtggtgatgagcgtgtacttcgacctgagcagaagaatgggctacttcaccatccagacctacatcccctgcaccctgatcgtggtgctgagctgggtgagcttctggatcaacaaggacgccgtgcccgccagaaccagcctgggcatcaccaccgtgctgaccatgaccaccctgagcaccatcgccagaaagagcctgcccaaggtgagctacgtgaccgccatggacctgttcgtgagcgtgtgcttcatcttcgtgttcagcgccctggtggagtacggcaccctgcactacttcgtgagcaacagaaagcccagcaaggacaaggacaagaagaagaagaaccccctgctgagaatgttcagcttcaaggcccccaccatcgacatcagacccagaagcgccaccatccagatgaacaacgccacccacctgcaggagagagacgaggagtacggctacgagtgcctggacggcaaggactgcgccagcttcttctgctgcttcgaggactgcagaaccggcgcctggagacacggcagaatccacatcagaatcgccaagatggacagctacgccagaatcttcttccccaccgccttctgcctgttcaacctggtgtactgggtgagctacctgtacctgtag

SEQ ID NO: 82666 - DNA, 1404 bp, Artificial Sequence
  Description of Artificial Sequence: Synthetic coding sequence
atgagcagccccaacatctggagcaccggcagcagcgtgtacagcacccccgtgttcagccagaagatgaccgtgtggatcctgctgctgctgagcctgtaccccggcttcaccagccagaagagcgacgacgactacgaggactacgccagcaacaagacctgggtgctgacccccaaggtgcccgagggcgacgtgaccgtgatcctgaacaacctgctggagggctacgacaacaagctgagacccgacatcggcgtgaagcccaccctgatccacaccgacatgtacgtgaacagcatcggccccgtgaacgccatcaacatggagtacaccatcgacatcttcttcgcccagacctggtacgacagaagactgaagttcaacagcaccatcaaggtgctgagactgaacagcaacatggtgggcaagatctggatccccgacaccttcttcagaaacagcaagaaggccgacgcccactggatcaccacccccaacagaatgctgagaatctggaacgacggcagagtgctgtacaccctgagactgaccatcgacgccgagtgccagctgcagctgcacaacttccccatggacgagcacagctgccccctggagttcagcagctacggctaccccagagaggagatcgtgtaccagtggaagagaagcagcgtggaggtgggcgacaccagaagctggagactgtaccagttcagcttcgtgggcctgagaaacaccaccgaggtggtgaagaccaccagcggcgactacgtggtgatgagcgtgtacttcgacctgagcagaagaatgggctacttcaccatccagacctacatcccctgcaccctgatcgtggtgctgagctgggtgagcttctggatcaacaaggacgccgtgcccgccagaaccagcctgggcatcaccaccgtgctgaccatgaccaccctgagcaccatcgccagaaagagcctgcccaaggtgagctacgtgaccgccatggacctgttcgtgagcgtgtgcttcatcttcgtgttcagcgccctggtggagtacggcaccctgcactacttcgtgagcaacagaaagcccagcaaggacaaggacaagaagaagaagaaccccgcccccaccatcgacatcagacccagaagcgccaccatccagatgaacaacgccacccacctgcaggagagagacgaggagtacggctacgagtgcctggacggcaaggactgcgccagcttcttctgctgcttcgaggactgcagaaccggcgcctggagacacggcagaatccacatcagaatcgccaagatggacagctacgccagaatcttcttccccaccgccttctgcctgttcaacctggtgtactgggtgagctacctgtacctgtag

SEQ ID NO: 82667 - DNA, 1119 bp, Artificial Sequence
  Description of Artificial Sequence: Synthetic coding sequence
atgtacgtgaacagcatcggccccgtgaacgccatcaacatggagtacaccatcgacatcttcttcgcccagacctggtacgacagaagactgaagttcaacagcaccatcaaggtgctgagactgaacagcaacatggtgggcaagatctggatccccgacaccttcttcagaaacagcaagaaggccgacgcccactggatcaccacccccaacagaatgctgagaatctggaacgacggcagagtgctgtacaccctgagactgaccatcgacgccgagtgccagctgcagctgcacaacttccccatggacgagcacagctgccccctggagttcagcagctacggctaccccagagaggagatcgtgtaccagtggaagagaagcagcgtggaggtgggcgacaccagaagctggagactgtaccagttcagcttcgtgggcctgagaaacaccaccgaggtggtgaagaccaccagcggcgactacgtggtgatgagcgtgtacttcgacctgagcagaagaatgggctacttcaccatccagacctacatcccctgcaccctgatcgtggtgctgagctgggtgagcttctggatcaacaaggacgccgtgcccgccagaaccagcctgggcatcaccaccgtgctgaccatgaccaccctgagcaccatcgccagaaagagcctgcccaaggtgagctacgtgaccgccatggacctgttcgtgagcgtgtgcttcatcttcgtgttcagcgccctggtggagtacggcaccctgcactacttcgtgagcaacagaaagcccagcaaggacaaggacaagaagaagaagaaccccgcccccaccatcgacatcagacccagaagcgccaccatccagatgaacaacgccacccacctgcaggagagagacgaggagtacggctacgagtgcctggacggcaaggactgcgccagcttcttctgctgcttcgaggactgcagaaccggcgcctggagacacggcagaatccacatcagaatcgccaagatggacagctacgccagaatcttcttccccaccgccttctgcctgttcaacctggtgtactgggtgagctacctgtacctgtag

SEQ ID NO: 82668 - DNA, 1404 bp, Artificial Sequence
  Description of Artificial Sequence: Synthetic coding sequence
atggcccccaagctgctgctgctgctgtgcctgttcagcggcctgcacgccagaagcagaaaggtggaggaggacgagtacgaggacagcagcagcaaccagaagtgggtgctggcccccaagagccaggacaccgacgtgaccctgatcctgaacaagctgctgagagagtacgacaagaagctgagacccgacatcggcatcaagcccaccgtgatcgacgtggacatctacgtgaacagcatcggccccgtgagcagcatcaacatggagtaccagatcgacatcttcttcgcccagacctggaccgacagcagactgagattcaacagcaccatgaagatcctgaccctgaacagcaacatggtgggcctgatctggatccccgacaccatcttcagaaacagcaagaccgccgaggcccactggatcaccacccccaaccagctgctgagaatctggaacgacggcaagatcctgtacaccctgagactgaccatcaacgccgagtgccagctgcagctgcacaacttccccatggacgagcacagctgccccctgatcttcagcagctacggctaccccaaggaggagatgatctacagatggagaaagaacagcgtggaggccgccgaccagaagagctggagactgtaccagttcgacttcatgggcctgagaaacaccaccgagatcgtgaccaccagcgccggcgactacgtggtgatgaccatctacttcgagctgagcagaagaatgggctacttcaccatccagacctacatcccctgcatcctgaccgtggtgctgagctgggtgagcttctggatcaagaaggacgccacccccgccagaaccgccctgggcatcaccaccgtgctgaccatgaccaccctgagcaccatcgccagaaagagcctgcccagagtgagctacgtgaccgccatggacctgttcgtgaccgtgtgcttcctgttcgtgttcgccgccctgatggagtacgccaccctgaactactacagcagctgcagaaagcccaccaccaccaagaagaccaccagcctgctgcaccccgacagcagcagatggatccccgagagaatcagcctgcaggcccccagcaactacagcctgctggacatgagacccccccccaccgccatgatcaccctgaacaacagcgtgtactggcaggagttcgaggacacctgcgtgtacgagtgcctggacggcaaggactgccagagcttcttctgctgctacgaggagtgcaagagcggcagctggagaaagggcagaatccacatcgacatcctggagctggacagctacagcagagtgttcttccccaccagcttcctgctgttcaacctggtgtactgggtgggctacctgtacctgtag

SEQ ID NO: 82669 - DNA, 1323 bp, Artificial Sequence
  Description of Artificial Sequence: Synthetic coding sequence
atgaactacagcctgcacctggccttcgtgtgcctgagcctgttcaccgagagaatgtgcatccagggcagccagttcaacgtggaggtgggcagaagcgacaagctgagcctgcccggcttcgagaacctgaccgccggctacaacaagttcctgagacccaacttcggcggcgagcccgtgcagatcgccctgaccctggacatcgccagcatcagcagcatcagcgagagcaacatggactacaccgccaccatctacctgagacagagatggatggaccagagactggtgttcgagggcaacaagagcttcaccctggacgccagactggtggagttcctgtgggtgcccgacacctacatcgtggagagcaagaagagcttcctgcacgaggtgaccgtgggcaacagactgatcagactgttcagcaacggcaccgtgctgtacgccctgagaatcaccaccaccgtggcctgcaacatggacctgagcaagtaccccatggacacccagacctgcaagctgcagctggagagctggggctacgacggcaacgacgtggagttcacctggctgagaggcaacgacagcgtgagaggcctggagcacctgagactggcccagtacaccatcgagagatacttcaccctggtgaccagaagccagcaggagaccggcaactacaccagactggtgctgcagttcgagctgagaagaaacgtgctgtacttcatcctggagacctacgtgcccagcaccttcctggtggtgctgagctgggtgagcttctggatcagcctggacagcgtgcccgccagaacctgcatcggcgtgaccaccgtgctgagcatgaccaccctgatgatcggcagcagaaccagcctgcccaacaccaactgcttcatcaaggccatcgacgtgtacctgggcatctgcttcagcttcgtgttcggcgccctgctggagtacgccgtggcccactacagcagcctgcagcagatggccgccaaggacagaggcaccaccaaggaggtggaggaggtgagcatcaccaacatcatcaacagcagcatcagcagcttcaagagaaagatcagcttcgccagcatcgagatcagcagcgacaacgtggactacagcgacctgaccatgaagaccagcgacaagttcaagttcgtgttcagagagaagatgggcagaatcgtggactacttcaccatccagaaccccagcaacgtggaccactacagcaagctgctgttccccctgatcttcatgctggccaacgtgttctactgggcctactacatgtacttctag

SEQ ID NO: 82670 - DNA, 159 bp, Artificial Sequence
  Description of Artificial Sequence: Synthetic coding sequence
atgaactacagcctgcacctggccttcgtgtgcctgagcctgttcaccgagagaatgtgcatccagggcagccagttcaacgtggaggtgggcagaagcgacaagctgagcctgcccggcttcgagaacctgaccgccggctacaacaagttcctgtag

SEQ ID NO: 82671 - DNA, 1323 bp, Artificial Sequence; identical to SEQ ID NO: 82669
  Description of Artificial Sequence: Synthetic coding sequence

SEQ ID NO: 82672 - DNA, 180 bp, Artificial Sequence
  Description of Artificial Sequence: Synthetic coding sequence
atgaactacagcctgcacctggccttcgtgtgcctgagcctgttcaccgagagaatgtgcatccagggcagccagttcaacgtggaggtgggcagaagcgacaagctgagcctgcccggcttcgagaacctgaccgccggctacaacaagttcctgagacccaacttcggcggcgagtag

SEQ ID NO: 82673 - DNA, 279 bp, Artificial Sequence
  Description of Artificial Sequence: Synthetic coding sequence
atgaactacagcctgcacctggccttcgtgtgcctgagcctgttcaccgagagaatgtgcatccagggcagccagttcaacgtggaggtgggcagaagcgacaagctgagcctgcccggcttcgagaacctgaccgccggctacaacaagttcctgagacccaacttcggcggcgagcccgtgcagatcgccctgaccctggacatcgccagcatcagcagcatcagcgagagcaacatggactacaccgccaccatctacctgagacagagatggtag

SEQ ID NO: 82674 - DNA, 516 bp, Artificial Sequence
  Description of Artificial Sequence: Synthetic coding sequence
atgaactacagcctgcacctggccttcgtgtgcctgagcctgttcaccgagagaatgtgcatccagggcagccagttcaacgtggaggtgggcagaagcgacaagctgagcctgcccggcttcgagaacctgaccgccggctacaacaagttcctgagacccaacttcggcggcgagcccgtgcagatcgccctgaccctggacatcgccagcatcagcagcatcagcgagagcaacatggactacaccgccaccatctacctgagacagagatggatggaccagagactggtgttcgagggcaacaagagcttcaccctggacgccagactggtggagttcctgtgggtgcccgacacctacatcgtggagagcaagaagagcttcctgcacgaggtgaccgtgggcaacagactgatcagactgttcagcaacggcaccgtgctgtacgccctgagaatcaccaccaccgtggcctgcaacatggacctgagcaagtaccccatggacacctag

SEQ ID NO: 82675 - DNA, 570 bp, Artificial Sequence
  Description of Artificial Sequence: Synthetic coding sequence
atgaactacagcctgcacctggccttcgtgtgcctgagcctgttcaccgagagaatgtgcatccagggcagccagttcaacgtggaggtgggcagaagcgacaagctgagcctgcccggcttcgagaacctgaccgccggctacaacaagttcctgagacccaacttcggcggcgagcccgtgcagatcgccctgaccctggacatcgccagcatcagcagcatcagcgagagcaacatggactacaccgccaccatctacctgagacagagatggatggaccagagactggtgttcgagggcaacaagagcttcaccctggacgccagactggtggagttcctgtgggtgcccgacacctacatcgtggagagcaagaagagcttcctgcacgaggtgaccgtgggcaacagactgatcagactgttcagcaacggcaccgtgctgtacgccctgagaatcaccaccaccgtggcctgcaacatggacctgagcaagtaccccatggacacccagacctgcaagctgcagctggagagctggggctacgacggcaacgacgtggagtag

SEQ ID NO: 82676 - DNA, 564 bp, Artificial Sequence
  Description of Artificial Sequence: Synthetic coding sequence
atggactacaccgccaccatctacctgagacagagatggatggaccagagactggtgttcgagggcaacaagagcttcaccctggacgaggtgaccgtgggcaacagactgatcagactgttcagcaacggcaccgtgctgtacgccctgagaatcaccaccaccgtggcctgcaacatggacctgagcaagtaccccatggacacccagacctgcaagctgcagctggagagctggggctacgacggcaacgacgtggagttcacctggctgagaggcaacgacagcgtgagaggcctggagcacctgagactggcccagtacaccatcgagagatacttcaccctggtgaccagaagccagcaggagaccggcaactacaccagactggtgctgcagttcgagctgagaagaaacgtgctgtacttcatcctggagacctacgtgcccagcaccttcctggtggtgctgagctgggtgagcttctggatcagcctggacagcgtgcccgccagaacctgcatcggcgacaacaagggcagcagaagaagccagtactactag

SEQ ID NO: 82677 - DNA, 2826 bp, Artificial Sequence
  Description of Artificial Sequence: Synthetic coding sequence
atggccagccccagaagcagcggccagcccggccccccccccccccccccccccccccccgccagactgctgctgctgctgctgctgcccctgctgctgcccctggcccccggcgcctggggctgggccagaggcgcccccagacccccccccagcagcccccccctgagcatcatgggcctgatgcccctgaccaaggaggtggccaagggcagcatcggcagaggcgtgctgcccgccgtggagctggccatcgagcagatcagaaacgagagcctgctgagaccctacttcctggacctgagactgtacgacaccgagtgcgacaacgccaagggcctgaaggccttctacgacgccatcaagtacggccccaaccacctgatggtgttcggcggcgtgtgccccagcgtgaccagcatcatcgccgagagcctgcagggctggaacctggtgcagctgagcttcgccgccaccacccccgtgctggccgacaagaagaagtacccctacttcttcagaaccgtgcccagcgacaacgccgtgaaccccgccatcctgaagctgctgaagcactaccagtggaagagagtgggcaccctgacccaggacgtgcagagattcagcgaggtgagaaacgacctgaccggcgtgctgtacggcgaggacatcgagatcagcgacaccgagagcttcagcaacgacccctgcaccagcgtgaagaagctgaagggcaacgacgtgagaatcatcctgggccagttcgaccagaacatggccgccaaggtgttctgctgcgcctacgaggagaacatgtacggcagcaagtaccagtggatcatccccggctggtacgagcccagctggtgggagcaggtgcacaccgaggccaacagcagcagatgcctgagaaagaacctgctggccgccatggagggctacatcggcgtggacttcgagcccctgagcagcaagcagatcaagaccatcagcggcaagaccccccagcagtacgagagagagtacaacaacaagagaagcggcgtgggccccagcaagttccacggctacgcctacgacggcatctgggtgatcgccaagaccctgcagagagccatggagaccctgcacgccagcagcagacaccagagaatccaggacttcaactacaccgaccacaccctgggcagaatcatcctgaacgccatgaacgagaccaacttcttcggcgtgaccggccaggtggtgttcagaaacggcgagagaatgggcaccatcaagttcacccagttccaggacagcagagaggtgaaggtgggcgagtacaacgccgtggccgacaccctggagatcatcaacgacaccatcagattccagggcagcgagccccccaaggacaagaccatcatcctggagcagctgagaaagatcagcctgcccctgtacagcatcctgagcgccctgaccatcctgggcatgatcatggccagcgccttcctgttcttcaacatcaagaacagaaaccagaagctgatcaagatgagcagcccctacatgaacaacctgatcatcctgggcggcatgctgagctacgccagcatcttcctgttcggcctggacggcagcttcgtgagcgagaagaccttcgagaccctgtgcaccgtgagaacctggatcctgaccgtgggctacaccaccgccttcggcgccatgttcgccaagacctggagagtgcacgccatcttcaagaacgtgaagatgaagaagaagatcatcaaggaccagaagctgctggtgatcgtgggcggcatgctgctgatcgacctgtgcatcctgatctgctggcaggccgtggaccccctgagaagaaccgtggagaagtacagcatggagcccgaccccgccggcagagacatcagcatcagacccctgctggagcactgcgagaacacccacatgaccatctggctgggcatcgtgtacgcctacaagggcctgctgatgctgttcggctgcttcctggcctgggagaccagaaacgtgagcatccccgccctgaacgacagcaagtacatcggcatgagcgtgtacaacgtgggcatcatgtgcatcatcggcgccgccgtgagcttcctgaccagagaccagcccaacgtgcagttctgcatcgtggccctggtgatcatcttctgcagcaccatcaccctgtgcctggtgttcgtgcccaagctgatcaccctgagaaccaaccccgacgccgccacccagaacagaagattccagttcacccagaaccagaagaaggaggacagcaagaccagcaccagcgtgaccagcgtgaaccaggccagcaccagcagactggagggcctgcagagcgagaaccacagactgagaatgaagatcaccgagctggacaaggacctggaggaggtgaccatgcagctgcaggacacccccgagaagaccacctacatcaagcagaaccactaccaggagctgaacgacatcctgaacctgggcaacttcaccgagagcaccgacggcggcaaggccatcctgaagaaccacctggaccagaacccccagctgcagtggaacaccaccgagcccagcagaacctgcaaggaccccatcgaggacatcaacagccccgagcacatccagagaagactgagcctgcagctgcccatcctgcaccacgcctacctgcccagcatcggcggcgtggacgccagctgcgtgagcccctgcgtgagccccaccgccagccccagacacagacacgtgccccccagcttcagagtgatggtgagcggcctgtag

SEQ ID NO: 82678 - DNA, 1179 bp, Artificial Sequence
  Description of Artificial Sequence: Synthetic coding sequence
atgagacccggcttcggcggccccgccatccccgtgggcgtggacgtgcaggtggagagcctggacagcatcagcgaggtggacatggacttcaccatgaccctgtacctgagacactactggaaggacgagagactgagcttccccagcaccaacaacctgagcatgaccttcgacggcagactggtgaagaagatctgggtgcccgacatgttcttcgtgcacagcaagagaagcttcatccacgacaccaccaccgacaacgtgatgctgagagtgcagcccgacggcaaggtgctgtacagcctgagagtgaccgtgaccgccatgtgcaacatggacttcagcagattccccctggacacccagacctgcagcctggagatcgagagctacgcctacaccgaggacgacctgatgctgtactggaagaagggcaacgacagcctgaagaccgacgagagaatcagcctgagccagttcctgatccaggagttccacaccaccaccaagctggccttctacagcagcaccggctggtacaacagactgtacatcaacttcaccctgagaagacacatcttcttcttcctgctgcagacctacttccccgccaccctgatggtgatgctgagctgggtgagcttctggatcgacagaagagccgtgcccgccagagtgcccctgggcatcaccaccgtgctgaccatgagcaccatcatcaccggcgtgaacgccagcatgcccagagtgagctacatcaaggccgtggacatctacctgtgggtgagcttcgtgttcgtgttcctgagcgtgctggagtacgccgccgtgaactacctgaccaccgtgcaggagagaaaggagcagaagctgagagagaagctgccctgcaccagcggcctgcccccccccagaaccgccatgctggacggcaactacagcgacggcgaggtgaacgacctggacaactacatgcccgagaacggcgagaagcccgacagaatgatggtgcagctgaccctggccagcgagagaagcagcccccagagaaagagccagagaagcagctacgtgagcatgagaatcgacacccacgccatcgacaagtacagcagaatcatcttccccgccgcctacatcctgttcaacctgatctactggagcatcttcagctag

SEQ ID NO: 82679 - DNA, 1389 bp, Artificial Sequence
  Description of Artificial Sequence: Synthetic coding sequence
atgctggccgtgcccaacatgagattcggcatcttcctgctgtggtggggctgggtgctggccaccgagagcagaatgcactggcccggcagagaggtgcacgagatgagcaagaagggcagccccatcctgagaagaagccccgacatcaccaagagccccctgaccaagagcgagcagctgctgagaatcgacgaccacgacttcagcatgagacccggcttcggcggccccgccatccccgtgggcgtggacgtgcaggtggagagcctggacagcatcagcgaggtggacatggacttcaccatgaccctgtacctgagacactactggaaggacgagagactgagcttccccagcaccaacaacctgagcatgaccttcgacggcagactggtgaagaagatctgggtgcccgacatgttcttcgtgcacagcaagagaagcttcatccacgacaccaccaccgacaacgtgatgctgagagtgcagcccgacggcaaggtgctgtacagcctgagagtgaccgtgaccgccatgtgcaacatggacttcagcagattccccctggacacccagacctgcagcctggagatcgagagctacgcctacaccgaggacgacctgatgctgtactggaagaagggcaacgacagcctgaagaccgacgagagaatcagcctgagccagttcctgatccaggagttccacaccaccaccaagctggccttctacagcagcaccggctggtacaacagactgtacatcaacttcaccctgagaagacacatcttcttcttcctgctgcagacctacttccccgccaccctgatggtgatgctgagctgggtgagcttctggatcgacagaagagccgtgcccgccagagtgcccctgggcatcaccaccgtgctgaccatgagcaccatcatcaccggcgtgaacgccagcatgcccagagtgagctacatcaaggccgtggacatctacctgtgggtgagcttcgtgttcgtgttcctgagcgtgctggagtacgccgccgtgaactacctgaccaccgtgcaggagagaaaggagcagaagctgagagagaagctgccctgcaccagcggcctgcccccccccagaaccgccatgctggacggcaactacagcgacggcgaggtgaacgacctggacaactacatgcccgagaacggcgagaagcccgacagaatgatggtgcagctgaccctggccagcgagagaagcagcccccagagaaagagccagagaagcagctacgtgagcatgagaatcgacacccacgccatcgacaagtacagcagaatcatcttccccgccgcctacatcctgttcaacctgatctactggagcatcttcagctag

SEQ ID NO: 82680 - DNA, 1179 bp, Artificial Sequence; identical to SEQ ID NO: 82678
  Description of Artificial Sequence: Synthetic coding sequence

SEQ ID NO: 82681 - DNA, 1440 bp, Artificial Sequence
  Description of Artificial Sequence: Synthetic coding sequence
atgctggccgtgcccaacatgagattcggcatcttcctgctgtggtggggctgggtgctggccaccgagagcagaatgcactggcccggcagagaggtgcacgagatgagcaagaagggcagaccccagagacagagaagagaggtgcacgaggacgcccacaagcaggtgagccccatcctgagaagaagccccgacatcaccaagagccccctgaccaagagcgagcagctgctgagaatcgacgaccacgacttcagcatgagacccggcttcggcggccccgccatccccgtgggcgtggacgtgcaggtggagagcctggacagcatcagcgaggtggacatggacttcaccatgaccctgtacctgagacactactggaaggacgagagactgagcttccccagcaccaacaacctgagcatgaccttcgacggcagactggtgaagaagatctgggtgcccgacatgttcttcgtgcacagcaagagaagcttcatccacgacaccaccaccgacaacgtgatgctgagagtgcagcccgacggcaaggtgctgtacagcctgagagtgaccgtgaccgccatgtgcaacatggacttcagcagattccccctggacacccagacctgcagcctggagatcgagagctacgcctacaccgaggacgacctgatgctgtactggaagaagggcaacgacagcctgaagaccgacgagagaatcagcctgagccagttcctgatccaggagttccacaccaccaccaagctggccttctacagcagcaccggctggtacaacagactgtacatcaacttcaccctgagaagacacatcttcttcttcctgctgcagacctacttccccgccaccctgatggtgatgctgagctgggtgagcttctggatcgacagaagagccgtgcccgccagagtgcccctgggcatcaccaccgtgctgaccatgagcaccatcatcaccggcgtgaacgccagcatgcccagagtgagctacatcaaggccgtggacatctacctgtgggtgagcttcgtgttcgtgttcctgagcgtgctggagtacgccgccgtgaactacctgaccaccgtgcaggagagaaaggagcagaagctgagagagaagctgccctgcaccagcggcctgcccccccccagaaccgccatgctggacggcaactacagcgacggcgaggtgaacgacctggacaactacatgcccgagaacggcgagaagcccgacagaatgatggtgcagctgaccctggccagcgagagaagcagcccccagagaaagagccagagaagcagctacgtgagcatgagaatcgacacccacgccatcgacaagtacagcagaatcatcttccccgccgcctacatcctgttcaacctgatctactggagcatcttcagctag

SEQ ID NO: 82682 - DNA, 1473 bp, Artificial Sequence
  Description of Artificial Sequence: Synthetic coding sequence
atggtgaagcccggcggcatctgcagcgccaccggctactggaaggccgccttctgcctgaccgacgtgcacaagatgccctacttcaccagactgatcctgttcctgttctgcctgatggtgctggtggagagcagaaagcccaagagaaagagatggaccggccaggtggagatgcccaagcccagccacctgtacaagaagaacctggacgtgaccaagatcagaaagggcaagccccagcagctgctgagagtggacgagcacgacttcagcatgagacccgccttcggcggccccgccatccccgtgggcgtggacgtgcaggtggagagcctggacagcatcagcgaggtggacatggacttcaccatgaccctgtacctgagacactactggaaggacgagagactggccttcagcagcgccagcaacaagagcatgaccttcgacggcagactggtgaagaagatctgggtgcccgacgtgttcttcgtgcacagcaagagaagcttcacccacgacaccaccaccgacaacatcatgctgagagtgttccccgacggccacgtgctgtacagcatgagaatcaccgtgaccgccatgtgcaacatggacttcagccacttccccctggacagccagacctgcagcctggagctggagagctacgcctacaccgacgaggacctgatgctgtactggaagaacggcgacgagagcctgaagaccgacgagaagatcagcctgagccagttcctgatccagaagttccacaccaccagcagactggccttctacagcagcaccggctggtacaacagactgtacatcaacttcaccctgagaagacacatcttcttcttcctgctgcagacctacttccccgccaccctgatggtgatgctgagctgggtgagcttctggatcgacagaagagccgtgcccgccagagtgagcctgggcatcaccaccgtgctgaccatgaccaccatcatcaccggcgtgaacgccagcatgcccagagtgagctacgtgaaggccgtggacatctacctgtgggtgagcttcgtgttcgtgttcctgagcgtgctggagtacgccgccgtgaactacctgaccaccgtgcaggagagaaaggagagaaagctgagagagaagttcccctgcatgtgcggcatgctgcacagcaagaccatgatgctggacggcagctacagcgagagcgaggccaacagcctggccggctaccccagaagccacatcctgaccgaggaggagagacaggacaagatcgtggtgcacctgggcctgagcggcgaggccaacgccgccagaaagaagggcctgctgaagggccagaccggcttcagaatcttccagaacacccacgccatcgacaagtacagcagactgatcttccccgccagctacatcttcttcaacctgatctactggagcgtgttcagctag

SEQ ID NO: 82683 - DNA, 453 bp, Artificial Sequence
  Description of Artificial Sequence: Synthetic coding sequence
atgctgagagccgccgtgatcctgctgctgatcagaacctggctggccgagggcaactaccccagccccatccccaagttccacttcgagttcagcagcgccgtgcccgaggtggtgctgaacctgttcaactgcaagaactgcgccaacgaggccgtggtgcagaagatcctggacagagtgctgagcagatacgacgtgagactgagacccaacttcggcggcgtgctggagaccaacagcacctggggcctgaacgacgacgagctgatggcccacggccaggagaaggacagcagcagcgagagcgaggacagctgcccccccagccccggctgcagcttcaccgagggcttcagcttcgacctgttcaaccccgactacgtgcccaaggtggacaagtggagcagattcctgttccccctggccttcggcctgttcaacatcgtgtag

SEQ ID NO: 82684 - DNA, 1899 bp, Artificial Sequence
  Description of Artificial Sequence: Synthetic coding sequence
atgggcatcagaggcatgctgagagccgccgtgatcctgctgctgatcagaacctggctggccgagggcaactaccccagccccatccccaagttccacttcgagttcagcagcgccgtgcccgaggtggtgctgaacctgttcaactgcaagaactgcgccaacgaggccgtggtgcagaagatcctggacagagtgctgagcagatacgacgtgagactgagacccaacttcggcggcgcccccgtgcccgtgagaatcagcatctacgtgaccagcatcgagcagatcagcgagatgaacatggactacaccatcaccatgttcttccaccagacctggaaggacagcagactggcctactacgagaccaccctgaacctgaccctggactacagaatgcacgagaagctgtgggtgcccgactgctacttcctgaacagcaaggacgccttcgtgcacgacgtgaccgtggagaacagagtgttccagctgcaccccgacggcaccgtgagatacggcatcagactgaccaccaccgccgcctgcagcctggacctgcacaagttccccatggacaagcaggcctgcaacctggtggtggagagctacggctacaccgtggaggacatcatcctgttctgggacgacaacggcaacgccatccacatgaccgaggagctgcacatcccccagttcaccttcctgggcagaaccatcaccagcaaggaggtgtacttctacaccggcagctacatcagactgatcctgaagttccaggtgcagagagaggtgaacagctacctggtgcaggtgtactggcccaccgtgctgaccaccatcaccagctggatcagcttctggatgaactacgacagcagcgccgccagagtgaccatcggcctgaccagcatgctgatcctgaccaccatcgacagccacctgagagacaagctgcccaacatcagctgcatcaaggccatcgacatctacatcctggtgtgcctgttcttcgtgttcctgagcctgctggagtacgtgtacatcaactacctgttctacagcagaggccccagaagacagcccagaagacacagaagacccagaagagtgatcgccagatacagataccagcaggtggtggtgggcaacgtgcaggacggcctgatcaacgtggaggacggcgtgagcagcctgcccatcacccccgcccaggcccccctggccagccccgagagcctgggcagcctgaccagcaccagcgagcaggcccagctggccaccagcgagagcctgagccccctgaccagcctgagcggccaggcccccctggccaccggcgagagcctgagcgacctgcccagcaccagcgagcaggccagacacagctacggcgtgagattcaacggcttccaggccgacgacagcatcttccccaccgagatcagaaacagagtggaggcccacggccacggcgtgacccacgaccacgaggacagcaacgagagcctgagcagcgacgagagacacggccacggccccagcggcaagcccatgctgcaccacggcgagaagggcgtgcaggaggccggctgggacctggacgacaacaacgacaagagcgactgcctggccatcaaggagcagttcaagtgcgacaccaacagcacctggggcctgaacgacgacgagctgatggcccacggccaggagaaggacagcagcagcgagagcgaggacagctgcccccccagccccggctgcagcttcaccgagggcttcagcttcgacctgttcaaccccgactacgtgcccaaggtggacaagtggagcagattcctgttccccctggccttcggcctgttcaacatcgtgtactgggtgtaccacatgtactag

SEQ ID NO: 82685 - DNA, 1083 bp, Artificial Sequence
  Description of Artificial Sequence: Synthetic coding sequence
atggacagcagcaactgcaaggtgatcgcccccctgctgagccagagatacagaagaatggtgaccaaggacggccacagcaccctgcagatggacggcgcccagagaggcctggcctacctgagagacgcctggggcatcctgatggacatgagatggagatggatgatgctggtgttcagcgccagcttcgtggtgcactggctggtgttcgccgtgctgtggtacgtgctggccgagatgaacggcgacctggagctggaccacgacgccccccccgagaaccacaccatctgcgtgaagtacatcaccagcttcaccgccgccttcagcttcagcctggagacccagctgaccatcggctacggcaccatgttccccagcggcgactgccccagcgccatcgccctgctggccatccagatgctgctgggcctgatgctggaggccttcatcaccggcgccttcgtggccaagatcgccagacccaagaacagagccttcagcatcagattcaccgacaccgccgtggtggcccacatggacggcaagcccaacctgatcttccaggtggccaacaccagacccagccccctgaccagcgtgagagtgagcgccgtgctgtaccaggagagagagaacggcaagctgtaccagaccagcgtggacttccacctggacggcatcagcagcgacgagtgccccttcttcatcttccccctgacctactaccacagcatcacccccagcagccccctggccaccctgctgcagcacgagaaccccagccacttcgagctggtggtgttcctgagcgccatgcaggagggcaccggcgagatctgccagagaagaaccagctacctgcccagcgagatcatgctgcaccactgcttcgccagcctgctgaccagaggcagcaagggcgagtaccagatcaagatggagaacttcgacaagaccgtgcccgagttccccacccccctggtgagcaagagccccaacagaaccgacctggacatccacatcaacggccagagcatcgacaacttccagatcagcgagaccggcctgaccgagtag

SEQ ID NO: 82686 - DNA, 2106 bp, Artificial Sequence
  Description of Artificial Sequence: Synthetic coding sequence
atggccgtgagcgccggcagcgccagaaccagccccagcagcggcttcctgatggtgctggacatcccccaggagagaggcctgagcagcctggacagaaagtacctggacggcctggacgtgtgcagattccccctgctggacgccctgagacccctgcccctggactggatgtacctggtgtacaccatcatgttcctgggcgccctgggcatgatgctgggcctgtgctacagaatcagctgcgtgctgttcctgctgccctactggtacgtgttcctgctggacaagaccagctggaacaaccacagctacctgtacggcctgctggccttccagctgaccttcatggacgccaaccactactggagcgtggacggcctgctgaacgcccacagaagaaacgcccacgtgcccctgtggaactacgccgtgctgagaggccagatcttcatcgtgtacttcatcgccggcgtgaagaagctggacgccgactgggtggagggctacagcatggagtacctgagcagacactggctgttcagccccttcaagctgctgctgagcgaggagctgaccagcctgctggtggtgcactggggcggcctgctgctggacctgagcgccggcttcctgctgttcttcgacgtgagcagaagcatcggcctgttcttcgtgagctacttccactgcatgaacagccagctgttcagcatcggcatgttcagctacgtgatgctggccagcagccccctgttctgcagccccgagtggcccagaaagctggtgagctactgccccagaagactgcagcagctgctgcccctgaaggccgccccccagcccagcgtgagctgcgtgtacaagagaagcagaggcaagagcggccagaagcccggcctgagacaccagctgggcgccgccttcaccctgctgtacctgctggagcagctgttcctgccctacagccacttcctgacccagggctacaacaactggaccaacggcctgtacggctacagctgggacatgatggtgcacagcagaagccaccagcacgtgaagatcacctacagagacggcagaaccggcgagctgggctacctgaaccccggcgtgttcacccagagcagaagatggaaggaccacgccgacatgctgaagcagtacgccacctgcctgagcagactgctgcccaagtacaacgtgaccgagccccagatctacttcgacatctgggtgagcatcaacgacagattccagcagagaatcttcgaccccagagtggacatcgtgcaggccgcctggagccccttccagagaaccagctgggtgcagcccctgctgatggacctgagcccctggagagccaagctgcaggagatcaagagcagcctggacaaccacaccgaggtggtgttcatcgccgacttccccggcctgcacctggagaacttcgtgagcgaggacctgggcaacaccagcatccagctgctgcagggcgaggtgaccgtggagctggtggccgagcagaagaaccagaccctgagagagggcgagaagatgcagctgcccgccggcgagtaccacaaggtgtacaccaccagccccagccccagctgctacatgtacgtgtacgtgaacaccaccgagctggccctggagcaggacctggcctacctgcaggagctgaaggagaaggtggagaacggcagcgagaccggccccctgccccccgagctgcagcccctgctggagggcgaggtgaagggcggccccgagcccacccccctggtgcagaccttcctgagaagacagcagagactgcaggagatcgagagaagaagaaacacccccttccacgagagattcttcagattcctgctgagaaagctgtacgtgttcagaagaagcttcctgatgacctgcatcagcctgagaaacctgatcctgggcagacccagcctggagcagctggcccaggaggtgacctacgccaacctgagacccttcgaggccgtgggcgagctgaaccccagcaacaccgacagcagccacagcaacccccccgagagcaaccccgaccccgtgcacagcgagttctag

SEQ ID NO: 82687 - DNA, 957 bp, Artificial Sequence
  Description of Artificial Sequence: Synthetic coding sequence
atggccagccccggctgcctgctgtgcgtgctgggcctgctgctgtgcggcgccgccagcctggagctgagcagaccccacggcgacaccgccaagaagcccatcatcggcatcctgatgcagaagtgcagaaacaaggtgatgaagaactacggcagatactacatcgccgccagctacgtgaagtacctggagagcgccggcgccagagtggtgcccgtgagactggacctgaccgagaaggactacgagatcctgttcaagagcatcaacggcatcctgttccccggcggcagcgtggacctgagaagaagcgactacgccaaggtggccaagatcttctacaacctgagcatccagagcttcgacgacggcgactacttccccgtgtggggcacctgcctgggcttcgaggagctgagcctgctgatcagcggcgagtgcctgctgaccgccaccgacaccgtggacgtggccatgcccctgaacttcaccggcggccagctgcacagcagaatgttccagaacttccccaccgagctgctgctgagcctggccgtggagcccctgaccgccaacttccacaagtggagcctgagcgtgaagaacttcaccatgaacgagaagctgaagaagttcttcaacgtgctgaccaccaacaccgacggcaagatcgagttcatcagcaccatggagggctacaagtaccccgtgtacggcgtgcagtggcaccccgagaaggccccctacgagtggaagaacctggacggcatcagccacgcccccaacgccgtgaagaccgccttctacctggccgagttcttcgtgaacgaggccagaaagaacaaccaccacttcaagagcgagagcgaggaggagaaggccctgatctaccagttcagccccatctacaccggcaacatcagcagcttccagcagtgctacatcttcgactag

SEQ ID NO: 82688 - DNA, 345 bp, Artificial Sequence
  Description of Artificial Sequence: Synthetic coding sequence
atggccaacagcggctgcaaggacgtgaccggccccgacgaggagagcttcctgtacttcgcctacggcagcaacctgctgaccgagagaatccacctgagaaaccccagcgccgccttcttctgcgtggccagactgcaggacttcaagctggacttcggcaacagccagggcaagaccagccagacctggcacggcggcatcgccaccatcttccagagccccggcgacgaggtgtggggcgtggtgtggaagatgaacaagagcaacctgaacagcctggacgagctgttcgcctgggtgcagaagaagatggtgtgcagatggagcatcaagagaagctag

SEQ ID NO: 82689 - DNA, 567 bp, Artificial Sequence
  Description of Artificial Sequence: Synthetic coding sequence
atggccaacagcggctgcaaggacgtgaccggccccgacgaggagagcttcctgtacttcgcctacggcagcaacctgctgaccgagagaatccacctgagaaaccccagcgccgccttcttctgcgtggccagactgcaggacttcaagctggacttcggcaacagccagggcaagaccagccagacctggcacggcggcatcgccaccatcttccagagccccggcgacgaggtgtggggcgtggtgtggaagatgaacaagagcaacctgaacagcctggacgagcaggagggcgtgaagagcggcatgtacgtggtgatcgaggtgaaggtggccacccaggagggcaaggagatcacctgcagaagctacctgatgaccaactacgagagcgccccccccagcccccagtacaagaagatcatctgcatgggcgccaaggagaacggcctgcccctggagtaccaggagaagctgaaggccatcgagcccaacgactacaccggcaaggtgagcgaggagatcgaggacatcatcaagaagggcgagacccagaccctgtag

SEQ ID NO: 82690 - DNA, 384 bp, Artificial Sequence
  Description of Artificial Sequence: Synthetic coding sequence
atgttcaaccccatccaccacctggactactacaagaagaccctgcccagcgagctgaactggctgggccagatgtggctgaagttcggctgcagcggcttcagacaggagggcgtgaagagcggcatgtacgtggtgatcgaggtgaaggtggccacccaggagggcaaggagatcacctgcagaagctacctgatgaccaactacgagagcgccccccccagcccccagtacaagaagatcatctgcatgggcgccaaggagaacggcctgcccctggagtaccaggagaagctgaaggccatcgagcccaacgactacaccggcaaggtgagcgaggagatcgaggacatcatcaagaagggcgagacccagaccctgtag

SEQ ID NO: 82691 - DNA, 285 bp, Artificial Sequence
  Description of Artificial Sequence: Synthetic coding sequence
atggccaacagcggctgcaaggacgtgaccggccccgacgaggagagcttcctgtacttcgcctacggcagcaacctgctgaccgagagaatccacctgagaaaccccagcgccgccttcttctgcgtggccagactgcagatcatctgcatgggcgccaaggagaacggcctgcccctggagtaccaggagaagctgaaggccatcgagcccaacgactacaccggcaaggtgagcgaggagatcgaggacatcatcaagaagggcgagacccagaccctgtag

SEQ ID NO: 82692 - DNA, 501 bp, Artificial Sequence
  Description of Artificial Sequence: Synthetic coding sequence
atggccaacagcggctgcaaggacgtgaccggccccgacgaggagagcttcctgtacttcgcctacggcagcaacctgctgaccgagagaatccacctgagaaaccccagcgccgccttcttctgcgtggccagactgcaggacttcaagctggacttcggcaacagccagggcaagaccagccagacctggcacggcggcatcgccaccatcttccagagccccggcgacgaggtgtggggcgtggtgtggaagatgaacaagagcaacctgaacagcctggacgagtggagaaagaagagacacaccgccttccagaaccagggcaaccacccctgcaagcacaagaccagaatgtgggacagagaccccaagatccccgtgcagaacctgagcctggccctgtgctggcaggcccagagcggccacggcacctgcaacagactgttcgcctgggtgcagaagaagatggtgtgcagatggagcatcaagagaagctag

SEQ ID NO: 82693 - DNA, 1710 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtggcccccagactggccttcgccaccatgttcaacagcagcgagcagagccagaagggcggcctgagcgtggccgtgcccggcgagatcagaggctacgagctggcccaccagagacacggcagactgccctgggccagactgttccagcccagcatccagctggccagacagggcttccccgtgggcaagggcctggccgccgccctggagaacaagagaaccgtgatcgagcagcagcccgtgctgtgcgaggtgttctgcagagacagaaaggtgctgagagagggcgagagactgaccctgccccagctggccgacacctacgagaccctggccatcgagggcgcccaggccttctacaacggcagcctgaccgcccagatcgtgaaggacatccaggccgccggcggcatcgtgaccgccgaggacctgaacaactacagagccgagctgatcgagcaccccctgaacatcagcctgggcgacgtggtgctgtacatgcccagcgcccccctgagcggccccgtgctggccctgatcctgaacatcctgaagggctacaacttcagcagagagagcgtggagagccccgagcagaagggcctgacctaccacagaatcgtggaggccttcagattcgcctacgccaagagaaccctgctgggcgaccccaagttcgtggacgtgaccgaggtggtgagaaacatgaccagcgagttcttcgccgcccagctgagagcccagatcagcgacgacaccacccaccccatcagctactacaagcccgagttctacacccccgacgacggcggcaccgcccacctgagcgtggtggccgaggacggcagcgccgtgagcgccaccagcaccatcaacctgtacttcggcagcaaggtgagaagccccgtgagcggcatcctgttcaacaacgagatggacgacttcagcagccccagcatcaccaacgagttcggcgtgccccccagccccgccaacttcatccagcccggcaagcagcccctgagcagcatgtgccccaccatcatggtgggccaggacggccaggtgagaatggtggtgggcgccgccggcggcacccagatcaccaccgccaccgccctggccatcatctacaacctgtggttcggctacgacgtgaagagagccgtggaggagcccagactgcacaaccagctgctgcccaacgtgaccaccgtggagagaaacatcgaccaggccgtgaccgccgccctggagaccagacaccaccacacccagatcgccagcaccttcatcgccgtggtgcaggccatcgtgagaaccgccggcggctgggccgccgccagcgacagcagaaagggcggcgagcccgccggctactag

SEQ ID NO: 82694 - DNA, 1710 bp, Artificial Sequence; identical to SEQ ID NO: 82693
  Description of Artificial Sequence: Synthetic coding sequence

SEQ ID NO: 82695 - DNA, 1710 bp, Artificial Sequence; identical to SEQ ID NO: 82693
  Description of Artificial Sequence: Synthetic coding sequence

SEQ ID NO: 82696 - DNA, 1710 bp, Artificial Sequence; identical to SEQ ID NO: 82693
  Description of Artificial Sequence: Synthetic coding sequence

SEQ ID NO: 82697 - DNA, 678 bp, Artificial Sequence
  Description of Artificial Sequence: Synthetic coding sequence
atgaccagcgagttcttcgccgcccagctgagagcccagatcagcgacgacaccacccaccccatcagctactacaagcccgagttctacacccccgacgacggcggcaccgcccacctgagcgtggtggccgaggacggcagcgccgtgagcgccaccagcaccatcaacctgtacttcggcagcaaggtgagaagccccgtgagcggcatcctgttcaacaacgagatggacgacttcagcagccccagcatcaccaacgagttcggcgtgccccccagccccgccaacttcatccagcccggcaagcagcccctgagcagcatgtgccccaccatcatggtgggccaggacggccaggtgagaatggtggtgggcgccgccggcggcacccagatcaccaccgccaccgccctggccatcatctacaacctgtggttcggctacgacgtgaagagagccgtggaggagcccagactgcacaaccagctgctgcccaacgtgaccaccgtggagagaaacatcgaccaggccgtgaccgccgccctggagaccagacaccaccacacccagatcgccagcaccttcatcgccgtggtgcaggccatcgtgagaaccgccggcggctgggccgccgccagcgacagcagaaagggcggcgagcccgccggctactag

SEQ ID NO: 82698 - DNA, 678 bp, Artificial Sequence; identical to SEQ ID NO: 82697
  Description of Artificial Sequence: Synthetic coding sequence

SEQ ID NO: 82699 - DNA, 678 bp, Artificial Sequence; identical to SEQ ID NO: 82697
  Description of Artificial Sequence: Synthetic coding sequence

SEQ ID NO: 82700 - DNA, 1710 bp, Artificial Sequence; identical to SEQ ID NO: 82693
  Description of Artificial Sequence: Synthetic coding sequence

SEQ ID NO: 82701 - DNA, 363 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtggcccccagactggccttcgccaccatgttcaactag

SEQ ID NO: 82702 - DNA, 1392 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtggcccccagactggccttcgccaccatgttcaacagcagcgagcagagccagaagggcggcctgagcgtggccgtgcccggcgagatcagaggctacgagctggcccaccagagacacggcagactgccctgggccagactgttccagcccagcatccagctggccagacagggcttccccgtgggcaagggcctggccgccgccctggagaacaagagaaccgtgatcgagcagcagcccgtgctgtgcgaggtgttctgcagagacagaaaggtgctgagagagggcgagagactgaccctgccccagctggccgacacctacgagaccctggccatcgagggcgcccaggccttctacaacggcagcctgaccgcccagatcgtgaaggacatccaggccgccggcggcatcgtgaccgccgaggacctgaacaactacagagccgagctgatcgagcaccccctgaacatcagcctgggcgacgtggtgctgtacatgcccagcgcccccctgagcggccccgtgctggccctgatcctgaacatcctgaagggctacaacttcagcagagagagcgtggagagccccgagcagaagggcctgacctaccacagaatcgtggaggccttcagattcgcctacgccaagagaaccctgctgggcgaccccaagttcgtggacgtgaccgaggtggtgagaaacatgaccagcgagttcttcgccgcccagctgagagcccagatcagcgacgacaccacccaccccatcagctactacaagcccgagttctacacccccgacgacggcggcaccgcccacctgagcgtggtggccgaggacggcagcgccgtgagcgccaccagcaccatcaacctgtacttcggcagcaaggtgagaagccccgtgagcggcatcctgttcaacaacgagatggacgacttcagcagccccagcatcaccaacgagttcggcgtgccccccagccccgccaacttcatccagcccggcaagcagcccctgagcagcatgtgccccaccatcatggtgggccaggacggctag

SEQ ID NO: 82703 - DNA, 243 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcctag

SEQ ID NO: 82704 - DNA, 525 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtggcccccagactggccttcgccaccatgttcaacagcagcgagcagagccagaagggcggcctgagcgtggccgtgcccggcgagatcagaggctacgagctggcccaccagagacacggcagactgccctgggccagactgttccagcccagcatccagctggccagacagggcttccccgtgggcaagggcctgtag

SEQ ID NO: 82705 - DNA, 381 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtggcccccagactggccttcgccaccatgttcaacagcagcgagcagagccagtag

SEQ ID NO: 82706 - DNA, 330 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtgtag

SEQ ID NO: 82707 - DNA, 336 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtggccccctag

SEQ ID NO: 82708 - DNA, 114 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtag

SEQ ID NO: 82709 - DNA, 207 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgcctag

SEQ ID NO: 82710 - DNA, 381 bp, Artificial Sequence; identical to SEQ ID NO: 82705
  Description of Artificial Sequence: Synthetic coding sequence

SEQ ID NO: 82711 - DNA, 351 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtggcccccagactggccttcgcctag

SEQ ID NO: 82712 - DNA, 384 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccaccagaaaggccgaggtgatcaacgccagagaggtggcccccagactggccttcgccaccatgttcaacagcagcgagcagagccagaagtag

SEQ ID NO: 82713 - DNA, 297 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccgtggccgccgacgccaagcagtgcagcaagatcggcagagacgccctgagagacggcggcagcgccgtggacgccgccatcgccgccctgctgtgcgtgggcctgatgaacgcccacagcatgggcatcggcggcggcctgttcctgaccatctacaacagcaccacctag

SEQ ID NO: 82714 - DNA, 93 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagctag

SEQ ID NO: 82715 - DNA, 1710 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccatggccgccgacgccaagcagtgcctggagatcggcagagacaccctgagagacggcggcagcgccgtggacgccgccatcgccgccctgctgtgcgtgggcctgatgaacgcccacagcatgggcatcggcgtgggcctgttcctgaccatctacaacagcaccaccagaaaggccgaggtgatcaacgccagagaggtggcccccagactggccttcgccagcatgttcaacagcagcgagcagagccagaagggcggcctgagcgtggccgtgcccggcgagatcagaggctacgagctggcccaccagagacacggcagactgccctgggccagactgttccagcccagcatccagctggccagacagggcttccccgtgggcaagggcctggccgccgtgctggagaacaagagaaccgtgatcgagcagcagcccgtgctgtggtacgtgttctgcagagacagaaaggtgctgagagagggcgagagactgaccctgcccagactggccgacacctacgagatgctggccatcgagggcgcccaggccttctacaacggcagcctgatggcccagatcgtgaaggacatccaggccgccggcggcatcgtgaccgccgaggacctgaacaactacagagccgagctgatcgagcaccccctgaacatcagcctgggcgacgccgtgctgtacatgcccagcgccagactgagcggccccgtgctggccctgatcctgaacatcctgaagggctacaacttcagcagagagagcgtggagacccccgagcagaagggcctgacctaccacagaatcgtggaggccttcagattcgcctacgccaagagaaccctgctgggcgaccccaagttcgtggacgtgaccgaggtggtgagaaacatgaccagcgagttcttcgccgcccagctgagaagccagatcagcgaccacaccacccaccccatcagctactacaagcccgagttctacacccccgacgacggcggcaccgcccacctgagcgtggtggccgaggacggcagcgccgtgagcgccaccagcaccatcaacctgtacttcggcagcaaggtgtgcagccccgtgagcggcatcctgttcaacaacgagtggaccaccagcgccctgcccgccttcaccaacgagttcggcgccccccccagccccgccaacttcatccagcccggcaagcagcccctgctgagcatgtgcctgaccatcatggtgggccaggacggccaggtgagaatggtggtgggcgccgccggcggcacccagatcaccaccgacaccgccctggccatcatctacaacctgtggttcggctacgacgtgaagagagccgtggaggagcccagactgcacaacaagctgctgcccaacgtgaccaccgtggagagaaacatcgaccaggccgtgaccgccgccctggagaccagacaccaccacacccagatcgccagcaccttcatcgccgtggtgcaggccatcgtgagaaccgccggcggctgggccgccgccagcgacagcagaaagggcggcgagcccgccggctactag

SEQ ID NO: 82716 - DNA, 1680 bp, Artificial Sequence
  Description of Artificial Sequence: Synthetic coding sequence
atgaagaagaagctggtggtgctgggcctgctggccgtggtgctggtgctggtgatcgtgggcctgtgcctgtggctgcccagcgccagcaaggagcccgacaaccacgtgtacaccagagccgccatggccgccgacgccaagcagtgcctggagatcggcagagacaccctgagagacggcggcagcgccgtggacgccgccatcgccgccctgctgtgcgtgggcctgatgaacgcccacagcatgggcatcggcgtgggcctgttcctgaccatctacaacagcaccaccagaaaggccgaggtgatcaacgccagagaggtggcccccagactggccttcgccagcatgttcaacagcagcgagcagagccagaagggcggcctgagcgtggccgtgcccggcgagatcagaggctacgagctggcccaccagagacacggcagactgccctgggccagactgttccagcccagcatccagctggccagacagggcttccccgtgggcaagggcctggccgccgtgctggagaacaagagaaccgtgatcgagcagcagcccgtgctgtggtacgtgttctgcagagacagaaaggtgctgagagagggcgagagactgaccctgcccagactggccgacacctacgagatgctggccatcgagggcgcccaggccttctacaacggcagcctgatggcccagatcgtgaaggacatccaggccgccggcggcatcgtgaccgccgaggacctgaacaactacagagccgagctgatcgagcaccccctgaacatcagcctgggcgacgccgtgctgtacatgcccagcgccagactgagcggccccgtgctggccctgatcctgaacatcctgaagggctacaacttcagcagagagagcgtggagacccccgagcagaagggcctgacctaccacagaatcgtggaggccttcagattcgcctacgccaagagaaccctgctgggcgaccccaagttcgtggacgtgaccgaggtggtgagaaacatgaccagcgagttcttcgccgcccagctgagaagccagatcagcgaccacaccacccaccccatcagctactacaagcccgagttctacacccccgacgacggcggcaccgcccacctgagcgtggtggccgaggacggcagcgccgtgagcgccaccagcaccatcaacctgtacggcatcctgttcaacaacgagtggaccaccagcgccctgcccgccttcaccaacgagttcggcgccccccccagccccgccaacttcatccagcccggcaagcagcccctgctgagcatgtgcctgaccatcatggtgggccaggacggccaggtgagaatggtggtgggcgccgccggcggcacccagatcaccaccgacaccgccctggccatcatctacaacctgtggttcggctacgacgtgaagagagccgtggaggagcccagactgcacaacaagctgctgcccaacgtgaccaccgtggagagaaacatcgaccaggccgtgaccgccgccctggagaccagacaccaccacacccagatcgccagcaccttcatcgccgtggtgcaggccatcgtgagaaccgccggcggctgggccgccgccagcgacagcagaaagggcggcgagcccgccggctactag

SEQ ID NO: 82717 - DNA, 1710 bp, Artificial Sequence; identical to SEQ ID NO: 82715
  Description of Artificial Sequence: Synthetic coding sequence

SEQ ID NO: 82718 - DNA, 1665 bp, Artificial Sequence
  Description of Artificial Sequence: Synthetic coding sequence
atggccagaggctacggcgccaccgtgagcctggtgctgctgggcctgggcctggccctggccgtgatcgtgctggccgtggtgctgagcagacaccaggccccctgcggcccccaggccttcgcccacgccgccgtggccgccgacagcaaggtgtgcagcgacatcggcagagccatcctgcagcagcagggcagccccgtggacgccaccatcgccgccctggtgtgcaccagcgtggtgaacccccagagcatgggcctgggcggcggcgtgatcttcaccatctacaacgtgaccaccggcgcccagtggatcggcgtgcccggcgagctgagaggctacgccgaggcccacagaagacacggcagactgccctgggcccagctgttccagcccaccatcgccctgctgagaggcggccacgtggtggcccccgtgctgagcagattcctgcacaacagcatcctgagacccagcctgcaggccagcaccctgagacagctgttcttcaacggcaccgagcccctgagaccccaggaccccctgccctggcccgccctggccaccaccctggagaccgtggccaccgagggcgtggaggtgttctacaccggcagactgggccagatgctggtggaggacatcgccaaggagggcagccagctgaccctgcaggacctggccaagttccagcccgaggtggtggacgccctggaggtgcccctgggcgactacaccctgtacagcccccccccccccgccggcggcgccatcctgagcttcatcctgaacgtgctgagaggcttcaacttcagcaccgagagcatggccagacccgagggcagagtgaacgtgtaccaccacctggtggagaccctgaagttcgccaagggccagagatggagactgggcgaccccagaagccaccccaagctgcagaacgccagcagagacctgctgggcgagaccctggcccagctgatcagacagcagatcgacggcagaggcgaccaccagctgagccactacagcctggccgaggcctggggccacggcaccggcaccagccacgtgagcgtgctgggcgaggacggcagcgccgtggccgccaccagcaccatcaacacccccttcggcgccatggtgtacagccccagaaccggcatcatcctgaacaacgagctgctggacctgtgcgagagatgccccagaggcagcggcaccacccccagccccgtgagcggcgacagagtgggcggcgcccccggcagatgctggccccccgtgcccggcgagagaagccccagcagcatggtgcccagcatcctgatcaacaaggcccagggcagcaagctggtgatcggcggcgccggcggcgagctgatcatcagcgccgtggcccaggccatcatgagcaagctgtggctgggcttcgacctgagagccgccatcgccgcccccatcctgcacgtgaacagcaagggctgcgtggagtacgagcccaacttcagccaggaggtgcagagaggcctgcaggacagaggccagaaccagacccagagacccttcttcctgaacgtggtgcaggccgtgagccaggagggcgcctgcgtgtacgccgtgagcgacctgagaaagagcggcgaggccgccggctactag

SEQ ID NO: 82719 - DNA, 1761 bp, Artificial Sequence
  Description of Artificial Sequence: Synthetic coding sequence
atggccagaggctacggcgccaccgtgagcctggtgctgctgggcctgggcctggccctggccgtgatcgtgctggccgtggtgctgagcagacaccaggccccctgcggcccccaggccttcgcccacgccgccgtggccgccgacagcaaggtgtgcagcgacatcggcagagccatcctgcagcagcagggcagccccgtggacgccaccatcgccgccctggtgtgcaccagcgtggtgaacccccagagcatgggcctgggcggcggcgtgatcttcaccatctacaacgtgaccaccggcaaggtggaggtgatcaacgccagagagaccgtgcccgccagccacgcccccagcctgctggaccagtgcgcccaggccctgcccctgggcaccggcgcccagtggatcggcgtgcccggcgagctgagaggctacgccgaggcccacagaagacacggcagactgccctgggcccagctgttccagcccaccatcgccctgctgagaggcggccacgtggtggcccccgtgctgagcagattcctgcacaacagcatcctgagacccagcctgcaggccagcaccctgagacagctgttcttcaacggcaccgagcccctgagaccccaggaccccctgccctggcccgccctggccaccaccctggagaccgtggccaccgagggcgtggaggtgttctacaccggcagactgggccagatgctggtggaggacatcgccaaggagggcagccagctgaccctgcaggacctggccaagttccagcccgaggtggtggacgccctggaggtgcccctgggcgactacaccctgtacagcccccccccccccgccggcggcgccatcctgagcttcatcctgaacgtgctgagaggcttcaacttcagcaccgagagcatggccagacccgagggcagagtgaacgtgtaccaccacctggtggagaccctgaagttcgccaagggccagagatggagactgggcgaccccagaagccaccccaagctgcagaacgccagcagagacctgctgggcgagaccctggcccagctgatcagacagcagatcgacggcagaggcgaccaccagctgagccactacagcctggccgaggcctggggccacggcaccggcaccagccacgtgagcgtgctgggcgaggacggcagcgccgtggccgccaccagcaccatcaacacccccttcggcgccatggtgtacagccccagaaccggcatcatcctgaacaacgagctgctggacctgtgcgagagatgccccagaggcagcggcaccacccccagccccgtgagcggcgacagagtgggcggcgcccccggcagatgctggccccccgtgcccggcgagagaagccccagcagcatggtgcccagcatcctgatcaacaaggcccagggcagcaagctggtgatcggcggcgccggcggcgagctgatcatcagcgccgtggcccaggccatcatgagcaagctgtggctgggcttcgacctgagagccgccatcgccgcccccatcctgcacgtgaacagcaagggctgcgtggagtacgagcccaacttcagccaggaggtgcagagaggcctgcaggacagaggccagaaccagacccagagacccttcttcctgaacgtggtgcaggccgtgagccaggagggcgcctgcgtgtacgccgtgagcgacctgagaaagagcggcgaggccgccggctactag

SEQ ID NO: 82720 - DNA, 1764 bp, Artificial Sequence
  Description of Artificial Sequence: Synthetic coding sequence
atggccagaggctacggcgccaccgtgagcctggtgctgctgggcctgggcctggccctggccgtgatcgtgctggccgtggtgctgagcagacaccaggccccctgcggcccccaggccttcgcccacgccgccgtggccgccgacagcaaggtgtgcagcgacatcggcagagccatcctgcagcagcagggcagccccgtggacgccaccatcgccgccctggtgtgcaccagcgtggtgaacccccagagcatgggcctgggcggcggcgtgatcttcaccatctacaacgtgaccaccggcaaggtggaggtgatcaacgccagagagaccgtgcccgccagccacgcccccagcctgctggaccagtgcgcccaggccctgcccctgggcaccggcgcccagtggatcggcgtgcccggcgagctgagaggctacgccgaggcccacagaagacacggcagactgccctgggcccagctgttccagcccaccatcgccctgctgagaggcggccacgtggtggcccccgtgctgagcagattcctgcacaacagcatcctgagacccagcctgcaggccagcaccctgagacagctgttcttcaacggcaccgagcccctgagaccccaggaccccctgccctggcccgccctggccaccaccctggagaccgtggccaccgagggcgtggaggtgttctacaccggcagactgggccagatgctggtggaggacatcgccaaggagggcagccagctgaccctgcaggacctggccaagttccagcccgaggtggtggacgccctggaggtgcccctgggcgactacaccctgtacagcccccccccccccgccggcggcgccatcctgagcttcatcctgaacgtgctgagaggcttcaacttcagcaccgagagcatggccagacccgagggcagagtgaacgtgtaccaccacctggtggagaccctgaagttcgccaagggccagagatggagactgggcgaccccagaagccaccccaagctgcagaacgccagcagagacctgctgggcgagaccctggcccagctgatcagacagcagatcgacggcagaggcgaccaccagctgagccactacagcctggccgaggcctggggccacggcaccggcaccagccacgtgagcgtgctgggcgaggacggcagcgccgtggccgccaccagcaccatcaacacccccttcggcgccatggtgtacagccccagaaccggcatcatcctgaacaacgagctgctggacctgtgcgagagatgccccagaggcagcggcaccacccccagccccgccgtgagcggcgacagagtgggcggcgcccccggcagatgctggccccccgtgcccggcgagagaagccccagcagcatggtgcccagcatcctgatcaacaaggcccagggcagcaagctggtgatcggcggcgccggcggcgagctgatcatcagcgccgtggcccaggccatcatgagcaagctgtggctgggcttcgacctgagagccgccatcgccgcccccatcctgcacgtgaacagcaagggctgcgtggagtacgagcccaacttcagccaggaggtgcagagaggcctgcaggacagaggccagaaccagacccagagacccttcttcctgaacgtggtgcaggccgtgagccaggagggcgcctgcgtgtacgccgtgagcgacctgagaaagagcggcgaggccgccggctactag

SEQ ID NO: 82721 - DNA, 1533 bp, Artificial Sequence
  Description of Artificial Sequence: Synthetic coding sequence
atggccagaggctacggcgccaccgtgagcctggtgctgctgggcctgggcctggccctggccgtgatcgtgctggccgtggtgctgagcagacaccaggccccctgcggcccccaggccttcgcccacgccgccgtggccgccgacagcaaggtgtgcagcgacatcggcagaggccccgtggacagaggcgccagaggcgccccctggctgtgcagaggccccccccccccctggccccccgccctgggcgccgccgtgcccgcccaccacagagccgcccccagaggcgcctgcggcggcccctgcccccagcccttccccgcccagcagcaccccgccgccttcctggccggcgtgaaccccgccctgttcttcaacggcaccgagcccctgagaccccaggaccccctgccctggcccgccctggccaccaccctggagaccgtggccaccgagggcgtggaggtgttctacaccggcagactgggccagatgctggtggaggacatcgccaaggagggcagccagctgaccctgcaggacctggccaagttccagcccgaggtggtggacgccctggaggtgcccctgggcgactacaccctgtacagcccccccccccccgccggcggcgccatcctgagcttcatcctgaacgtgctgagaggcttcaacttcagcaccgagagcatggccagacccgagggcagagtgaacgtgtaccaccacctggtggagaccctgaagttcgccaagggccagagatggagactgggcgaccccagaagccaccccaagctgcagaacgccagcagagacctgctgggcgagaccctggcccagctgatcagacagcagatcgacggcagaggcgaccaccagctgagccactacagcctggccgaggcctggggccacggcaccggcaccagccacgtgagcgtgctgggcgaggacggcagcgccgtggccgccaccagcaccatcaacacccccttcggcgccatggtgtacagccccagaaccggcatcatcctgaacaacgagctgctggacctgtgcgagagatgccccagaggcagcggcaccacccccagccccgccgtgagcggcgacagagtgggcggcgcccccggcagatgctggccccccgtgcccggcgagagaagccccagcagcatggtgcccagcatcctgatcaacaaggcccagggcagcaagctggtgatcggcggcgccggcggcgagctgatcatcagcgccgtggcccaggccatcatgagcaagctgtggctgggcttcgacctgagagccgccatcgccgcccccatcctgcacgtgaacagcaagggctgcgtggagtacgagcccaacttcagccaggaggtgcagagaggcctgcaggacagaggccagaaccagacccagagacccttcttcctgaacgtggtgcaggccgtgagccaggagggcgcctgcgtgtacgccgtgagcgacctgagaaagagcggcgaggccgccggctactag

SEQ ID NO: 82722 - DNA, 1506 bp, Artificial Sequence
  Description of Artificial Sequence: Synthetic coding sequence
atgggcctgggcggcggcgtgatcttcaccatctacaacgtgaccaccggcaaggtggaggtgatcaacgccagagagaccgtgcccgccagccacgcccccagcctgctggaccagtgcgcccaggccctgcccctgggcaccggcgcccagtggatcggcgtgcccggcgagctgagaggctacgccgaggcccacagaagacacggcagactgccctgggcccagctgttccagcccaccatcgccctgctgagaggcggccacgtggtggcccccgtgctgagcagattcctgcacaacagcatcctgagacccagcctgcaggccagcaccctgagacagctgttcttcaacggcaccgagcccctgagaccccaggaccccctgccctggcccgccctggccaccaccctggagaccgtggccaccgagggcgtggaggtgttctacaccggcagactgggccagatgctggtggaggacatcgccaaggagggcagccagctgaccctgcaggacctggccaagttccagcccgaggtggtggacgccctggaggtgcccctgggcgactacaccctgtacagcccccccccccccgccggcggcgccatcctgagcttcatcctgaacgtgctgagaggcttcaacttcagcaccgagagcatggccagacccgagggcagagtgaacgtgtaccaccacctggtggagaccctgaagttcgccaagggccagagatggagactgggcgaccccagaagccaccccaagctgcagaacgccagcagagacctgctgggcgagaccctggcccagctgatcagacagcagatcgacggcagaggcgaccaccagctgagccactacagcctggccgaggcctggggccacggcaccggcaccagccacgtgagcgtgctgggcgaggacggcagcgccgtggccgccaccagcaccatcaacacccccttcggcgccatggtgtacagccccagaaccggcatcatcctgaacaacgagctgctggacctgtgcgagagatgccccagaggcagcggcaccacccccagccccgtgagcggcgacagagtgggcggcgcccccggcagatgctggccccccgtgcccggcgagagaagccccagcagcatggtgcccagcatcctgatcaacaaggcccagggcagcaagctggtgatcggcggcgccggcggcgagctgatcatcagcgccgtggcccaggccatcatgagcaagctgtggctgggcttcgacctgagagccgccatcgccgcccccatcctgcacgtgaacagcaagggctgcgtggagtacgagcccaacttcagccaggaggtgcagagaggcctgcaggacagaggccagaaccagacccagagacccttcttcctgaacgtggtgcaggccgtgagccaggagggcgcctgcgtgtacgccgtgagcgacctgagaaagagcggcgaggccgccggctactag

SEQ ID NO: 82723 - DNA, 1386 bp, Artificial Sequence
  Description of Artificial Sequence: Synthetic coding sequence
atggagagagccgaggagcccgtggtgtaccagaagctgctgccctgggagcccagcctggagagcgaggaggaggtggaggaggaggagaccagcgaggccctggtgctgaaccccagaagacaccaggacagcagcagaaacaaggccggcggcctgcccggcacctgggccagagtggtggccgccctgctgctgctggccgtgggctgcagcctggccgtgagacagctgcagaaccagggcagaagcaccggcagcctgggcagcgtggcccccccccccggcggccacagccacggccccggcgtgtaccaccacggcgccatcatcagccccgccggcgccatgttctggggcctgttccacgacagcagcagcggcaacagcaccgccctgaccagcggccccgcccagaccctggcccccggcctgggcctgcccgccgccctgcccaccctgcacctgctgcacgccagattcggcagactgccctggcccagactgctggtgggccccaccaccctggcccaggagggcttcctggtggacacccccctggccagagccctggtggccagaggcaccgagggcctgtgccccctgctgtgccacgccgacggcacccccctgggcgccggcgccagagccaccaacccccagctggccgccgtgctgagaagcgccgccctggcccccaccagcgacctggccggcgacgccctgctgagcctgctggccggcgacctgggcgtggaggtgcccagcgccgtgcccagacccaccctggagcccgccgagcagctgcccgtgccccagggcatcctgttcaccacccccagccccagcgccggccccgagctgctggccctgctggaggccgccctgagaagcggcgcccccatccccgacccctgcccccccttcctgcagaccgccgtgagccccgagagcagcgccctggccgccgtggacagcagcggcagcgtgctgctgctgaccagcagcctgaactgcagcttcggcagcgcccacctgagccccagcaccggcgtgctgctgagcaacctggtggccaagagcaccaccagcgcctgggcctgccccctgatcctgagaggcagcctggacgacaccgaggccgacgtgctgggcctggtggccagcggcacccccgacgtggccagagccatgacccacaccctgctgagacacctggccgccagaccccccacccaggcccagcaccagcaccagggccagcaggagcccaccgagcaccccagcacctgcggccagggcaccctgctgcaggtggccgcccacaccgagcacgcccacgtgagcagcgtgccccacgcctgctgccccttccagggcttctag

SEQ ID NO: 82724 - DNA, 1482 bp, Artificial Sequence
  Description of Artificial Sequence: Synthetic coding sequence
atggagagagccgaggagcccgtggtgtaccagaagctgctgccctgggagcccagcctggagagcgaggaggaggtggaggaggaggagaccagcgaggccctggtgctgaaccccagaagacaccaggacagcagcagaaacaaggccggcggcctgcccggcacctgggccagagtggtggccgccctgctgctgctggccgtgggctgcagcctggccgtgagacagctgcagaaccagggcagaagcaccggcagcctgggcagcgtggcccccccccccggcggccacagccacggccccggcgtgtaccaccacggcgccatcatcagccccgccggcagagagctgctggtggccggcggcaacgtggtggacgccggcgtgggcgccgccctgtgcctggccgtggtgcacccccacgccaccggcctgggcgccatgttctggggcctgttccacgacagcagcagcggcaacagcaccgccctgaccagcggccccgcccagaccctggcccccggcctgggcctgcccgccgccctgcccaccctgcacctgctgcacgccagattcggcagactgccctggcccagactgctggtgggccccaccaccctggcccaggagggcttcctggtggacacccccctggccagagccctggtggccagaggcaccgagggcctgtgccccctgctgtgccacgccgacggcacccccctgggcgccggcgccagagccaccaacccccagctggccgccgtgctgagaagcgccgccctggcccccaccagcgacctggccggcgacgccctgctgagcctgctggccggcgacctgggcgtggaggtgcccagcgccgtgcccagacccaccctggagcccgccgagcagctgcccgtgccccagggcatcctgttcaccacccccagccccagcgccggccccgagctgctggccctgctggaggccgccctgagaagcggcgcccccatccccgacccctgcccccccttcctgcagaccgccgtgagccccgagagcagcgccctggccgccgtggacagcagcggcagcgtgctgctgctgaccagcagcctgaactgcagcttcggcagcgcccacctgagccccagcaccggcgtgctgctgagcaacctggtggccaagagcaccaccagcgcctgggcctgccccctgatcctgagaggcagcctggacgacaccgaggccgacgtgctgggcctggtggccagcggcacccccgacgtggccagagccatgacccacaccctgctgagacacctggccgccagaccccccacccaggcccagcaccagcaccagggccagcaggagcccaccgagcaccccagcacctgcggccagggcaccctgctgcaggtggccgcccacaccgagcacgcccacgtgagcagcgtgccccacgcctgctgccccttccagggcttctag

SEQ ID NO: 82725 - DNA, 1038 bp, Artificial Sequence
  Description of Artificial Sequence: Synthetic coding sequence
atgttctggggcctgttccacgacagcagcagcggcaacagcaccgccctgaccagcggccccgcccagaccctggcccccggcctgggcctgcccgccgccctgcccaccctgcacctgctgcacgccagattcggcagactgccctggcccagactgctggtgggccccaccaccctggcccaggagggcttcctggtggacacccccctggccagagccctggtggccagaggcaccgagggcctgtgccccctgctgtgccacgccgacggcacccccctgggcgccggcgccagagccaccaacccccagctggccgccgtgctgagaagcgccgccctggcccccaccagcgacctggccggcgacgccctgctgagcctgctggccggcgacctgggcgtggaggtgcccagcgccgtgcccagacccaccctggagcccgccgagcagctgcccgtgccccagggcatcctgttcaccacccccagccccagcgccggccccgagctgctggccctgctggaggccgccctgagaagcggcgcccccatccccgacccctgcccccccttcctgcagaccgccgtgagccccgagagcagcgccctggccgccgtggacagcagcggcagcgtgctgctgctgaccagcagcctgaactgcagcttcggcagcgcccacctgagccccagcaccggcgtgctgctgagcaacctggtggccaagagcaccaccagcgcctgggcctgccccctgatcctgagaggcagcctggacgacaccgaggccgacgtgctgggcctggtggccagcggcacccccgacgtggccagagccatgacccacaccctgctgagacacctggccgccagaccccccacccaggcccagcaccagcaccagggccagcaggagcccaccgagcaccccagcacctgcggccagggcaccctgctgcaggtggccgcccacaccgagcacgcccacgtgagcagcgtgccccacgcctgctgccccttccagggcttctag

SEQ ID NO: 82726 - DNA, 1482 bp, Artificial Sequence; identical to SEQ ID NO: 82724
  Description of Artificial Sequence: Synthetic coding sequence

SEQ ID NO: 82727 - DNA, 678 bp, Artificial Sequence
  Description of Artificial Sequence: Synthetic coding sequence
atgaccagcgagttcttcagcgcccagctgagagcccagatcagcgacgacaccacccaccccatcagctactacaagcccgagttctacatgcccgacgacggcggcaccgcccacctgagcgtggtggccgaggacggcagcgccgtgagcgccaccagcaccatcaacctgtacttcggcagcaaggtgagaagccccgtgagcggcatcctgctgaacaacgagatggacgacttcagcagcaccagcatcaccaacgagttcggcgtgccccccagccccgccaacttcatccagcccggcaagcagcccctgagcagcatgtgccccaccatcatggtgggccaggacggccaggtgagaatggtggtgggcgccgccggcggcacccagatcaccatggccaccgccctggccatcatctacaacctgtggttcggctacgacgtgaagtgggccgtggaggagcccagactgcacaaccagctgctgcccaacgtgaccaccgtggagagaaacatcgaccaggaggtgaccgccgccctggagaccagacaccaccacacccagatcaccagcaccttcatcgccgtggtgcaggccatcgtgagaatggccggcggctgggccgccgccagcgacagcagaaagggcggcgagcccgccggctactag

SEQ ID NO: 82728 - DNA, 678 bp, Artificial Sequence; identical to SEQ ID NO: 82727
  Description of Artificial Sequence: Synthetic coding sequence

SEQ ID NO: 82729 - DNA, 678 bp, Artificial Sequence; identical to SEQ ID NO: 82727
  Description of Artificial Sequence: Synthetic coding sequence

SEQ ID NO: 82730 - DNA, 678 bp, Artificial Sequence
  Description of Artificial Sequence: Synthetic coding sequence
atgaccagcgagttcttcgccgcccagctgagagcccagatcagcgacgacaccacccaccccatcagctactacaagcccgagttctacacccccgtggacggcggcaccgcccacctgagcgtggtggccgaggacggcagcgccgtgagcgccaccagcaccatcaacctgtacttcggcagcaaggtgagaagccccgtgagcgagatcctgttcaacgacgagatggacgacttcagcagccccaacatcaccaacgagttcggcgtgccccccagccccgccaacttcatccagcccggcaagcagcccctgagcagcatgtgccccaccatcatggtgggccaggacggccaggtgagaatggtggtgggcgccgccggcggcacccagatcaccaccgccaccgccctggccatcatctacaacctgtggttcggctacgacgtgaagagagccgtggaggagcccagactgcacaaccagctgctgcccaacgtgaccaccgtggagagaaacatcgaccaggccgtgaccgccgccctggagaccagacaccaccacacccagatcgccagcaccttcatcgccgtggtgcaggccatcgtgagaaccgccggcggctgggccgccgccagcgacagcagaaagggcggcgagcccgccggctactag

SEQ ID NO: 82731 - DNA, 657 bp, Artificial Sequence
  Description of Artificial Sequence: Synthetic coding sequence
atgaccagcgagttcttcgccgcccagctgagagcccagatcagcgacgacaccacccaccccatcagctactacaagcccgagttctacacccccgtggacggcggcaccgcccacctgagcgtggtggccgaggacggcagcgccgtgagcgccaccagcaccatcaacctgtacttcggcagcaaggtgagaagccccgtgagcgagatcctgttcaacgacgagatggacgacttcagcagccccaacatcaccaacgagttcggcgtgccccccagccccgccaacttcatccagcccggcaagcagcccctgagcagcatgtgccccaccatcatggtgggccaggacggccagccccccagccacgccgaccacacccccatgccccaggccatcatctacaacctgtggttcggctacgacgtgaagagagccgtggaggagcccagactgcacaaccagctgctgcccaacgtgaccaccgtggagagaaacatcgaccaggccgtgaccgccgccctggagaccagacaccaccacacccagatcgccagcaccttcatcgccgtggtgcaggccatcgtgagaaccgccggcggctgggccgccgccagcgacagcagaaagggcggcgagcccgccggctactag

SEQ ID NO: 82732 - DNA, 678 bp, Artificial Sequence
  Description of Artificial Sequence: Synthetic coding sequence
atgaccagcgagttcttcgccgcccagctgagaagccagatcagcgaccacaccacccaccccatcagctactacaagcccgagttctacacccccgacgacggcggcaccgcccacctgagcgtggtggccgaggacggcagcgccgtgagcgccaccagcaccatcaacctgtacttcggcagcaaggtgtgcagccccgtgagcggcatcctgttcaacaacgagtggaccaccagcgccctgcccgccttcaccaacgagttcggcgccccccccagccccgccaacttcatccagcccggcaagcagcccctgctgagcatgtgccccaccatcatggtgggccaggacggccaggtgagaatggtggtgggcgccgccggcggcacccagatcaccaccgacaccgccctggccatcatctacaacctgtggttcggctacgacgtgaagagagccgtggaggagcccagactgcacaacaagctgctgcccaacgtgaccaccgtggagagaaacatcgaccaggccgtgaccgccgccctggagaccagacaccaccacacccagatcgccagcaccttcatcgccgtggtgcaggccatcgtgagaaccgccggcggctgggccgccgccagcgacagcagaaagggcggcgagcccgccggctactag

SEQ ID NO: 82733 - DNA, 711 bp, Artificial Sequence
  Description of Artificial Sequence: Synthetic coding sequence
cccgccctgggcagccagcaggtggtgagaaacatgaccagcgagttcttcgccgcccagctgagaagccagatcagcgaccacaccacccaccccatcagctactacaagcccgagttctacacccccgacgacggcggcaccgcccacctgagcgtggtggccgaggacggcagcgccgtgagcgccaccagcaccatcaacctgtacttcggcagcaaggtgtgcagccccgtgagcggcatcctgttcaacaacgagtggaccaccagcgccctgcccgccttcaccaacgagttcggcgccccccccagccccgccaacttcatccagcccggcaagcagcccctgctgagcatgtgccccaccatcatggtgggccaggacggccaggtgagaatggtggtgggcgccgccggcggcacccagatcaccaccgacaccgccctggccatcatctacaacctgtggttcggctacgacgtgaagagagccgtggaggagcccagactgcacaacaagctgctgcccaacgtgaccaccgtggagagaaacatcgaccaggccgtgaccgccgccctggagaccagacaccaccacacccagatcgccagcaccttcatcgccgtggtgcaggccatcgtgagaaccgccggcggctgggccgccgccagcgacagcagaaagggcggcgagcccgccggctactag

SEQ ID NO: 82734 - DNA, 675 bp, Artificial Sequence
  Description of Artificial Sequence: Synthetic coding sequence
atggtggccgccgtgctgctgggcctgagctggctgtgcagccccctgggcgccctggtgctggacttcaacaacatcagaagcagcgccgacctgcacggcgccagaaagggcagccagtgcctgagcgacaccgactgcaacaccagaaagttctgcctgcagcccagagacgagaagcccttctgcgccacctgcagaggcctgagaagaagatgccagagagacgccatgtgctgccccggcaccctgtgcgtgaacgacgtgtgcaccaccatggaggacgccacccccatcctggagagacagctggacgagcaggacggcacccacgccgagggcaccaccggccaccccgtgcaggagaaccagcccaagagaaagcccagcatcaagaagagccagggcagaaagggccaggagggcgagagctgcctgagaaccttcgactgcggccccggcctgtgctgcgccagacacttctggaccaagatctgcaagcccgtgctgctggagggccaggtgtgcagcagaagaggccacaaggacaccgcccaggcccccgagatcttccagagatgcgactgcggccccggcctgctgtgcagaagccagctgaccagcaacagacagcacgccagactgagagtgtgccagaagatcgagaagctgtag

SEQ ID NO: 82735 - DNA, 873 bp, Artificial Sequence
  Description of Artificial Sequence: Synthetic coding sequence
atgagactgaacagcaccggcgaggtgcccgtgctgatccacggcgagaacatcatctgcgaggccacccagatcatcgactacctggagcagaccttcctggacgagagaacccccagactgatgcccgacaaggagagcatgtactaccccagagtgcagcactacagagagctgctggacagcctgcccatggacgcctacacccacggctgcatcctgcaccccgagctgaccgtggacagcatgatccccgcctacgccaccaccagaatcagaagccagatcggcaacaccgagagcgagctgaagaagctggccgaggagaaccccgacctgcaggaggcctacatcgccaagcagaagagactgaagagcaagctgctggaccacgacaacgtgaagtacctgaagaagatcctggacgagctggagaaggtgctggaccaggtggagaccgagctgcagagaagaaacgaggagacccccgaggagggccagcagccctggctgtgcggcgagagcttcaccctggccgacgtgagcctggccgtgaccctgcacagactgaagttcctgggcttcgccagaagaaactggggcaacggcaagagacccaacctggagacctactacgagagagtgctgaagagaaagaccttcaacaaggtgctgggccacgtgaacaacatcctgatcagcgccgtgctgcccaccgccttcagagtggccaagaagagagcccccaaggtgctgggcaccaccctggtggtgggcctgctggccggcgtgggctacttcgccttcatgctgttcagaaagagactgggcagcatgatcctggccttcagacccagacccaactacttctag

SEQ ID NO: 82736 - DNA, 1632 bp, Artificial Sequence
  Description of Artificial Sequence: Synthetic coding sequence
atgggcgactggaacctgctgggcggcatcctggaggaggtgcacagccacagcaccatcgtgggcaagatctggctgaccatcctgttcatcttcagaatgctggtgctgagagtggccgccgaggacgtgtgggacgacgagcagagcgccttcgcctgcaacaccagacagcccggctgcaacaacatctgctacgacgacgccttccccatcagcctgatcagattctgggtgctgcagatcatcttcgtgagcagccccagcctggtgtacatgggccacgccctgtacagactgagagccttcgagaaggacagacagagaaagaagagccacctgagagcccagatggagaaccccgacctggacctggaggagcagcagagaatcgacagagagctgagaagactggaggagcagaagagaatccacaaggtgcccctgaagggctgcctgctgagaacctacgtgctgcacatcctgaccagaagcgtgctggaggtgggcttcatgatcggccagtacatcctgtacggcttccagatgcaccccctgtacaagtgcacccagcccccctgccccaacgccgtggactgcttcgtgagcagacccaccgagaagaccatcttcatgctgttcatgcacagcatcgccgccatcagcctgctgctgaacatcctggagatcttccacctgggcatcagaaagatcatgagaaccctgtacaagaagagcagcagcgagggcatcgaggacgagaccggcccccccttccacctgaagaagtacagcgtggcccagcagtgcatgatctgcagcagcctgcccgagagaatcagccccctgcaggccaacaaccagcagcaggtgatcagagtgaacgtgcccaagagcaagaccatgtggcagatcccccagcccagacagctggaggtggaccccagcaacggcaagaaggactggagcgagaaggaccagcacagcggccagctgcacgtgcacagcccctgcccctgggccggcagcgccggcaaccagcacctgggccagcagagcgaccacagcagcttcggcctgcagaacaccatgagccagagctggctgggcaccaccaccgcccccagaaactgccccagcttcgccgtgggcacctgggagcagagccaggaccccgagcccagcggcgagcccctgaccgacctgcacagccactgcagagacagcgagggcagcatgagagagagcggcgtgtggatcgacagaagcagacccggcagcagaaaggccagcttcctgagcagactgctgagcgagaagagacacctgcacagcgacagcggcagcagcggcagcagaaacagcagctgcctggacttcccccactgggagaacagccccagccccctgcccagcgtgaccggccacagaaccagcatggtgagacaggccgccctgcccatcatggagctgagccaggagctgttccacagcggctgcttcctgttccccttcttcctgcccggcgtgtgcatgtacgtgtgcgtggacagagaggccgacggcggcggcgactacctgtggagagacaagatcatccacagcatccacagcgtgaagttcaacagctag

SEQ ID NO: 82737 - DNA, 1308 bp, Artificial Sequence
  Description of Artificial Sequence: Synthetic coding sequence
atgggcgactggagcttcctgggcagactgctggagaacgcccaggagcacagcaccgtgatcggcaaggtgtggctgaccgtgctgttcatcttcagaatcctggtgctgggcgccgccgccgaggacgtgtggggcgacgagcagagcgacttcacctgcaacacccagcagcccggctgcgagaacgtgtgctacgacagagccttccccatcagccacatcagattctgggccctgcagatcatcttcgtgagcacccccaccctgatctacctgggccacgtgctgcacatcgtgagaatggaggagaagaagaaggagagagaggaggaggagcagctgaagagagagagccccagccccaaggagcccccccaggacaaccccagcagcagagacgacagaggcagagtgagaatggccggcgccctgctgagaacctacgtgttcaacatcatcttcaagaccctgttcgaggtgggcttcatcgccggccagtacttcctgtacggcttcgagctgaagcccctgtacagatgcgacagatggccctgccccaacaccgtggactgcttcatcagcagacccaccgagaagaccatcttcatcatcttcatgctggccgtggcctgcgccagcctgctgctgaacatgctggagatctaccacctgggctggaagaagctgaagcagggcgtgaccagcagactgggccccgacgccagcgaggcccccctgggcaccgccgaccccccccccctgccccccagcagcagaccccccgccgtggccatcggcttccccccctactacgcccacaccgccgcccccctgggccaggccagagccgtgggctaccccggcgcccccccccccgccgccgacttcaagctgctggccctgaccgaggccagaggcaagggccagagcgccaagctgtacaacggccaccaccacctgctgatgaccgagcagaactgggccaaccaggccgccgagagacagccccccgccctgaaggcctaccccgccgccagcacccccgccgcccccagccccgtgggcagcagcagcccccccctggcccacgaggccgaggccggcgccgcccccctgctgctggacggcagcggcagcagcctggagggcagcgccctggccggcacccccgaggaggaggagcaggccgtgaccaccgccgcccagatgcaccagccccccctgcccctgggcgaccccggcagagccagcaaggccagcagagccagcagcggcagagccagacccgaggacctggccatctag

SEQ ID NO: 82738 - DNA, 1002 bp, Artificial Sequence
  Description of Artificial Sequence: Synthetic coding sequence
atgggcgactggggcttcctggagaagctgctggaccaggtgcaggagcacagcaccgtggtgggcaagatctggctgaccgtgctgttcatcttcagaatcctgatcctgggcctggccggcgagagcgtgtggggcgacgagcagagcgacttcgagtgcaacaccgcccagcccggctgcaccaacgtgtgctacgaccaggccttccccatcagccacatcagatactgggtgctgcagttcctgttcgtgagcacccccaccctggtgtacctgggccacgtgatctacctgagcagaagagaggagagactgagacagaaggagggcgagctgagagccctgcccgccaaggacccccaggtggagagagccctggccgccgtggagagacagatggccaagatcagcgtggccgaggacggcagactgagaatcagaggcgccctgatgggcacctacgtggccagcgtgctgtgcaagagcgtgctggaggccggcttcctgtacggccagtggagactgtacggctggaccatggagcccgtgttcgtgtgccagagagccccctgcccctacctggtggactgcttcgtgagcagacccaccgagaagaccatcttcatcatcttcatgctggtggtgggcctgatcagcctggtgctgaacctgctggagctggtgcacctgctgtgcagatgcctgagcagaggcatgagagccagacagggccaggacgccccccccacccagggcaccagcagcgacccctacaccgaccaggtgttcttctacctgcccgtgggccagggccccagcagccccccctgccccacctacaacggcctgagcagcagcgagcagaactgggccaacctgaccaccgaggagagactggccagcagcagaccccccctgttcctggacccccccccccagaacggccagaagccccccagcagacccagcagcagcgccagcaagaagcagtacgtgtag

SEQ ID NO: 82739 - DNA, 879 bp, Artificial Sequence
  Description of Artificial Sequence: Synthetic coding sequence
atgggcgactggggcttcctggagaagctgctggaccaggtgcaggagcacagcaccgtggtgggcaagatctggctgaccgtgctgttcatcttcagaatcctgatcctgggcctggccggcgagagcgtgtggggcgacgagcagagcgacttcgagtgcaacaccgcccagcccggctgcaccaacgtgtgctacgaccaggccttccccatcagccacatcagatactgggtgctgcagttcctgttcgtgagcacccccaccctggtgtacctgggccacgtgatctacctgagcagaagagaggagagactgagacagaaggagggcgagctgagagccctgcccgccaaggacccccaggtggagagagccctggccgccgtggagagacagatggccaagatcagcgtggccgaggacggcagactgagaatcagaggcgccctgatgggcacctacgtggccagcgtgctgtgcaagagcgtgctggaggccggcttcctgtacggccagtggagactgtacggctggaccatggagcccgtgttcgtgtgccagagagccccctgcccctacctggtggactgcttcgtgagcagacccaccgagaagaccatcttcatcatcttcatgctggtggtgggcctgatcagcctggtgctgaacctgctggagctggtgcacctgctgtgcagatgcctgagcagaggcatgagagccagacagggccaggacgccccccccacccagggcaccagcagcgacccctacaccgaccaggtgttcttctacctgcccgtgggccagggccccagcagccccccctgccccacctacaacggcctgagcagcagcgagcagaactgggcctag

SEQ ID NO: 82740 - DNA, 882 bp, Artificial Sequence
  Description of Artificial Sequence: Synthetic coding sequence
atgggcgactggggcttcctggagaagctgctggaccaggtgcaggagcacagcaccgtggtgggcaagatctggctgaccgtgctgttcatcttcagaatcctgatcctgggcctggccggcgagagcgtgtggggcgacgagcagagcgacttcgagtgcaacaccgcccagcccggctgcaccaacgtgtgctacgaccaggccttccccatcagccacatcagatactgggtgctgcagttcctgttcgtgagcacccccaccctggtgtacctgggccacgtgatctacctgagcagaagagaggagagactgagacagaaggagggcgagctgagagccctgcccgccaaggacccccaggtggagagagccctggccgccgtggagagacagatggccaagatcagcgtggccgaggacggcagactgagaatcagaggcgccctgatgggcacctacgtggccagcgtgctgtgcaagagcgtgctggaggccggcttcctgtacggccagtggagactgtacggctggaccatggagcccgtgttcgtgtgccagagagccccctgcccctacctggtggactgcttcgtgagcagacccaccgagaagaccatcttcatcatcttcatgctggtggtgggcctgatcagcctggtgctgaacctgctggagctggtgcacctgctgtgcagatgcctgagcagaggcatgagagccagacagggccaggacgccccccccacccagggcaccccccagaccctgaccagaaccagaagcagcagcaccagcccctgggccagaggcccccacccccaccacgccccccccaccatgggcagccaccccgtgagcagaaccggccccacctag

SEQ ID NO: 82741 - DNA, 1077 bp, Artificial Sequence
  Description of Artificial Sequence: Synthetic coding sequence
atgggcgactggagcttcctgggcaacttcctggaggaggtgcacaagcacagcaccgtggtgggcaaggtgtggctgaccgtgctgttcatcttcagaatgctggtgctgggcaccgccgccgagagcagctggggcgacgagcaggccgacttcagatgcgacaccatccagcccggctgccagaacgtgtgctacgaccaggccttccccatcagccacatcagatactgggtgctgcagatcatcttcgtgagcacccccagcctggtgtacatgggccacgccatgcacaccgtgagaatgcaggagaagagaaagctgagagaggccgagagagccaaggaggtgagaggcagcggcagctacgagtaccccgtggccgagaaggccgagctgagctgctgggaggagggcaacggcagaatcgccctgcagggcaccctgctgaacacctacgtgtgcagcatcctgatcagaaccaccatggaggtgggcttcatcgtgggccagtacttcatctacggcatcttcctgaccaccctgcacgtgtgcagaagaagcccctgcccccaccccgtgaactgctacgtgagcagacccaccgagaagaacgtgttcatcgtgttcatgctggccgtggccgccctgagcctgctgctgagcctggccgagctgtaccacctgggctggaagaagatcagacagagattcgtgaagcccagacagcacatggccaagtgccagctgagcggccccagcgtgggcatcgtgcagagctgcacccccccccccgacttcaaccagtgcctggagaacggccccggcggcaagttcttcaaccccttcagcaacaacatggccagccagcagaacaccgacaacctggtgaccgagcaggtgagaggccaggagcagacccccggcgagggcttcatccaggtgagatacggccagaagcccgaggtgcccaacggcgtgagccccggccacagactgccccacggctaccacagcgacaagagaagactgagcaaggccagcagcaaggccagaagcgacgacctgagcgtgtag

SEQ ID NO: 82742 - DNA, 1077 bp, Artificial Sequence; identical to SEQ ID NO: 82741
  Description of Artificial Sequence: Synthetic coding sequence

SEQ ID NO: 82743 - DNA, 759 bp, Artificial Sequence
  Description of Artificial Sequence: Synthetic coding sequence
atgggcgactggagcttcctgggcaacttcctggaggaggtgcacaagcacagcaccgtggtgggcaaggtgtggctgaccgtgctgttcatcttcagaatgctggtgctgggcaccgccgccgagagcagctggggcgacgagcaggccgacttcagatgcgacaccatccagcccggctgccagaacgtgtgctacgaccaggccttccccatcagccacatcagatactgggtgctgcagatcatcttcgtgagcacccccagcctggtgtacatgggccacgccatgcacaccgtgagaatgcaggagaagagaaagctgagagaggccgagagagccaaggaggtgagaggcagcggcagctacgagtaccccgtggccgagaaggccgagctgagctgctgggaggagggcaacggcagaatcgccctgcagggcaccctgctgaacacctacgtgtgcagcatcctgatcagaaccaccatggaggtgggcttcatcgtgggccagtacttcatctacggcatcttcctgaccaccctgcacgtgtgcagaagaagcccctgcccccaccccgtgaactgctacgtgagcagacccaccgagaagaacgtgttcatcgtgttcatgctggccgtggccgccctgagcctgctgctgagcctggccgagctgtaccacctgggctggaagaagatcagacagagattcgtgaagcccagacagcacatggccaagtgccagctgagcggctag

SEQ ID NO: 82744 - DNA, 1302 bp, Artificial Sequence
  Description of Artificial Sequence: Synthetic coding sequence
atgggcgactggagcttcctgggcaacatcctggaggaggtgaacgagcacagcaccgtgatcggcagagtgtggctgaccgtgctgttcatcttcagaatcctgatcctgggcaccgccgccgagttcgtgtggggcgacgagcagagcgacttcgtgtgcaacacccagcagcccggctgcgagaacgtgtgctacgacgaggccttccccatcagccacatcagactgtgggtgctgcagatcatcttcgtgagcacccccagcctgatgtacgtgggccacgccgtgcactacgtgagaatggaggagaagagaaagagcagagaggccgaggagctgggccagcaggccggcaccaacggcggccccgaccagggcagcgtgaagaagagcagcggcagcaagggcaccaagaagttcagactggagggcaccctgctgagaacctacatctgccacatcatcttcaagaccctgttcgaggtgggcttcatcgtgggccactacttcctgtacggcttcagaatcctgcccctgtacagatgcagcagatggccctgccccaacgtggtggactgcttcgtgagcagacccaccgagaagaccatcttcatcctgttcatgctgagcgtggccagcgtgagcctgttcctgaacgtgatggagctgggccacctgggcctgaagggcatcagaagcgccctgaagagacccgtggagcagcccctgggcgagatccccgagaagagcctgcacagcatcgccgtgagcagcatccagaaggccaagggctaccagctgctggaggaggagaagatcgtgagccactacttccccctgaccgaggtgggcatggtggagaccagccccctgcccgccaagcccttcaaccagttcgaggagaagatcagcaccggccccctgggcgacctgagcagaggctaccaggagaccctgcccagctacgcccaggtgggcgcccaggaggtggagggcgagggcccccccgccgaggagggcgccgagcccgaggtgggcgagaagaaggaggaggccgagagactgaccaccgaggagcaggagaaggtggccgtgcccgagggcgagaaggtggagacccccggcgtggacaaggagggcgagaaggaggagccccagagcgagaaggtgagcaagcagggcctgcccgccgagaagacccccagcctgtgccccgagctgaccaccgacgacgccagacccctgagcagactgagcaaggccagcagcagagccagaagcgacgacctgaccgtgtag

SEQ ID NO: 82745 - DNA, 1302 bp, Artificial Sequence; identical to SEQ ID NO: 82744
  Description of Artificial Sequence: Synthetic coding sequence

SEQ ID NO: 82746 - DNA, 1548 bp, Artificial Sequence
  Description of Artificial Sequence: Synthetic coding sequence
atgggcgactggaacctgctgggcgacaccctggaggaggtgcacatccacagcaccatgatcggcaagatctggctgaccatcctgttcatcttcagaatgctggtgctgggcgtggccgccgaggacgtgtggaacgacgagcagagcggcttcatctgcaacaccgagcagcccggctgcagaaacgtgtgctacgaccaggccttccccatcagcctgatcagatactgggtgctgcaggtgatcttcgtgagcagccccagcctggtgtacatgggccacgccctgtacagactgagagtgctggaggaggagagacagagaatgaaggcccagctgagagtggagctggaggaggtggagttcgagatgcccagagacagaagaagactggagcaggagctgtgccagctggagaagagaaagctgaacaaggcccccctgagaggcaccctgctgtgcacctacgtgatccacatcttcaccagaagcgtggtggaggtgggcttcatgatcggccagtacctgctgtacggcttccacctggagcccctgttcaagtgccacggccacccctgccccaacatcatcgactgcttcgtgagcagacccaccgagaagaccatcttcctgctgttcatgcagagcatcgccaccatcagcctgttcctgaacatcctggagatcttccacctgggcttcaagaagatcaagagaggcctgtggggcaagtacaagctgaagaaggagcacaacgagttccacgccaacaaggccaagcagaacgtggccaagtaccagagcaccagcgccaacagcctgaagagactgcccagcgcccccgactacaacctgctggtggagaagcagacccacaccgccgtgtaccccagcctgaacagcagcagcgtgttccagcccaaccccgacaaccacagcgtgaacgacgagaagtgcatcctggacgagcaggagaccgtgctgagcaacgagatcagcaccctgagcaccagctgcagccacttccagcacatcagcagcaacaacaacaaggacacccacaagatcttcggcaaggagctgaacggcaaccagctgatggagaagagagagaccgagggcaaggacagcaagagaaactactacagcagaggccacagaagcatccccggcgtggccatcgacggcgagaacaacatgagacagagcccccagaccgtgttcagcctgcccgccaactgcgactggaagcccagatggctgagagccacctggggcagcagcaccgagcacgagaacagaggcagcccccccaagggcaacctgaagggccagttcagaaagggcaccgtgagaaccctgccccccagccagggcgacagccagagcctggacatccccaacaccgccgacagcctgggcggcctgagcttcgagcccggcctggtgagaacctgcaacaaccccgtgtgcccccccaaccacgtggtgagcctgaccaacaacctgatcggcagaagagtgcccaccgacctgcagatctag

SEQ ID NO: 82747 - DNA, 1548 bp, Artificial Sequence; identical to SEQ ID NO: 82746
  Description of Artificial Sequence: Synthetic coding sequence

SEQ ID NO: 82748 - DNA, 1545 bp, Artificial Sequence
  Description of Artificial Sequence: Synthetic coding sequence
atgggcgactggaacctgctgggcgacaccctggaggaggtgcacatccacagcaccatgatcggcaagatctggctgaccatcctgttcatcttcagaatgctggtgctgggcgtggccgccgaggacgtgtggaacgacgagcagagcggcttcatctgcaacaccgagcagcccggctgcagaaacgtgtgctacgaccaggccttccccatcagcctgatcagatactgggtgctgcaggtgatcttcgtgagcagccccagcctggtgtacatgggccacgccctgtacagactgagagtgctggaggaggagagacagagaatgaaggcccagctgagagtggagctggaggaggtggagttcgagatgcccagagacagaagaagactggagcaggagctgtgccagctggagaagagaaagctgaacaaggcccccctgagaggcaccctgctgtgcacctacgtgatccacatcttcaccagaagcgtggtggaggtgggcttcatgatcggccagtacctgctgtacggcttccacctggagcccctgttcaagtgccacggccacccctgccccaacatcatcgactgcttcgtgagcagacccaccgagaagaccatcttcctgctgttcatgcagagcatcgccaccatcagcctgttcctgaacatcctggagatcttccacctgggcttcaagaagatcaagagaggcctgtggggcaagtacaagctgaagaaggagcacaacgagttccacgccaacaaggccaagcagaacgtggccaagtaccagagcaccagcgccaacagcctgaagagactgcccagcgcccccgactacaacctgctggtggagaagcagacccacaccgccgtgtaccccagcctgaacagcagcagcgtgttccagcccaaccccgacaaccacagcgtgaacgacgagaagtgcatcctggacgagcaggagaccgtgctgagcaacgagatcagcaccctgagcaccagctgcagccacttccagcacatcagcagcaacaacaacaaggacacccacaagatcttcggcaaggagctgaacggcaaccagctgatggagaagagagagaccgagggcaaggacagcaagagaaactactacagcagaggccacagaagcatccccggcgtggccatcgacggcgagaacaacatgagacagagcccccagaccgtgttcagcctgcccgccaactgcgactggaagcccagatggctgagagccacctggggcagcagcaccgagcacgagaacagaggcagcccccccaaggtgcccggcagcaaggccaccgccagcagcctgctgctgatcctgcagagacccaccagcagccagcccagactgaaggagacccccaagatcaaggccgaggccaagatctacgacagcaagcacccccccagactgctgcagagcaccgtgagcaccttcagcggcagagagcccagaagccccgcccccatgggccaccacagcttcagaggccccagatag

SEQ ID NO: 82749 - DNA, 852 bp, Artificial Sequence
  Description of Artificial Sequence: Synthetic coding sequence
atgaactggaccggcctgtacaccctgctgagcggcgtgaacagacacagcaccgccatcggcagagtgtggctgagcgtgatcttcatcttcagaatcatggtgctggtggtggccgccgagagcgtgtggggcgacgagaagagcagcttcatctgcaacaccctgcagcccggctgcaacagcgtgtgctacgaccagttcttccccatcagccacgtgagactgtggagcctgcagctgatcctggtgagcacccccgccctgctggtggccatgcacgtggcccaccagcagcacatcgagaagaagatgctgagactggagggccacggcgaccccctgcacctggaggaggtgaagagacacaaggtgcacatcagcggcaccctgtggtggacctacgtgatcagcgtggtgttcagactgctgttcgaggccgtgttcatgtacgtgttctacctgctgtaccccggctacgccatggtgagactggtgaagtgcgacgtgtacccctgccccaacaccgtggactgcttcgtgagcagacccaccgagaagaccgtgttcaccgtgttcatgctggccgccagcggcatctgcatcatcctgaacgtggccgaggtggtgtacctgatcatcagagcctgcgccagaagagcccagagaagaagcaacccccccagcagaaagggcagcggcttcggccacagactgagccccgagtacaagcagaacgagatcaacaagctgctgagcgagcaggacggcagcctgaaggacatcctgagaagaagccccggcaccggcgccggcctggccgagaagagcgacagatgcagcgcctgctag

SEQ ID NO: 82750 - DNA, 852 bp, Artificial Sequence; identical to SEQ ID NO: 82749
  Description of Artificial Sequence: Synthetic coding sequence

SEQ ID NO: 82751 - DNA, 852 bp, Artificial Sequence; identical to SEQ ID NO: 82749
  Description of Artificial Sequence: Synthetic coding sequence

SEQ ID NO: 82752 - DNA, 255 bp, Artificial Sequence
  Description of Artificial Sequence: Synthetic coding sequence
atgaactggaccggcctgtacaccctgctgagcggcgtgaacagacacagcaccgccatcggcagagtgtggctgagcgtgatcttcatcttcagaatcatggtgctggtggtggccgccgagagcgtgtggggcgacgagaagagcagcttcatctgcaacaccctgcagcccggctgcaacagcgtgtgctacgaccagttcttccccatcagccacgtgagactgtggagcctgcagctgatcctggtgtag

SEQ ID NO: 82753 - DNA, 681 bp, Artificial Sequence
  Description of Artificial Sequence: Synthetic coding sequence
atggactggggcaccctgcagaccatcctgggcggcgtgaacaagcacagcaccagcatcggcaagatctggctgaccgtgctgttcatcttcagaatcatgatcctggtggtggccgccaaggaggtgtggggcgacgagcaggccgacttcgtgtgcaacaccctgcagcccggctgcaagaacgtgtgctacgaccactacttccccatcagccacatcagactgtgggccctgcagctgatcttcgtgagcacccccgccctgctggtggccatgcacgtggcctacagaagacacgagaagaagagaaagttcatcaagggcgagatcaagagcgagttcaaggacatcgaggagatcaagacccagaaggtgagaatcgagggcagcctgtggtggacctacaccagcagcatcttcttcagagtgatcttcgaggccgccttcatgtacgtgttctacgtgatgtacgacggcttcagcatgcagagactggtgaagtgcaacgcctggccctgccccaacaccgtggactgcttcgtgagcagacccaccgagaagaccgtgttcaccgtgttcatgatcgccgtgagcggcatctgcatcctgctgaacgtgaccgagctgtgctacctgctgatcagatactgcagcggcaagagcaagaagcccgtgtag

SEQ ID NO: 82754 - DNA, 681 bp, Artificial Sequence; identical to SEQ ID NO: 82753
  Description of Artificial Sequence: Synthetic coding sequence

SEQ ID NO: 82755 - DNA, 813 bp, Artificial Sequence
  Description of Artificial Sequence: Synthetic coding sequence
atggactggaagaccctgcaggccctgctgagcggcgtgaacaagtacagcaccgccttcggcagaatctggctgagcgtggtgttcgtgttcagagtgctggtgtacgtggtggccgccgagagagtgtggggcgacgagcagaaggacttcgactgcaacaccaagcagcccggctgcaccaacgtgtgctacgacaactacttccccatcagcaacatcagactgtgggccctgcagctgatcttcgtgacctgccccagcctgctggtgatcctgcacgtggcctacagagaggagagagagagaagacacagacagaagcacggcgaccagtgcgccaagctgtacgacaacgccggcaagaagcacggcggcctgtggtggacctacctgttcagcctgatcttcaagctgatcatcgagttcctgttcctgtacctgctgcacaccctgtggcacggcttcaacatgcccagactggtgcagtgcgccaacgtggccccctgccccaacatcgtggactgctacatcgccagacccaccgagaagaagatcttcacctacttcatggtgggcgccagcgccgtgtgcatcgtgctgaccatctgcgagctgtgctacctgatctgccacagagtgctgagaggcctgcacaaggacaagcccagaggcggctgcagccccagcagcagcgccagcagagccagcacctgcagatgccaccacaagctggtggaggccggcgaggtggaccccgaccccggcaacaacaagctgcaggccagcgcccccaacctgacccccatctag

SEQ ID NO: 82756 - DNA, 813 bp, Artificial Sequence; identical to SEQ ID NO: 82755
  Description of Artificial Sequence: Synthetic coding sequence

SEQ ID NO: 82757 - DNA, 765 bp, Artificial Sequence
  Description of Artificial Sequence: Synthetic coding sequence
atggactggaagaccctgcaggccctgctgagcggcgtgaacaagtacagcaccgccttcggcagaatctggctgagcgtggtgttcgtgttcagagtgctggtgtacgtggtggccgccgagagagtgtggggcgacgagcagaaggacttcgactgcaacaccaagcagcccggctgcaccaacgtgtgctacgacaactacttccccatcagcaacatcagactgtgggccctgcagctgatcttcgtgacctgccccagcctgctggtgatcctgcacgtggcctacagagaggagagagagagaagacacagacagaagcacggcgaccagtgcgccaagctgtacgacaacgccggcaagaagcacggcggcctgtggtggacctacctgctgcacaccctgtggcacggcttcaacatgcccagactggtgcagtgcgccaacgtggccccctgccccaacatcgtggactgctacatcgccagacccaccgagaagaagatcttcacctacttcatggtgggcgccagcgccgtgtgcatcgtgctgaccatctgcgagctgtgctacctgatctgccacagagtgctgagaggcctgcacaaggacaagcccagaggcggctgcagccccagcagcagcgccagcagagccagcacctgcagatgccaccacaagctggtggaggccggcgaggtggaccccgaccccggcaacaacaagctgcaggccagcgcccccaacctgacccccatctag

SEQ ID NO: 82758 - DNA, 801 bp, Artificial Sequence
  Description of Artificial Sequence: Synthetic coding sequence
atgaactgggccttcctgcagggcctgctgagcggcgtgaacaagtacagcaccgtgctgagcagaatctggctgagcgtggtgttcatcttcagagtgctggtgtacgtggtggccgccgaggaggtgtgggacgacgagcagaaggacttcgtgtgcaacaccaagcagcccggctgccccaacgtgtgctacgacgagttcttccccgtgagccacgtgagactgtgggccctgcagctgatcctggtgacctgccccagcctgctggtggtgatgcacgtggcctacagagaggagagagagagaaagcaccacctgaagcacggccccaacgcccccagcctgtacgacaacctgagcaagaagagaggcggcctgtggtggacctacctgctgagcctgatcttcaaggccgccgtggacgccggcttcctgtacatcttccacagactgtacaaggactacgacatgcccagagtggtggcctgcagcgtggagccctgcccccacaccgtggactgctacatcagcagacccaccgagaagaaggtgttcacctacttcatggtgaccaccgccgccatctgcatcctgctgaacctgagcgaggtgttctacctggtgggcaagagatgcatggagatcttcggccccagacacagaagacccagatgcagagagtgcctgcccgacacctgccccccctacgtgctgagccagggcggccaccccgaggacggcaacagcgtgctgatgaaggccggcagcgcccccgtggacgccggcggctacccctag

SEQ ID NO: 82759 - DNA, 822 bp, Artificial Sequence
  Description of Artificial Sequence: Synthetic coding sequence
atgaactggagcatcttcgagggcctgctgagcggcgtgaacaagtacagcaccgccttcggcagaatctggctgagcctggtgttcatcttcagagtgctggtgtacctggtgaccgccgagagagtgtggagcgacgaccacaaggacttcgactgcaacaccagacagcccggctgcagcaacgtgtgcttcgacgagttcttccccgtgagccacgtgagactgtgggccctgcagctgatcctggtgacctgccccagcctgctggtggtgatgcacgtggcctacagagaggtgcaggagaagagacacagagaggcccacggcgagaacagcggcagactgtacctgaaccccggcaagaagagaggcggcctgtggtggacctacgtgtgcagcctggtgttcaaggccagcgtggacatcgccttcctgtacgtgttccacagcttctaccccaagtacatcctgccccccgtggtgaagtgccacgccgacccctgccccaacatcgtggactgcttcatcagcaagcccagcgagaagaacatcttcaccctgttcatggtggccaccgccgccatctgcatcctgctgaacctggtggagctgatctacctggtgagcaagagatgccacgagtgcctggccgccagaaaggcccaggccatgtgcaccggccaccacccccacggcaccaccagcagctgcaagcaggacgacctgctgagcggcgacctgatcttcctgggcagcgacagccacccccccctgctgcccgacagacccagagaccacgtgaagaagaccatcctgtag

SEQ ID NO: 82760 - DNA, 786 bp, Artificial Sequence
  Description of Artificial Sequence: Synthetic coding sequence
atggactggggcaccctgcacaccttcatcggcggcgtgaacaagcacagcaccagcatcggcaaggtgtggatcaccgtgatcttcatcttcagagtgatgatcctggtggtggccgcccaggaggtgtggggcgacgagcaggaggacttcgtgtgcaacaccctgcagcccggctgcaagaacgtgtgctacgaccacttcttccccgtgagccacatcagactgtgggccctgcagctgatcttcgtgagcacccccgccctgctggtggccatgcacgtggcctactacagacacgagaccaccagaaagttcagaagaggcgagaagagaaacgacttcaaggacatcgaggacatcaagaagcagaaggtgagaatcgagggcagcctgtggtggacctacaccagcagcatcttcttcagaatcatcttcgaggccgccttcatgtacgtgttctacttcctgtacaacggctaccacctgccctgggtgctgaagtgcggcatcgacccctgccccaacctggtggactgcttcatcagcagacccaccgagaagaccgtgttcaccatcttcatgatcagcgccagcgtgatctgcatgctgctgaacgtggccgagctgtgctacctgctgctgaaggtgtgcttcagaagaagcaagagagcccagacccagaagaaccaccccaaccacgccctgaaggagagcaagcagaacgagatgaacgagctgatcagcgacagcggccagaacgccatcaccggcttccccagctag

SEQ ID NO: 82761 - DNA, 786 bp, Artificial Sequence; identical to SEQ ID NO: 82760
  Description of Artificial Sequence: Synthetic coding sequence

SEQ ID NO: 82762 - DNA, 786 bp, Artificial Sequence; identical to SEQ ID NO: 82760
  Description of Artificial Sequence: Synthetic coding sequence

SEQ ID NO: 82763 - DNA, 786 bp, Artificial Sequence; identical to SEQ ID NO: 82760
  Description of Artificial Sequence: Synthetic coding sequence

SEQ ID NO: 82764 - DNA, 672 bp, Artificial Sequence
  Description of Artificial Sequence: Synthetic coding sequence
atgagctggatgttcctgagagacctgctgagcggcgtgaacaagtacagcaccggcaccggctggatctggctggccgtggtgttcgtgttcagactgctggtgtacatggtggccgccgagcacgtgtggaaggacgagcagaaggagttcgagtgcaacagcagacagcccggctgcaagaacgtgtgcttcgacgacttcttccccatcagccaggtgagactgtgggccctgcagctgatcatggtgagcacccccagcctgctggtggtgctgcacgtggcctaccacgagggcagagagaagagacacagaaagaagctgtacgtgagccccggcaccatggacggcggcctgtggtacgcctacctgatcagcctgatcgtgaagaccggcttcgagatcggcttcctggtgctgttctacaagctgtacgacggcttcagcgtgccctacctgatcaagtgcgacctgaagccctgccccaacaccgtggactgcttcatcagcaagcccaccgagaagaccatcttcatcctgttcctggtgatcaccagctgcctgtgcatcgtgctgaacttcatcgagctgagcttcctggtgctgaagtgcttcatcaagtgctgcctgcagaagtacctgaagaagccccaggtgctgagcgtgtag

SEQ ID NO: 82765 - DNA, 492 bp, Artificial Sequence
  Description of Artificial Sequence: Synthetic coding sequence
atgagctggatgttcctgagagacctgctgagcggcgtgaacaagtacagcaccggcaccggctggatctggctggccgtggtgttcgtgttcagactgctggtgtacatggtggccgccgagcacgtgtggaaggacgagcagaaggagttcgagtgcaacagcagacagcccggctgcaagaacgtgtgcttcgacgacttcttccccatcagccaggtgagactgtgggccctgcagctgatcatggtgagcacccccagcctgctggtggtgctgcacgtggcctaccacgagggcagagagaagagacacagaaagaagctgtacgtgagccccggcaccatggacggcggcctgtggtacgcctacctgatcagcctgatcgtgaagaccggcttcgagatcggcttcctggtgctgttctacaagctgtacgacggcttcagcgtgccctacctgatcaagtgcgacctgaagccctgcccctag

SEQ ID NO: 82766 - DNA, 672 bp, Artificial Sequence; identical to SEQ ID NO: 82764
  Description of Artificial Sequence: Synthetic coding sequence

SEQ ID NO: 82767 - DNA, 966 bp, Artificial Sequence
  Description of Artificial Sequence: Synthetic coding sequence
atgggcgagtggaccatcctggagagactgctggaggccgccgtgcagcagcacagcaccatgatcggcagaatcctgctgaccgtggtggtgatcttcagaatcctgatcgtggccatcgtgggcgagaccgtgtacgacgacgagcagaccatgttcgtgtgcaacaccctgcagcccggctgcaaccaggcctgctacgacagagccttccccatcagccacatcagatactgggtgttccagatcatcatggtgtgcacccccagcctgtgcttcatcacctacagcgtgcaccagagcgccaagcagagagagagaagatacagcaccgtgttcctggccctggacagagacccccccgagagcatcggcggccccggcggcaccggcggcggcggcagcggcggcggcaagagagaggacaagaagctgcagaacgccatcgtgaacggcgtgctgcagaacaccgagaacaccagcaaggagaccgagcccgactgcctggaggtgaaggagctgaccccccaccccagcggcctgagaaccgccagcaagagcaagctgagaagacaggagggcatcagcagattctacatcatccaggtggtgttcagaaacgccctggagatcggcttcctggtgggccagtacttcctgtacggcttcagcgtgcccggcctgtacgagtgcaacagatacccctgcatcaaggaggtggagtgctacgtgagcagacccaccgagaagaccgtgttcctggtgttcatgttcgccgtgagcggcatctgcgtggtgctgaacctggccgagctgaaccacctgggctggagaaagatcaagctggccgtgagaggcgcccaggccaagagaaagagcatctacgagatcagaaacaaggacctgcccagagtgagcgtgcccaacttcggcagaacccagagcagcgacagcgcctacgtgtag

SEQ ID NO: 82768 - DNA, 891 bp, Artificial Sequence
  Description of Artificial Sequence: Synthetic coding sequence
atgggcgagtgggccttcctgggcagcctgctggacgccgtgcagctgcagagccccctggtgggcagactgtggctggtggtgatgctgatcttcagaatcctggtgctggccaccgtgggcggcgccgtgttcgaggacgagcaggaggagttcgtgtgcaacaccctgcagcccggctgcagacagacctgctacgacagagccttccccgtgagccactacagattctggctgttccacatcctgctgctgagcgccccccccgtgctgttcgtggtgtacagcatgcacagagccggcaaggaggccggcggcgccgaggccgccgcccagtgcgcccccggcctgcccgaggcccagtgcgccccctgcgccctgagagccagaagagccagaagatgctacctgctgagcgtggccctgagactgctggccgagctgaccttcctgggcggccaggccctgctgtacggcttcagagtggccccccacttcgcctgcgccggccccccctgcccccacaccgtggactgcttcgtgagcagacccaccgagaagaccgtgttcgtgctgttctacttcgccgtgggcctgctgagcgccctgctgagcgtggccgagctgggccacctgctgtggaagggcagacccagagccggcgagagagacaacagatgcaacagagcccacgaggaggcccagaagctgctgccccccccccccccccccccccccatcgtggtgacctgggaggagaacagacacctgcagggcgagggcagccccggcagcccccaccccaagaccgagctggacgcccccagattcagaagagagagcaccagccccgccggctggcactgcagcctgcccttccacggcacctag

SEQ ID NO: 82769 - DNA, 1113 bp, Artificial Sequence
  Description of Artificial Sequence: Synthetic coding sequence
atggagggcgtggacctgctgggcttcctgatcatcaccctgaactgcaacgtgaccatggtgggcaagctgtggttcgtgctgaccatgctgctgagaatgctggtgatcgtgctggccggcagacccgtgtaccaggacgagcaggagagattcgtgtgcaacaccctgcagcccggctgcgccaacgtgtgctacgacgtgttcagccccgtgagccacctgagattctggctgatccagggcgtgtgcgtgctgctgcccagcgccgtgttcagcgtgtacgtgctgcacagaggcgccaccctggccgccctgggccccagaagatgccccgaccccagagagcccgccagcggccagagaagatgccccagacccttcggcgagagaggcggcctgcaggtgcccgacttcagcgccggctacatcatccacctgctgctgagaaccctgctggaggccgccttcggcgccctgcactacttcctgttcggcttcctggcccccaagaagttcccctgcaccagacccccctgcaccggcgtggtggactgctacgtgagcagacccaccgagaagagcctgctgatgctgttcctgtgggccgtgagcgccctgagcttcctgctgggcctggccgacctggtgtgcagcctgagaagaagaatgagaagaagacccggcccccccaccagccccagcatcagaaagcagagcggcgccagcggccacgccgagggcagaagaaccgacgaggagggcggcagagaggaggagggcgcccccgccccccccggcgccagagccggcggcgagggcgccggcagccccagaagaaccagcagagtgagcggccacaccaagatccccgacgaggacgagagcgaggtgaccagcagcgccagcgagaagctgggcagacagcccagaggcagaccccacagagaggccgcccaggaccccagaggcagcggcagcgaggagcagcccagcgccgcccccagcagactggccgccccccccagctgcagcagcctgcagccccccgacccccccgccagcagcagcggcgccccccacctgagagccagaaagagcgagtgggtgtag

SEQ ID NO: 82770 - DNA, 1191 bp, Artificial Sequence
  Description of Artificial Sequence: Synthetic coding sequence
atgagctggagcttcctgaccagactgctggaggagatccacaaccacagcaccttcgtgggcaagatctggctgaccgtgctgatcgtgttcagaatcgtgctgaccgccgtgggcggcgagagcatctactacgacgagcagagcaagttcgtgtgcaacaccgagcagcccggctgcgagaacgtgtgctacgacgccttcgcccccctgagccacgtgagattctgggtgttccagatcatcctggtggccacccccagcgtgatgtacctgggctacgccatccacaagatcgccaagatggagcacggcgaggccgacaagaaggccgccagaagcaagccctacgccatgagatggaagcagcacagagccctggaggagaccgaggaggacaacgaggaggaccccatgatgtaccccgagatggagctggagagcgacaaggagaacaaggagcagagccagcccaagcccaagcacgacggcagaagaagaatcagagaggacggcctgatgaagatctacgtgctgcagctgctggccagaaccgtgttcgaggtgggcttcctgatcggccagtacttcctgtacggcttccaggtgcaccccttctacgtgtgcagcagactgccctgcccccacaagatcgactgcttcatcagcagacccaccgagaagaccatcttcctgctgatcatgtacggcgtgaccggcctgtgcctgctgctgaacatctgggagatgctgcacctgggcttcggcaccatcagagacagcctgaacagcaagagaagagagctggaggaccccggcgcctacaactaccccttcacctggaacacccccagcgccccccccggctacaacatcgccgtgaagcccgaccagatccagtacaccgagctgagcaacgccaagatcgcctacaagcagaacaaggccaacaccgcccaggagcagcagtacggcagccacgaggagaacctgcccgccgacctggaggccctgcagagagagatcagaatggcccaggagagactggacctggccgtgcaggcctacagccaccagaacaacccccacggccccagagagaagaaggccaaggtgggcagcaaggccggcagcaacaagagcaccgccagcagcaagagcggcgacggcaagaccagcgtgtggatctag

SEQ ID NO: 82771 - DNA, 1191 bp, Artificial Sequence; identical to SEQ ID NO: 82770
  Description of Artificial Sequence: Synthetic coding sequence

SEQ ID NO: 82772 - DNA, 1320 bp, Artificial Sequence
  Description of Artificial Sequence: Synthetic coding sequence
atgaccaacatgagctggagcttcctgaccagactgctggaggagatccacaaccacagcaccttcgtgggcaaggtgtggctgaccgtgctggtggtgttcagaatcgtgctgaccgccgtgggcggcgaggccatctacagcgacgagcaggccaagttcacctgcaacaccagacagcccggctgcgacaacgtgtgctacgacgccttcgcccccctgagccacgtgagattctgggtgttccagatcgtggtgatcagcacccccagcgtgatgtacctgggctacgccgtgcacagactggccagagccagcgagcaggagagaagaagagccctgagaagaagacccggccccagaagagcccccagagcccacctgccccccccccacgccggctggcccgagcccgccgacctgggcgaggaggagcccatgctgggcctgggcgaggaggaggaggaggaggagaccggcgccgccgagggcgccggcgaggaggccgaggaggccggcgccgaggaggcctgcaccaaggccgtgggcgccgacggcaaggccgccggcacccccggccccaccggccagcacgacggcagaagaagaatccagagagagggcctgatgagagtgtacgtggcccagctggtggccagagccgccttcgaggtggccttcctggtgggccagtacctgctgtacggcttcgaggtgagacccttcttcccctgcagcagacagccctgcccccacgtggtggactgcttcgtgagcagacccaccgagaagaccgtgttcctgctggtgatgtacgtggtgagctgcctgtgcctgctgctgaacctgtgcgagatggcccacctgggcctgggcagcgcccaggacgccgtgagaggcagaagaggcccccccgccagcgcccccgcccccgcccccagaccccccccctgcgccttccccgccgccgccgccggcctggcctgcccccccgactacagcctggtggtgagagccgccgagagagccagagcccacgaccagaacctggccaacctggccctgcaggccctgagagacggcgccgccgccggcgacagagacagagacagcagcccctgcgtgggcctgcccgccgccagcagaggcccccccagagccggcgcccccgccagcagaaccggcagcgccaccagcgccggcaccgtgggcgagcagggcagacccggcacccacgagagacccggcgccaagcccagagccggcagcgagaagggcagcgccagcagcagagacggcaagaccaccgtgtggatctag

SEQ ID NO: 82773 - DNA, 840 bp, Artificial Sequence
  Description of Artificial Sequence: Synthetic coding sequence
atgtgcggcagattcctgagaagactgctggccgaggagagcagaagaagcacccccgtgggcagactgctgctgcccgtgctgctgggcttcagactggtgctgctggccgccagcggccccggcgtgtacggcgacgagcagagcgagttcgtgtgccacacccagcagcccggctgcaaggccgcctgcttcgacgccttccaccccctgagccccctgagattctgggtgttccaggtgatcctggtggccgtgcccagcgccctgtacatgggcttcaccctgtaccacgtgatctggcactgggagctgagcggcaagggcaaggaggaggagaccctgatccagggcagagagggcaacaccgacgtgcccggcgccggcagcctgagactgctgtgggcctacgtggcccagctgggcgccagactggtgctggagggcgccgccctgggcctgcagtaccacctgtacggcttccagatgcccagcagcttcgcctgcagaagagagccctgcctgggcagcatcacctgcaacctgagcagacccagcgagaagaccatcttcctgaagaccatgttcggcgtgagcggcttctgcctgctgttcaccttcctggagctggtgctgctgggcctgggcagatggtggagaacctggaagcacaagagcagcagcagcaagtacttcctgaccagcgagagcaccagaagacacaagaaggccaccgacagcctgcccgtggtggagaccaaggagcagttccaggaggccgtgcccggcagaagcctggcccaggagaagcagagacccgtgggccccagagacgcctag

SEQ ID NO: 82774 - DNA, 1338 bp, Artificial Sequence
  Description of Artificial Sequence: Synthetic coding sequence
atgaccatgttcgagaacgtgaccagagccctggccagacagctgaaccccagaggcgacctgacccccctggacagcctgatcgacttcaagagattccaccccttctgcctggtgctgagaaagagaaagagcaccctgttctggggcgccagatacgtgagaaccgactacaccctgctggacgtgctggagcccggcagcagccccagcgaccccaccgacaccggcaacttcggcttcaagaacatgctggacaccagagtggagggcgacgtggacgtgcccaagaccgtgaaggtgaagggcaccgccggcctgagccagaacagcaccctggaggtgcagaccctgagcgtggcccccaaggccctggagaccgtgcaggagagaaagctggccgccgaccaccccttcctgaaggagatgcaggaccagggcgagaacctgtacgtggtgatggaggtggtggagaccgtgcaggaggtgaccctggagagagccggcaaggccgaggcctgcttcagcctgcccttcttcgcccccctgggcctgcagggcagcatcaaccacaaggaggccgtgaccatccccaagggctgcgtgctggccttcagagtgagacagctgatggtgaagggcaaggacgagtgggacatcccccacatctgcaacgacaacatgcagaccttcccccccggcgagaagagcggcgaggagaaggtgatcctgatccaggccagcgacgtgggcgacgtgcacgagggcttcagaaccctgaaggaggaggtgcagagagagacccagcaggtggagaagctgagcagagtgggccagagcagcctgctgagcagcctgagcaagctgctgggcaagaagaaggagctgcaggacctggagctggccctggagggcgccctggacaagggccacgaggtgaccctggaggccctgcccaaggacgtgctgctgagcaaggaggccgtgggcgccatcctgtacttcgtgggcgccctgaccgagctgagcgaggcccagcagaagctgctggtgaagagcatggagaagaagatcctgcccgtgcagctgaagctggtggagagcaccatggagcagaacttcctgctggacaaggagggcgtgttccccctgcagcccgagctgctgagcagcctgggcgacgaggagctgaccctgaccgaggccctggtgggcctgagcggcctggaggtgcagagaagcggcccccagtacatgtgggaccccgacaccctgcccagactgtgcgccctgtacgccggcctgagcctgctgcagcagctgaccaaggccagctag

SEQ ID NO: 82775 - DNA, 1212 bp, Artificial Sequence
  Description of Artificial Sequence: Synthetic coding sequence
atgttcagcgtgttcgaggagatcaccagaatcgtggtgaaggagatggacgccggcggcgacatgatcgccgtgagaagcctggtggacgccgacagattcagatgcttccacctggtgggcgagaagagaaccttcttcggctgcagacactacaccaccggcctgaccctgatggacatcctggacaccgacggcgacaagtggctggacgagctggacagcggcctgcagggccagaaggccgagttccagatcctggacaacgtggacagcaccggcgagctgatcgtgagactgcccaaggagatcaccatcagcggcagcttccagggcttccaccaccagaagatcaagatcagcgagaacagaatcagccagcagtacctggccaccctggagaacagaaagctgaagagagagctgcccttcagcttcagaagcatcaacaccagagagaacctgtacctggtgaccgagaccctggagaccgtgaaggaggagaccctgaagagcgacagacagtacaagttctggagccagatcagccagggccacctgagctacaagcacaagggccagagagaggtgaccatcccccccaacagagtgctgagctacagagtgaagcagctggtgttccccaacaaggagaccatgaagaaggacggcgccagcagctgcctgggcaagagcctgggcagcgaggacagcagaaacatgaaggagaagctggaggacatggagagcgtgctgaaggacctgaccgaggagaagagaaaggacgtgctgaacagcctggccaagtgcctgggcaaggaggacatcagacaggacctggagcagagagtgagcgaggtgctgatcagcggcgagctgcacatggaggaccccgacaagcccctgctgagcagcctgttcaacgccgccggcgtgctggtggaggccagagccaaggccatcctggacttcctggacgccctgctggagctgagcgaggagcagcagttcgtggccgaggccctggagaagggcaccctgcccctgctgaaggaccaggtgaagagcgtgatggagcagaactgggacgagctggccagcagcccccccgacatggactacgaccccgaggccagaatcctgtgcgccctgtacgtggtggtgagcatcctgctggagctggccgagggccccaccagcgtgagcagctag

SEQ ID NO: 82776 - DNA, 1236 bp, Artificial Sequence
  Description of Artificial Sequence: Synthetic coding sequence
atgttcagcgtgttcgaggagatcaccagaatcgtggtgaaggagatggacgccggcggcgacatgatcgccgtgagaagcctggtggacgccgacagattcagatgcttccacctggtgggcgagaagagaaccttcttcggctgcagacactacaccaccggcctgaccctgatggacatcctggacaccgacggcgacaagtggctggacgagctggacagcggcctgcagggccagaaggccgagttccagatcctggacaacgtggacagcaccggcgagctgatcgtgagactgcccaaggagatcaccatcagcggcagcttccagggcttccaccaccagaagatcaagatcagcgagaacagaatcagccagcagtacctggccaccctggagaacagaaagctgaagagagagctgcccttcagcttcagaagcatcaacaccagagagaacctgtacctggtgaccgagaccctggagaccgtgaaggaggagaccctgaagagcgacagacagtacaagttctggagccagatcagccagggccacctgagctacaagcacaagggccagagagaggtgaccatcccccccaacagagtgctgagctacagagtgaagcagctggtgttccccaacaaggagaccatgagcgccggcctggacatccacttcagaggcaagaccaagagcttccccgagggcaagagcctgggcagcgaggacagcagaaacatgaaggagaagctggaggacatggagagcgtgctgaaggacctgaccgaggagaagagaaaggacgtgctgaacagcctggccaagtgcctgggcaaggaggacatcagacaggacctggagcagagagtgagcgaggtgctgatcagcggcgagctgcacatggaggaccccgacaagcccctgctgagcagcctgttcaacgccgccggcgtgctggtggaggccagagccaaggccatcctggacttcctggacgccctgctggagctgagcgaggagcagcagttcgtggccgaggccctggagaagggcaccctgcccctgctgaaggaccaggtgaagagcgtgatggagcagaactgggacgagctggccagcagcccccccgacatggactacgaccccgaggccagaatcctgtgcgccctgtacgtggtggtgagcatcctgctggagctggccgagggccccaccagcgtgagcagctag

SEQ ID NO: 82777 - DNA, 1185 bp, Artificial Sequence
  Description of Artificial Sequence: Synthetic coding sequence
atgttcagcgtgttcgaggagatcaccagaatcgtggtgaaggagatggacgccggcggcgacatgatcgccgtgagaagcctggtggacgccgacagattcagatgcttccacctggtgggcgagaagagaaccttcttcggctgcagacactacaccaccggcctgaccctgatggacatcctggacaccgacggcgacaagtggctggacgagctggacagcggcctgcagggccagaaggccgagttccagatcctggacaacgtggacagcaccggcgagctgatcgtgagactgcccaaggagatcaccatcagcggcagcttccagggcttccaccaccagaagatcaagatcagcgagaacagaatcagccagcagtacctggccaccctggagaacagaaagctgaagagagagctgcccttcagcttcagaagcatcaacaccagagagaacctgtacctggtgaccgagaccctggagaccgtgaaggaggagaccctgaagagcgacagacagtacaagttctggagccagatcagccagggccacctgagctacaagcacaagggccagagagaggtgaccatcccccccaacagagtgctgagctacagagtgaagcagctggtgttccccaacaaggagaccatgagaaagagcctgggcagcgaggacagcagaaacatgaaggagaagctggaggacatggagagcgtgctgaaggacctgaccgaggagaagagaaaggacgtgctgaacagcctggccaagtgcctgggcaaggaggacatcagacaggacctggagcagagagtgagcgaggtgctgatcagcggcgagctgcacatggaggaccccgacaagcccctgctgagcagcctgttcaacgccgccggcgtgctggtggaggccagagccaaggccatcctggacttcctggacgccctgctggagctgagcgaggagcagcagttcgtggccgaggccctggagaagggcaccctgcccctgctgaaggaccaggtgaagagcgtgatggagcagaactgggacgagctggccagcagcccccccgacatggactacgaccccgaggccagaatcctgtgcgccctgtacgtggtggtgagcatcctgctggagctggccgagggccccaccagcgtgagcagctag

SEQ ID NO: 82778 - DNA, 1236 bp, Artificial Sequence; identical to SEQ ID NO: 82776
  Description of Artificial Sequence: Synthetic coding sequence

SEQ ID NO: 82779 - DNA, 1251 bp, Artificial Sequence
  Description of Artificial Sequence: Synthetic coding sequence
atgttcagcgtgttcgaggagatcaccagaatcgtggtgaaggagatggacgccggcggcgacatgatcgccgtgagaagcctggtggacgccgacagattcagatgcttccacctggtgggcgagaagagaaccttcttcggctgcagacactacaccaccggcctgaccctgatggacatcctggacaccgacggcgacaagtggctggacgagctggacagcggcctgcagggccagaaggccgagttccagatcctggacaacgtggacagcaccggcgagctgatcgtgagactgcccaaggagatcaccatcagcggcagcttccagggcttccaccaccagaagatcaagatcagcgagaacagaatcagccagcagtacctggccaccctggagaacagaaagctgaagagagagctgcccttcagcttcagaagcatcaacaccagagagaacctgtacctggtgaccgagaccctggagaccgtgaaggaggagaccctgaagagcgacagacagtacaagttctggagccagatcagccagggccacctgagctacaagcacaagggccagagagaggtgaccatcccccccaacagagtgctgagctacagagtgaagcagctggtgttccccaacaaggagaccatgaacatccacttcagaggcaagaccaagagcttccccgaggagaaggacggcgccagcagctgcctgggcaagagcctgggcagcgaggacagcagaaacatgaaggagaagctggaggacatggagagcgtgctgaaggacctgaccgaggagaagagaaaggacgtgctgaacagcctggccaagtgcctgggcaaggaggacatcagacaggacctggagcagagagtgagcgaggtgctgatcagcggcgagctgcacatggaggaccccgacaagcccctgctgagcagcctgttcaacgccgccggcgtgctggtggaggccagagccaaggccatcctggacttcctggacgccctgctggagctgagcgaggagcagcagttcgtggccgaggccctggagaagggcaccctgcccctgctgaaggaccaggtgaagagcgtgatggagcagaactgggacgagctggccagcagcccccccgacatggactacgaccccgaggccagaatcctgtgcgccctgtacgtggtggtgagcatcctgctggagctggccgagggccccaccagcgtgagcagctag

SEQ ID NO: 82780 - DNA, 1047 bp, Artificial Sequence
  Description of Artificial Sequence: Synthetic coding sequence
tgactggacgagctggacagcggcctgcagggccagaaggccgagttccagatcctggacaacgtggacagcaccggcgagctgatcgtgagactgcccaaggagatcaccatcagcggcagcttccagggcttccaccaccagaagatcaagatcagcgagaacagaatcagccagcagtacctggccaccctggagaacagaaagctgaagagagagctgcccttcagcttcagaagcatcaacaccagagagaacctgtacctggtgaccgagaccctggagaccgtgaaggaggagaccctgaagagcgacagacagtacaagttctggagccagatcagccagggccacctgagctacaagcacaagggccagagagaggtgaccatcccccccaacagagtgctgagctacagagtgaagcagctggtgttccccaacaaggagaccatgaacatccacttcagaggcaagaccaagagcttccccgaggagaaggacggcgccagcagctgcctgggcaagagcctgggcagcgaggacagcagaaacatgaaggagaagctggaggacatggagagcgtgctgaaggacctgaccgaggagaagagaaaggacgtgctgaacagcctggccaagtgcctgggcaaggaggacatcagacaggacctggagcagagagtgagcgaggtgctgatcagcggcgagctgcacatggaggaccccgacaagcccctgctgagcagcctgttcaacgccgccggcgtgctggtggaggccagagccaaggccatcctggacttcctggacgccctgctggagctgagcgaggagcagcagttcgtggccgaggccctggagaagggcaccctgcccctgctgaaggaccaggtgaagagcgtgatggagcagaactgggacgagctggccagcagcccccccgacatggactacgaccccgaggccagaatcctgtgcgccctgtacgtggtggtgagcatcctgctggagctggccgagggccccaccagcgtgagcagctag

SEQ ID NO: 82781 - DNA, 1224 bp, Artificial Sequence
  Description of Artificial Sequence: Synthetic coding sequence
atgttcagcgtgttcgaggagatcaccagaatcgtggtgaaggagatggacgccggcggcgacatgatcgccgtgagaagcctggtggacgccgacagattcagatgcttccacctggtgggcgagaagagaaccttcttcggctgcagacactacaccaccggcctgaccctgatggacatcctggacaccgacggcgacaagtggctggacgagctggacagcggcctgcagggccagaaggccgagttccagatcctggacaacgtggacagcaccggcgagctgatcgtgagactgcccaaggagatcaccatcagcggcagcttccagggcttccaccaccagaagatcaagatcagcgagaacagaatcagccagcagtacctggccaccctggagaacagaaagctgaagagagagctgcccttcagcttcagaagcatcaacaccagagagaacctgtacctggtgaccgagaccctggagaccgtgaaggaggagaccctgaagagcgacagacagtacaagttctggagccagatcagccagggccacctgagctacaagcacaagggccagagagaggtgaccatcccccccaacagagtgctgagctacagagtgaagcagctggtgttccccaacaaggagaccatgaacatccacttcagaggcaagaccaagagcttccccgagggcaagagcctgggcagcgaggacagcagaaacatgaaggagaagctggaggacatggagagcgtgctgaaggacctgaccgaggagaagagaaaggacgtgctgaacagcctggccaagtgcctgggcaaggaggacatcagacaggacctggagcagagagtgagcgaggtgctgatcagcggcgagctgcacatggaggaccccgacaagcccctgctgagcagcctgttcaacgccgccggcgtgctggtggaggccagagccaaggccatcctggacttcctggacgccctgctggagctgagcgaggagcagcagttcgtggccgaggccctggagaagggcaccctgcccctgctgaaggaccaggtgaagagcgtgatggagcagaactgggacgagctggccagcagcccccccgacatggactacgaccccgaggccagaatcctgtgcgccctgtacgtggtggtgagcatcctgctggagctggccgagggccccaccagcgtgagcagctag

SEQ ID NO: 82782 - DNA, 1527 bp, Artificial Sequence
  Description of Artificial Sequence: Synthetic coding sequence
atgcccagcatgctggagagaatcagcaagaacctggtgaaggagatcggcagcaaggacctgacccccgtgaagtacctgctgagcgccaccaagctgagacagttcgtgatcctgagaaagaagaaggacagcagaagcagcttctgggagcagagcgactacgtgcccgtggagttcagcctgaacgacatcctggagcccagcagcagcgtgctggagaccgtggtgaccggccccttccacttcagcgacatcatgatccagaagcacaaggccgacatgggcgtgaacgtgggcatcgaggtgagcgtgagcggcgaggccagcgtggaccacggctgcagcctggagttccagatcgtgaccatccccagccccaacctggaggacttccagaagagaaagctgctggaccccgagcccagcttcctgaaggagtgcagaagaagaggcgacaacctgtacgtggtgaccgaggccgtggagctgatcaacaacaccgtgctgtacgacagcagcagcgtgaacatcctgggcaagatcgccctgtggatcacctacggcaagggccagggccagggcgagagcctgagagtgaagaagaaggccctgaccctgcagaagggcatggtgatggcctacaagagaaagcagctggtgatcaaggagaaggccatcctgatcagcgacgacgacgagcagagaaccttccaggacgagtacgagatcagcgagatggtgggctactgcgccgccagaagcgagggcctgctgcccagcttccacaccatcagccccaccctgttcaacgccagcagcaacgacatgaagctgaagcccgagctgttcctgacccagcagttcctgagcggccacctgcccaagtacgagcaggtgcacatcctgcccgtgggcagaatcgaggagcccttctggcagaacttcaagcacctgcaggaggaggtgttccagaagatcaagaccctggcccagctgagcaaggacgtgcaggacgtgatgttctacagcatcctggccatgctgagagacagaggcgccctgcaggacctgatgaacatgctggagctggacagcagcggccacctggacggccccggcggcgccatcctgaagaagctgcagcaggacagcaaccacgcctggttcaaccccaaggaccccatcctgtacctgctggaggccatcatggtgctgagcgacttccagcacgacctgctggcctgcagcatggagaagagaatcctgctgcagcagcaggagctggtgagaagcatcctggagcccaacttcagatacccctggagcatccccttcaccctgaagcccgagctgctggcccccctgcagagcgagggcctggccatcacctacggcctgctggaggagtgcggcctgagaatggagctggacaaccccagaagcacctgggacgtggaggccaagatgcccctgagcgccctgtacggcaccctgagcctgctgcagcagctggccgaggcctag

SEQ ID NO: 82783 - DNA, 462 bp, Artificial Sequence
  Description of Artificial Sequence: Synthetic coding sequence
atggtggccaccaagaccttcgccctgctgctgctgagcctgttcctggccgtgggcctgggcgagaagaaggagggccacttcagcgccctgcccagcctgcccgtgggcagccacgccaaggtgagcagcccccagcccagaggccccagatacgccgagggcaccttcatcagcgactacagcatcgccatggacaagatccaccagcaggacttcgtgaactggctgctggcccagaagggcaagaagaacgactggaagcacaacatcacccagagagaggccagagccctggagctggccagccaggccaacagaaaggaggaggaggccgtggagccccagagcagccccgccaagaaccccagcgacgaggacctgctgagagacctgctgatccaggagctgctggcctgcctgctggaccagaccaacctgtgcagactgagaagcagatag

SEQ ID NO: 82784 - DNA, 1401 bp, Artificial Sequence
  Description of Artificial Sequence: Synthetic coding sequence
atgaccaccagccccatcctgcagctgctgctgagactgagcctgtgcggcctgctgctgcagagagccgagaccggcagcaagggccagaccgccggcgagctgtaccagagatgggagagatacagaagagagtgccaggagaccctggccgccgccgagccccccagcggcctggcctgcaacggcagcttcgacatgtacgtgtgctgggactacgccgcccccaacgccaccgccagagccagctgcccctggtacctgccctggcaccaccacgtggccgccggcttcgtgctgagacagtgcggcagcgacggccagtggggcctgtggagagaccacacccagtgcgagaaccccgagaagaacgaggccttcctggaccagagactgatcctggagagactgcaggtgatgtacaccgtgggctacagcctgagcctggccaccctgctgctggccctgctgatcctgagcctgttcagaagactgcactgcaccagaaactacatccacatcaacctgttcaccagcttcatgctgagagccgccgccatcctgagcagagacagactgctgcccagacccggcccctacctgggcgaccaggccctggccctgtggaaccaggccctggccgcctgcagaaccgcccagatcgtgacccagtactgcgtgggcgccaactacacctggctgctggtggagggcgtgtacctgcacagcctgctggtgctggtgggcggcagcgaggagggccacttcagatactacctgctgctgggctggggcgcccccgccctgttcgtgatcccctgggtgatcgtgagatacctgtacgagaacacccagtgctgggagagaaacgaggtgaaggccatctggtggatcatcagaacccccatcctgatgaccatcctgatcaacttcctgatcttcatcagaatcctgggcatcctgctgagcaagctgagaaccagacagatgagatgcagagactacagactgagactggccagaagcaccctgaccctggtgcccctgctgggcgtgcacgaggtggtgttcgcccccgtgaccgaggagcaggccagaggcgccctgagattcgccaagctgggcttcgagatcttcctgagcagcttccagggcttcctggtgagcgtgctgtactgcttcatcaacaaggaggtgcagagcgagatcagaagaggctggcaccactgcagactgagaagaagcctgggcgaggagcagagacagctgcccgagagagccttcagagccctgcccagcggcagcggccccggcgaggtgcccaccagcagaggcctgagcagcggcaccctgcccggccccggcaacgaggccagcagagagctggagagctactgctag

SEQ ID NO: 82785 - DNA, 1293 bp, Artificial Sequence
  Description of Artificial Sequence: Synthetic coding sequence
atgaccaccagccccatcctgcagctgctgctgagactgagcctgtgcggcctgctgctgcagagagccgagaccggcagcaagggccagaccgccggcgagctgtaccagagatgggagagatacagaagagagtgccaggagaccctggccgccgccgagccccccagcgtggccgccggcttcgtgctgagacagtgcggcagcgacggccagtggggcctgtggagagaccacacccagtgcgagaaccccgagaagaacgaggccttcctggaccagagactgatcctggagagactgcaggtgatgtacaccgtgggctacagcctgagcctggccaccctgctgctggccctgctgatcctgagcctgttcagaagactgcactgcaccagaaactacatccacatcaacctgttcaccagcttcatgctgagagccgccgccatcctgagcagagacagactgctgcccagacccggcccctacctgggcgaccaggccctggccctgtggaaccaggccctggccgcctgcagaaccgcccagatcgtgacccagtactgcgtgggcgccaactacacctggctgctggtggagggcgtgtacctgcacagcctgctggtgctggtgggcggcagcgaggagggccacttcagatactacctgctgctgggctggggcgcccccgccctgttcgtgatcccctgggtgatcgtgagatacctgtacgagaacacccagtgctgggagagaaacgaggtgaaggccatctggtggatcatcagaacccccatcctgatgaccatcctgatcaacttcctgatcttcatcagaatcctgggcatcctgctgagcaagctgagaaccagacagatgagatgcagagactacagactgagactggccagaagcaccctgaccctggtgcccctgctgggcgtgcacgaggtggtgttcgcccccgtgaccgaggagcaggccagaggcgccctgagattcgccaagctgggcttcgagatcttcctgagcagcttccagggcttcctggtgagcgtgctgtactgcttcatcaacaaggaggtgcagagcgagatcagaagaggctggcaccactgcagactgagaagaagcctgggcgaggagcagagacagctgcccgagagagccttcagagccctgcccagcggcagcggccccggcgaggtgcccaccagcagaggcctgagcagcggcaccctgcccggccccggcaacgaggccagcagagagctggagagctactgctag

SEQ ID NO: 82786 - DNA, 1401 bp, Artificial Sequence; identical to SEQ ID NO: 82784
  Description of Artificial Sequence: Synthetic coding sequence

SEQ ID NO: 82787 - DNA, 1254 bp, Artificial Sequence
  Description of Artificial Sequence: Synthetic coding sequence
atggcctggttcgccctgtacctgctgagcctgctgtgggccaccgccggcaccagcacccagacccagagcagctgcagcgtgcccagcgcccaggagcccctggtgaacggcatccaggtgctgatggagaacagcgtgaccagcagcgcctaccccaaccccagcatcctgatcgccatgaacctggccggcgcctacaacctgaaggcccagaagctgctgacctaccagctgatgagcagcgacaacaacgacctgaccatcggccagctgggcctgaccatcatggccctgaccagcagctgcagagaccccggcgacaaggtgagcatcctgcagagacagatggagaactgggcccccagcagccccaacgccgaggccagcgccttctacggccccagcctggccatcctggccctgtgccagaagaacagcgaggccaccctgcccatcgccgtgagattcgccaagaccctgctggccaacagcagccccttcaacgtggacaccggcgccatggccaccctggccctgacctgcatgtacaacaagatccccgtgggcagcgaggagggctacagaagcctgttcggccaggtgctgaaggacatcgtggagaagatcagcatgaagatcaaggacaacggcatcatcggcgacatctacagcaccggcctggccatgcaggccctgagcgtgacccccgagcccagcaagaaggagtggaactgcaagaagaccaccgacatgatcctgaacgagatcaagcagggcaagttccacaaccccatgagcatcgcccagatcctgcccagcctgaagggcaagacctacctggacgtgccccaggtgacctgcagccccgaccacgaggtgcagcccaccctgcccagcaaccccggccccggccccaccagcgccagcaacatcaccgtgatctacaccatcaacaaccagctgagaggcgtggagctgctgttcaacgagaccatcaacgtgagcgtgaagagcggcagcgtgctgctggtggtgctggaggaggcccagagaaagaaccccatgttcaagttcgagaccaccatgaccagctggggcctggtggtgagcagcatcaacaacatcgccgagaacgtgaaccacaagacctactggcagttcctgagcggcgtgacccccctgaacgagggcgtggccgactacatccccttcaaccacgagcacatcaccgccaacttcacccagtactag

SEQ ID NO: 82788 - DNA, 1179 bp, Artificial Sequence
  Description of Artificial Sequence: Synthetic coding sequence
atggccgtgcccagcgcccaggagcccctggtgaacggcatccaggtgctgatggagaacagcgtgaccagcagcgcctaccccaaccccagcatcctgatcgccatgaacctggccggcgcctacaacctgaaggcccagaagctgctgacctaccagctgatgagcagcgacaacaacgacctgaccatcggccagctgggcctgaccatcatggccctgaccagcagctgcagagaccccggcgacaaggtgagcatcctgcagagacagatggagaactgggcccccagcagccccaacgccgaggccagcgccttctacggccccagcctggccatcctggccctgtgccagaagaacagcgaggccaccctgcccatcgccgtgagattcgccaagaccctgctggccaacagcagccccttcaacgtggacaccggcgccatggccaccctggccctgacctgcatgtacaacaagatccccgtgggcagcgaggagggctacagaagcctgttcggccaggtgctgaaggacatcgtggagaagatcagcatgaagatcaaggacaacggcatcatcggcgacatctacagcaccggcctggccatgcaggccctgagcgtgacccccgagcccagcaagaaggagtggaactgcaagaagaccaccgacatgatcctgaacgagatcaagcagggcaagttccacaaccccatgagcatcgcccagatcctgcccagcctgaagggcaagacctacctggacgtgccccaggtgacctgcagccccgaccacgaggtgcagcccaccctgcccagcaaccccggccccggccccaccagcgccagcaacatcaccgtgatctacaccatcaacaaccagctgagaggcgtggagctgctgttcaacgagaccatcaacgtgagcgtgaagagcggcagcgtgctgctggtggtgctggaggaggcccagagaaagaaccccatgttcaagttcgagaccaccatgaccagctggggcctggtggtgagcagcatcaacaacatcgccgagaacgtgaaccacaagacctactggcagttcctgagcggcgtgacccccctgaacgagggcgtggccgactacatccccttcaaccacgagcacatcaccgccaacttcacccagtactag

SEQ ID NO: 82789 - DNA, 306 bp, Artificial Sequence
  Description of Artificial Sequence: Synthetic coding sequence
atgcagagactgtgcgtgtacgtgctgatcttcgccctggccctggccgccttcagcgaggccagctggaagcccagaagccagcagcccgacgcccccctgggcaccggcgccaacagagacctggagctgccctggctggagcagcagggccccgccagccaccacagaagacagctgggcccccagggccccccccacctggtggccgaccccagcaagaagcagggcccctggctggaggaggaggaggaggcctacggctggatggacttcggcagaagaagcgccgaggacgagaactag

SEQ ID NO: 82790 - DNA, 447 bp, Artificial Sequence
  Description of Artificial Sequence: Synthetic coding sequence
atgagaggcagagagctgcccctggtgctgctggccctggtgctgtgcctggcccccagaggcagagccgtgcccctgcccgccggcggcggcaccgtgctgaccaagatgtaccccagaggcaaccactgggccgtgggccacctgatgggcaagaagagcaccggcgagagcagcagcgtgagcgagagaggcagcctgaagcagcagctgagagagtacatcagatgggaggaggccgccagaaacctgctgggcctgatcgaggccaaggagaacagaaaccaccagcccccccagcccaaggccctgggcaaccagcagcccagctgggacagcgaggacagcagcaacttcaaggacgtgggcagcaagggcaaggtgggcagactgagcgcccccggcagccagagagagggcagaaacccccagctgaaccagcagtag

SEQ ID NO: 82791 - DNA, 426 bp, Artificial Sequence
  Description of Artificial Sequence: Synthetic coding sequence
atgagaggcagagagctgcccctggtgctgctggccctggtgctgtgcctggcccccagaggcagagccgtgcccctgcccgccggcggcggcaccgtgctgaccaagatgtaccccagaggcaaccactgggccgtgggccacctgatgggcaagaagagcaccggcgagagcagcagcgtgagcgagagaggcagcctgaagcagcagctgagagagtacatcagatgggaggaggccgccagaaacctgctgggcctgatcgaggccaaggagaacagaaaccaccagcccccccagcccaaggccctgggcaaccagcagcccagctgggacagcgaggacagcagcaacttcaaggacgtgggcagcaagggcaagggcagccagagagagggcagaaacccccagctgaaccagcagtag

SEQ ID NO: 82792 - DNA, 417 bp, Artificial Sequence
  Description of Artificial Sequence: Synthetic coding sequence
atgagaggcagagagctgcccctggtgctgctggccctggtgctgtgcctggcccccagaggcagagccgtgcccctgcccgccggcggcggcaccgtgctgaccaagatgtaccccagaggcaaccactgggccgtgggccacctgatgggcaagaagagcaccggcgagagcagcagcgtgagcgagagaggcagcctgaagcagcagctgagagagtacatcagatgggaggaggccgccagaaacctgctgggcctgatcgaggccaaggagaacagaaaccaccagcccccccagcccaaggccctgggcaaccagcagcccagctgggacagcgaggacagcagcaacttcaaggacctggtggacagcctgctgcaggtgctgaacgtgaaggagggcacccccagctag

SEQ ID NO: 82793 - DNA, 1155 bp, Artificial Sequence
  Description of Artificial Sequence: Synthetic coding sequence
atggccctgaacgactgcttcctgctgaacctggaggtggaccacttcatgcactgcaacatcagcagccacagcgccgacctgcccgtgaacgacgactggagccaccccggcatcctgtacgtgatccccgccgtgtacggcgtgatcatcctgatcggcctgatcggcaacatcaccctgatcaagatcttctgcaccgtgaagagcatgagaaacgtgcccaacctgttcatcagcagcctggccctgggcgacctgctgctgctgatcacctgcgcccccgtggacgccagcagatacctggccgacagatggctgttcggcagaatcggctgcaagctgatccccttcatccagctgaccagcgtgggcgtgagcgtgttcaccctgaccgccctgagcgccgacagatacaaggccatcgtgagacccatggacatccaggccagccacgccctgatgaagatctgcctgaaggccgccttcatctggatcatcagcatgctgctggccatccccgaggccgtgttcagcgacctgcaccccttccacgaggagagcaccaaccagaccttcatcagctgcgccccctacccccacagcaacgagctgcaccccaagatccacagcatggccagcttcctggtgttctacgtgatccccctgagcatcatcagcgtgtactactacttcatcgccaagaacctgatccagagcgcctacaacctgcccgtggagggcaacatccacgtgaagaagcagatcgagagcagaaagagactggccaagaccgtgctggtgttcgtgggcctgttcgccttctgctggctgcccaaccacgtgatctacctgtacagaagctaccactacagcgaggtggacaccagcatgctgcacttcgtgaccagcatctgcgccagactgctggccttcaccaacagctgcgtgaaccccttcgccctgtacctgctgagcaagagcttcagaaagcagttcaacacccagctgctgtgctgccagcccggcctgatcatcagaagccacagcaccggcagaagcaccacctgcatgaccagcctgaagagcaccaaccccagcgtggccaccttcagcctgatcaacggcaacatctgccacgagagatacgtgtag

SEQ ID NO: 82794 - DNA, 480 bp, Artificial Sequence
  Description of Artificial Sequence: Synthetic coding sequence
atggccagcttcctggtgttctacgtgatccccctgagcatcatcagcgtgtactactacttcatcgccaagaacctgatccagagcgcctacaacctgcccgtggagggcaacatccacgtgaagaagcagatcgagagcagaaagagactggccaagaccgtgctggtgttcgtgggcctgttcgccttctgctggctgcccaaccacgtgatctacctgtacagaagctaccactacagcgaggtggacaccagcatgctgcacttcgtgaccagcatctgcgccagactgctggccttcaccaacagctgcgtgaaccccttcgccctgtacctgctgagcgagttccaggagaccgtgcagcacagcgccgccctgctgcccgcctggcccgaccaccccgtgagccagcactggaaggagtacaacctgcacgacctgccccaggagtaccagcccctgagaggccacctgtag

SEQ ID NO: 82795 - DNA, 600 bp, Artificial Sequence
  Description of Artificial Sequence: Synthetic coding sequence
atgctggcctacagcagcgtgcactgcttcagagaggacaagatgaagttcaccatcgtgttcgccggcctgctgggcgtgttcctggcccccgccctggccaactacaacatcaacgtgaacgacgacaacaacaacgccggcagcggccagcagagcgtgagcgtgaacaacgagcacaacgtggccaacgtggacaacaacaacggctgggacagctggaacagcatctgggactacggcaacggcttcgccgccaccagactgttccagaagaagacctgcatcgtgcacaagatgaacaaggaggtgatgcccagcatccagagcctggacgccctggtgaaggagaagaagctgcagggcaagggccccggcggccccccccccaagggcctgatgtacagcgtgaaccccaacaaggtggacgacctgagcaagttcggcaagaacatcgccaacatgtgcagaggcatccccacctacatggccgaggagatgcaggaggccagcctgttcttctacagcggcacctgctacaccaccagcgtgctgtggatcgtggacatcagcttctgcggcgacaccgtggagaactag

SEQ ID NO: 82796 - DNA, 1092 bp, Artificial Sequence
  Description of Artificial Sequence: Synthetic coding sequence
atgcagagagccggcggcggcagcgcccccggcggcaacggcggcggcggcggcggcggccccggcaccgccttcagcatcgacagcctgatcggcccccccccccccagaagcggccacctgctgtacaccggctaccccatgttcatgccctacagacccctggtgctgccccaggccctggcccccgcccccctgcccgccggcctgccccccctggcccccctggccagcttcgccggcagactgaccaacaccttctgcgccggcctgggccaggccgtgcccagcatggtggccctgaccaccgccctgcccagcttcgccgagccccccgacgccttctacggcccccaggagctggccgccgccgccgccgccgccgccgccaccgccgccagaaacaaccccgagcccggcggcagaagacccgagggcggcctggaggccgacgagctgctgcccgccagagagaaggtggccgagccccccccccccccccccccccacttcagcgagaccttccccagcctgcccgccgagggcaaggtgtacagcagcgacgaggagaagctggaggccagcgccggcgaccccgccggcagcgagcaggaggaggagggcagcggcggcgacagcgaggacgacggcttcctggacagcagcgccggcggccccggcgccctgctgggccccaagcccaagctgaagggcagcctgggcaccggcgccgaggagggcgcccccgtgaccgccggcgtgaccgcccccggcggcaagagcagaagaagaagaaccgccttcaccagcgagcagctgctggagctggagaaggagttccactgcaagaagtacctgagcctgaccgagagaagccagatcgcccacgccctgaagctgagcgaggtgcaggtgaagatctggttccagaacagaagagccaagtggaagagaatcaaggccggcaacgtgagcagcagaagcggcgagcccgtgagaaaccccaagatcgtggtgcccatccccgtgcacgtgaacagattcgccgtgagaagccagcaccagcagatggagcagggcgccagaccctag

SEQ ID NO: 82797 - DNA, 1047 bp, Artificial Sequence
  Description of Artificial Sequence: Synthetic coding sequence
atgagcgccgccttcccccccagcctgatgatgatgcagagacccctgggcagcagcaccgccttcagcatcgacagcctgatcggcagccccccccagcccagccccggccacttcgtgtacaccggctaccccatgttcatgccctacagacccgtggtgctgccccccccccccccccccccccccgccctgccccaggccgccctgcagcccgccctgccccccgcccacccccaccaccagatccccagcctgcccaccggcttctgcagcagcctggcccagggcatggccctgaccagcaccctgatggccaccctgcccggcggcttcagcgccagcccccagcaccaggaggccgccgccgccagaaagttcgccccccagcccctgcccggcggcggcaacttcgacaaggccgaggccctgcaggccgacgccgaggacggcaagggcttcctggccaaggagggcagcctgctggccttcagcgccgccgagaccgtgcaggccagcctggtgggcgccgtgagaggccagggcaaggacgagagcaaggtggaggacgaccccaagggcaaggaggagagcttcagcctggagagcgacgtggactacagcagcgacgacaacctgaccggccaggccgcccacaaggaggaggaccccggccacgccctggaggagaccccccccagcagcggcgccgccggcagcaccaccagcaccggcaagaacagaagaagaagaaccgccttcaccagcgagcagctgctggagctggagaaggagttccactgcaagaagtacctgagcctgaccgagagaagccagatcgcccacgccctgaagctgagcgaggtgcaggtgaagatctggttccagaacagaagagccaagtggaagagagtgaaggccggcaacgccaacagcaagaccggcgagcccagcagaaaccccaagatcgtggtgcccatccccgtgcacgtgagcagattcgccatcagaagccagcaccagcagctggagcaggccagaccctag

SEQ ID NO: 82798 - DNA, 1443 bp, Artificial Sequence
  Description of Artificial Sequence: Synthetic coding sequence
atggaggtggcccccgagcagcccagatggatggcccaccccgccgtgctgaacgcccagcaccccgacagccaccaccccggcctggcccacaactacatggagcccgcccagctgctgccccccgacgaggtggacgtgttcttcaaccacctggacagccagggcaacccctactacgccaaccccgcccacgccagagccagagtgagctacagccccgcccacgccagactgaccggcggccagatgtgcagaccccacctgctgcacagccccggcctgccctggctggacggcggcaaggccgccctgagcgccgccgccgcccaccaccacaacccctggaccgtgagccccttcagcaagacccccctgcaccccagcgccgccggcggccccggcggccccctgagcgtgtaccccggcgccggcggcggcagcggcggcggcagcggcagcagcgtggccagcctgacccccaccgccgcccacagcggcagccacctgttcggcttcccccccaccccccccaaggaggtgagccccgaccccagcaccaccggcgccgccagccccgccagcagcagcgccggcggcagcgccgccagaggcgaggacaaggacggcgtgaagtaccaggtgagcctgaccgagagcatgaagatggagagcggcagccccctgagacccggcctggccaccatgggcacccagcccgccacccaccaccccatccccacctaccccagctacgtgcccgccgccgcccacgactacagcagcggcctgttccaccccggcggcttcctgggcggccccgccagcagcttcacccccaagcagagaagcaaggccagaagctgcagcgagggcagagagtgcgtgaactgcggcgccaccgccacccccctgtggagaagagacggcaccggccactacctgtgcaacgcctgcggcctgtaccacaagatgaacggccagaacagacccctgatcaagcccaagagaagactgagcgccgccagaagagccggcacctgctgcgccaactgccagaccaccaccaccaccctgtggagaagaaacgccaacggcgaccccgtgtgcaacgcctgcggcctgtactacaagctgcacaacgtgaacagacccctgaccatgaagaaggagggcatccagaccagaaacagaaagatgagcaacaagagcaagaagagcaagaagggcgccgagtgcttcgaggagctgagcaagtgcatgcaggagaagagcagccccttcagcgccgccgccctggccggccacatggcccccgtgggccacctgccccccttcagccacagcggccacatcctgcccacccccacccccatccaccccagcagcagcctgagcttcggccacccccaccccagcagcatggtgaccgccatgggctag

SEQ ID NO: 82799 - DNA, 1401 bp, Artificial Sequence
  Description of Artificial Sequence: Synthetic coding sequence
atggaggtggcccccgagcagcccagatggatggcccaccccgccgtgctgaacgcccagcaccccgacagccaccaccccggcctggcccacaactacatggagcccgcccagctgctgccccccgacgaggtggacgtgttcttcaaccacctggacagccagggcaacccctactacgccaaccccgcccacgccagagccagagtgagctacagccccgcccacgccagactgaccggcggccagatgtgcagaccccacctgctgcacagccccggcctgccctggctggacggcggcaaggccgccctgagcgccgccgccgcccaccaccacaacccctggaccgtgagccccttcagcaagacccccctgcaccccagcgccgccggcggccccggcggccccctgagcgtgtaccccggcgccggcggcggcagcggcggcggcagcggcagcagcgtggccagcctgacccccaccgccgcccacagcggcagccacctgttcggcttcccccccaccccccccaaggaggtgagccccgaccccagcaccaccggcgccgccagccccgccagcagcagcgccggcggcagcgccgccagaggcgaggacaaggacggcgtgaagtaccaggtgagcctgaccgagagcatgaagatggagagcggcagccccctgagacccggcctggccaccatgggcacccagcccgccacccaccaccccatccccacctaccccagctacgtgcccgccgccgcccacgactacagcagcggcctgttccaccccggcggcttcctgggcggccccgccagcagcttcacccccaagcagagaagcaaggccagaagctgcagcgagggcagagagtgcgtgaactgcggcgccaccgccacccccctgtggagaagagacggcaccggccactacctgtgcaacgcctgcggcctgtaccacaagatgaacggccagaacagacccctgatcaagcccaagagaagactgaccaccaccaccaccctgtggagaagaaacgccaacggcgaccccgtgtgcaacgcctgcggcctgtactacaagctgcacaacgtgaacagacccctgaccatgaagaaggagggcatccagaccagaaacagaaagatgagcaacaagagcaagaagagcaagaagggcgccgagtgcttcgaggagctgagcaagtgcatgcaggagaagagcagccccttcagcgccgccgccctggccggccacatggcccccgtgggccacctgccccccttcagccacagcggccacatcctgcccacccccacccccatccaccccagcagcagcctgagcttcggccacccccaccccagcagcatggtgaccgccatgggctag

SEQ ID NO: 82800 - DNA, 1443 bp, Artificial Sequence; identical to SEQ ID NO: 82798
  Description of Artificial Sequence: Synthetic coding sequence

SEQ ID NO: 82801 - DNA, 453 bp, Artificial Sequence
  Description of Artificial Sequence: Synthetic coding sequence
atggaggtggcccccgagcagcccagatggatggcccaccccgccgtgctgaacgcccagcaccccgacagccaccaccccggcctggcccacaactacatggagcccgcccagctgctgccccccgacgaggtggacgtgttcttcaaccacctggacagccagggcaacccctactacgccaaccccgcccacgccagagccagagtgagctacagccccgcccacgccagactgaccggcggccagatgtgcagaccccacctgctgcacagccccggcctgccctggctggacggcggcaaggccgccctgagcgccgccgccgcccaccaccacaacccctggaccgtgagccccttcagcaagacccccctgcaccccagcgccgccggcggccccggcggccccctgagcgtgtaccccggcgccggcggcggcagcggcggctag

SEQ ID NO: 82802 - DNA, 27 bp, Artificial Sequence
  Description of Artificial Sequence: Synthetic coding sequence
atggaggtggcccccgagcagccctag

SEQ ID NO: 82803 - DNA, 1326 bp, Artificial Sequence
  Description of Artificial Sequence: Synthetic coding sequence
atgtaccagagcctgccctggccccccaccaccggcagaccccccgtgcccaccagaagagccgcccccgcccccagctgcaccgccagagcccccagacccagacagagcacctgcccccacagaggcgccctgctgagagccggccccgtgctgccccccggcagaagaagaggcctgtgcgtgagaagagccagcggcggcagcagcggcggcgccgccagcggcgccggccccggcacccagcagggcagccccggctggagccaggccggcgccgacggcgccgcctacacccccccccccgtgagccccagattcagcttccccggcaccaccggcagcctggccgccgccgccgccgccgccgccgccagagaggccgccgcctacagcagcggcggcggcgccgccggcgccggcctggccggcagagagcagtacggcagagccggcttcgccggcagctacagcagcccctaccccgcctacatggccgacgtgggcgccagctgggccgccgccgccgccgccagcgccggccccttcgacagccccgtgctgcacagcctgcccggcagagccaaccccgccgccagacaccccaacctggacatgttcgacgacttcagcgagggcagagagtgcgtgaactgcggcgccatgagcacccccctgtggagaagagacggcaccggccactacctgtgcaacgcctgcggcctgtaccacaagatgaacggcatcaacagacccctgatcaagccccagagaagactgagcgccagcagaagagtgggcctgagctgcgccaactgccagaccaccaccaccaccctgtggagaagaaacgccgagggcgagcccgtgtgcaacgcctgcggcctgtacatgaagctgcacggcgtgcccagacccctggccatgagaaaggagggcatccagaccagaaagagaaagcccaagaacctgaacaagagcaagacccccgccgcccccagcggcagcgagagcctgccccccgccagcggcgccagcagcaacagcagcaacgccaccaccagcagcagcgaggagatgagacccatcaagaccgagcccggcctgagcagccactacggccacagcagcagcgtgagccagaccttcagcgtgagcgccatgagcggccacggccccagcatccaccccgtgctgagcgccctgaagctgagcccccagggctacgccagccccgtgagccagagcccccagaccagcagcaagcaggacagctggaacagcctggtgctggccgacagccacggcgacatcatcaccgcctag

SEQ ID NO: 82804 - DNA, 1329 bp, Artificial Sequence
  Description of Artificial Sequence: Synthetic coding sequence
atgtaccagagcctggccatggccgccaaccacggccccccccccggcgcctacgaggccggcggccccggcgccttcatgcacggcgccggcgccgccagcagccccgtgtacgtgcccacccccagagtgcccagcagcgtgctgggcctgagctacctgcagggcggcggcgccggcagcgccagcggcggcgccagcggcggcagcagcggcggcgccgccagcggcgccggccccggcacccagcagggcagccccggctggagccaggccggcgccgacggcgccgcctacacccccccccccgtgagccccagattcagcttccccggcaccaccggcagcctggccgccgccgccgccgccgccgccgccagagaggccgccgcctacagcagcggcggcggcgccgccggcgccggcctggccggcagagagcagtacggcagagccggcttcgccggcagctacagcagcccctaccccgcctacatggccgacgtgggcgccagctgggccgccgccgccgccgccagcgccggccccttcgacagccccgtgctgcacagcctgcccggcagagccaaccccgccgccagacaccccaacctggacatgttcgacgacttcagcgagggcagagagtgcgtgaactgcggcgccatgagcacccccctgtggagaagagacggcaccggccactacctgtgcaacgcctgcggcctgtaccacaagatgaacggcatcaacagacccctgatcaagccccagagaagactgagcgccagcagaagagtgggcctgagctgcgccaactgccagaccaccaccaccaccctgtggagaagaaacgccgagggcgagcccgtgtgcaacgcctgcggcctgtacatgaagctgcacggcgtgcccagacccctggccatgagaaaggagggcatccagaccagaaagagaaagcccaagaacctgaacaagagcaagacccccgccgcccccagcggcagcgagagcctgccccccgccagcggcgccagcagcaacagcagcaacgccaccaccagcagcagcgaggagatgagacccatcaagaccgagcccggcctgagcagccactacggccacagcagcagcgtgagccagaccttcagcgtgagcgccatgagcggccacggccccagcatccaccccgtgctgagcgccctgaagctgagcccccagggctacgccagccccgtgagccagagcccccagaccagcagcaagcaggacagctggaacagcctggtgctggccgacagccacggcgacatcatcaccgcctag

SEQ ID NO: 82805 - DNA, 528 bp, Artificial Sequence
  Description of Artificial Sequence: Synthetic coding sequence
atgttcgacgacttcagcgagggcagagagtgcgtgaactgcggcgccatgagcacccccctgtggagaagagacggcaccggccactacctgtgcaacgcctgcggcctgtaccacaagatgaacggcatcaacagacccctgatcaagccccagagaagactgagcgccagcagaagagtgggcctgagctgcgccaactgccagaccaccaccaccaccctgtggagaagaaacgccgagggcgagcccgtgtgcaacgcctgcggcctgtacatgaagctgcacggcgtgcccagacccctggccatgagaaaggagggcatccagaccagaaagagaaagcccaagaacctgaacaagagcaagacccccgccgcccccagcggcagcgagagcctgccccccgccagcggcgccagcagcaacagcagcaacgccaccaccagcagcagcgaggagatgagacccatcaagaccgagcccggcctgagcagccactacggccacagcagcagcgtgagctag

SEQ ID NO: 82806 - DNA, 354 bp, Artificial Sequence
  Description of Artificial Sequence: Synthetic coding sequence
atgtaccagagcctggccatggccgccaaccacggccccccccccggcgcctacgaggccggcggccccggcgccttcatgcacggcgccggcgccgccagcagccccgtgtacgtgcccacccccagagtgcccagcagcgtgctgggcctgagctacctgcagggcggcggcgccggcagcgccagcggcggcgccagcggcggcagcagcggcggcgccgccagcggcgccggccccggcacccagcagggcagccccggctggagccaggccggcgccgacggcgccgcctacacccccccccccgtgagccccagattcagcttccccggcaccaccggcagcctgtag

SEQ ID NO: 82807 - DNA, 711 bp, Artificial Sequence
  Description of Artificial Sequence: Synthetic coding sequence
atgttcgacgacttcagcgagggcagagagtgcgtgaactgcggcgccatgagcacccccctgtggagaagagacggcaccggccactacctgtgcaacgcctgcggcctgtaccacaagatgaacggcatcaacagacccctgatcaagccccagagaagactgagcgccagcagaagagtgggcctgagctgcgccaactgccagaccaccaccaccaccctgtggagaagaaacgccgagggcgagcccgtgtgcaacgcctgcggcctgtacatgaagctgcacggcgtgcccagacccctggccatgagaaaggagggcatccagaccagaaagagaaagcccaagaacctgaacaagagcaagacccccgccgcccccagcggcagcgagagcctgccccccgccagcggcgccagcagcaacagcagcaacgccaccaccagcagcagcgaggagatgagacccatcaagaccgagcccggcctgagcagccactacggccacagcagcagcgtgagccagaccttcagcgtgagcgccatgagcggccacggccccagcatccaccccgtgctgagcgccctgaagctgagcccccagggctacgccagccccgtgagccagagcccccagaccagcagcaagcaggacagctggaacagcctggtgctggccgacagccacggcgacatcatcaccgcctag

SEQ ID NO: 82808 - DNA, 1332 bp, Artificial Sequence
  Description of Artificial Sequence: Synthetic coding sequence
atgtaccagagcctggccatggccgccaaccacggccccccccccggcgcctacgaggccggcggccccggcgccttcatgcacggcgccggcgccgccagcagccccgtgtacgtgcccacccccagagtgcccagcagcgtgctgggcctgagctacctgcagggcggcggcgccggcagcgccagcggcggcgccagcggcggcagcagcggcggcgccgccagcggcgccggccccggcacccagcagggcagccccggctggagccaggccggcgccgacggcgccgcctacacccccccccccgtgagccccagattcagcttccccggcaccaccggcagcctggccgccgccgccgccgccgccgccgccagagaggccgccgcctacagcagcggcggcggcgccgccggcgccggcctggccggcagagagcagtacggcagagccggcttcgccggcagctacagcagcccctaccccgcctacatggccgacgtgggcgccagctgggccgccgccgccgccgccagcgccggccccttcgacagccccgtgctgcacagcctgcccggcagagccaaccccgccgccagacaccccaacctggtggacatgttcgacgacttcagcgagggcagagagtgcgtgaactgcggcgccatgagcacccccctgtggagaagagacggcaccggccactacctgtgcaacgcctgcggcctgtaccacaagatgaacggcatcaacagacccctgatcaagccccagagaagactgagcgccagcagaagagtgggcctgagctgcgccaactgccagaccaccaccaccaccctgtggagaagaaacgccgagggcgagcccgtgtgcaacgcctgcggcctgtacatgaagctgcacggcgtgcccagacccctggccatgagaaaggagggcatccagaccagaaagagaaagcccaagaacctgaacaagagcaagacccccgccgcccccagcggcagcgagagcctgccccccgccagcggcgccagcagcaacagcagcaacgccaccaccagcagcagcgaggagatgagacccatcaagaccgagcccggcctgagcagccactacggccacagcagcagcgtgagccagaccttcagcgtgagcgccatgagcggccacggccccagcatccaccccgtgctgagcgccctgaagctgagcccccagggctacgccagccccgtgagccagagcccccagaccagcagcaagcaggacagctggaacagcctggtgctggccgacagccacggcgacatcatcaccgcctag

SEQ ID NO: 82809 - DNA, 1194 bp, Artificial Sequence
  Description of Artificial Sequence: Synthetic coding sequence
atgtaccagagcctggccctggccgccagccccagacaggccgcctacgccgacagcggcagcttcctgcacgcccccggcgccggcagccccatgttcgtgccccccgccagagtgcccagcatgctgagctacctgagcggctgcgagcccagcccccagccccccgagctggccgccagacccggctgggcccagaccgccaccgccgacagcagcgccttcggccccggcagcccccacccccccgccgcccacccccccggcgccaccgccttccccttcgcccacagccccagcggccccggcagcggcggcagcgccggcggcagagacggcagcgcctaccagggcgccctgctgcccagagagcagttcgccgcccccctgggcagacccgtgggcaccagctacagcgccacctaccccgcctacgtgagccccgacgtggcccagagctggaccgccggccccttcgacggcagcgtgctgcacggcctgcccggcagaagacccaccttcgtgagcgacttcctggaggagttccccggcgagggcagagagtgcgtgaactgcggcgccctgagcacccccctgtggagaagagacggcaccggccactacctgtgcaacgcctgcggcctgtaccacaagatgaacggcgtgaacagacccctggtgagaccccagaagagactgagcagcagcagaagagccggcctgtgctgcaccaactgccacaccaccaacaccaccctgtggagaagaaacagcgagggcgagcccgtgtgcaacgcctgcggcctgtacatgaagctgcacggcgtgcccagacccctggccatgaagaaggagagcatccagaccagaaagagaaagcccaagaccatcgccaaggccagaggcagcagcggcagcaccagaaacgccagcgccagccccagcgccgtggccagcaccgacagcagcgccgccaccagcaaggccaagcccagcctggccagccccgtgtgccccggccccagcatggccccccaggccagcggccaggaggacgacagcctggcccccggccacctggagttcaagttcgagcccgaggacttcgccttccccagcaccgcccccagcccccaggccggcctgagaggcgccctgagacaggaggcctggtgcgccctggccctggcctag

SEQ ID NO: 82810 - DNA, 1194 bp, Artificial Sequence; identical to SEQ ID NO: 82809
  Description of Artificial Sequence: Synthetic coding sequence

SEQ ID NO: 82811 - DNA, 1254 bp, Artificial Sequence
  Description of Artificial Sequence: Synthetic coding sequence
accgccaccgccgtgccctgcagacccccctgccccctggtgaagaccacccccggcagaatgtaccagagcctggccctggccgccagccccagacaggccgcctacgccgacagcggcagcttcctgcacgcccccggcgccggcagccccatgttcgtgccccccgccagagtgcccagcatgctgagctacctgagcggctgcgagcccagcccccagccccccgagctggccgccagacccggctgggcccagaccgccaccgccgacagcagcgccttcggccccggcagcccccacccccccgccgcccacccccccggcgccaccgccttccccttcgcccacagccccagcggccccggcagcggcggcagcgccggcggcagagacggcagcgcctaccagggcgccctgctgcccagagagcagttcgccgcccccctgggcagacccgtgggcaccagctacagcgccacctaccccgcctacgtgagccccgacgtggcccagagctggaccgccggccccttcgacggcagcgtgctgcacggcctgcccggcagaagacccaccttcgtgagcgacttcctggaggagttccccggcgagggcagagagtgcgtgaactgcggcgccctgagcacccccctgtggagaagagacggcaccggccactacctgtgcaacgcctgcggcctgtaccacaagatgaacggcgtgaacagacccctggtgagaccccagaagagactgagcagcagcagaagagccggcctgtgctgcaccaactgccacaccaccaacaccaccctgtggagaagaaacagcgagggcgagcccgtgtgcaacgcctgcggcctgtacatgaagctgcacggcgtgcccagacccctggccatgaagaaggagagcatccagaccagaaagagaaagcccaagaccatcgccaaggccagaggcagcagcggcagcaccagaaacgccagcgccagccccagcgccgtggccagcaccgacagcagcgccgccaccagcaaggccaagcccagcctggccagccccgtgtgccccggccccagcatggccccccaggccagcggccaggaggacgacagcctggcccccggccacctggagttcaagttcgagcccgaggacttcgccttccccagcaccgcccccagcccccaggccggcctgagaggcgccctgagacaggaggcctggtgcgccctggccctggcctag

SEQ ID NO: 82812 - DNA, 1788 bp, Artificial Sequence
  Description of Artificial Sequence: Synthetic coding sequence
atggccctgaccgacggcggctggtgcctgcccaagagattcggcgccgccggcgccgacgccagcgacagcagagccttccccgccagagagcccagcaccccccccagccccatcagcagcagcagcagcagctgcagcagaggcggcgagagaggccccggcggcgccagcaactgcggcaccccccagctggacaccgaggccgccgccggcccccccgccagaagcctgctgctgagcagctacgccagccaccccttcggcgccccccacggccccagcgcccccggcgtggccggccccggcggcaacctgagcagctgggaggacctgctgctgttcaccgacctggaccaggccgccaccgccagcaagctgctgtggagcagcagaggcgccaagctgagccccttcgcccccgagcagcccgaggagatgtaccagaccctggccgccctgagcagccagggccccgccgcctacgacggcgcccccggcggcttcgtgcacagcgccgccgccgccgccgccgccgccgccgccgccagcagccccgtgtacgtgcccaccaccagagtgggcagcatgctgcccggcctgccctaccacctgcagggcagcggcagcggccccgccaaccacgccggcggcgccggcgcccaccccggctggccccaggccagcgccgacagccccccctacggcagcggcggcggcgccgccggcggcggcgccgccggccccggcggcgccggcagcgccgccgcccacgtgagcgccagattcccctacagccccagcccccccatggccaacggcgccgccagagagcccggcggctacgccgccgccggcagcggcggcgccggcggcgtgagcggcggcggcagcagcctggccgccatgggcggcagagagccccagtacagcagcctgagcgccgccagacccctgaacggcacctaccaccaccaccaccaccaccaccaccaccaccccagcccctacagcccctacgtgggcgcccccctgacccccgcctggcccgccggccccttcgagacccccgtgctgcacagcctgcagagcagagccggcgcccccctgcccgtgcccagaggccccagcgccgacctgctggaggacctgagcgagagcagagagtgcgtgaactgcggcagcatccagacccccctgtggagaagagacggcaccggccactacctgtgcaacgcctgcggcctgtacagcaagatgaacggcctgagcagacccctgatcaagccccagaagagagtgcccagcagcagaagactgggcctgagctgcgccaactgccacaccaccaccaccaccctgtggagaagaaacgccgagggcgagcccgtgtgcaacgcctgcggcctgtacatgaagctgcacggcgtgcccagacccctggccatgaagaaggagggcatccagaccagaaagagaaagcccaagaacatcaacaagagcaagacctgcagcggcaacagcaacaacagcatccccatgacccccaccagcaccagcagcaacagcgacgactgcagcaagaacaccagccccaccacccagcccaccgccagcggcgccggcgcccccgtgatgaccggcgccggcgagagcaccaaccccgagaacagcgagctgaagtacagcggccaggacggcctgtacatcggcgtgagcctggccagccccgccgaggtgaccagcagcgtgagacccgacagctggtgcgccctggccctggcctag

SEQ ID NO: 82813 - DNA, 8016 bp, Artificial Sequence
  Description of Artificial Sequence: Synthetic coding sequence
atggccgccgacacccaggtgagcgagaccctgaagagattcgccggcaaggtgaccaccgccagcgtgaaggagagaagagagatcctgagcgagctgggcaagtgcgtggccggcaaggacctgcccgagggcgccgtgaagggcctgtgcaagctgttctgcctgaccctgcacagatacagagacgccgccagcagaagagccctgcaggccgccatccagcagctggccgaggcccagcccgaggccaccgccaagaacctgctgcacagcctgcagagcagcggcatcggcagcaaggccggcgtgcccagcaagagcagcggcagcgccgccctgctggccctgacctggacctgcctgctggtgagaatcgtgttccccagcagagccaagagacagggcgacatctggaacaagctggtggaggtgcagtgcctgctgctgctggaggtgctgggcggcagccacaagcacgccgtggacggcgccgtgaagaagctgaccaagctgtggaaggagaaccccggcctggtggagcagtacctgagcgccatcctgagcctggagcccaaccagaactacgccggcatgctgggcctgctggtgcagttctgcaccagccacaaggagatggacgtggtgagccagcacaagagcgccctgctggacttctacatgaagaacatcctgatgagcaaggtgaagccccccaagtacctgctggacagctgcgcccccctgctgagatacctgagccacagcgagttcaaggacctgatcctgcccaccatccagaagagcctgctgagaagccccgagaacgtgatcgagaccatcagcagcctgctggccagcgtgaccctggacctgagccagtacgccatggacatcgtgaagggcctggccggccacctgaagagcaacagccccagactgatggacgaggccgtgctggccctgagaaacctggccagacagtgcagcgacagcagcgccatggagagcctgaccaagcacctgttcgccatcctgggcggcagcgagggcaagctgaccgtggtggcccagaagatgagcgtgctgagcggcatcggcagcgtgagccaccacgtggtgagcggccccagcagccaggtgctgaacggcatcgtggccgagctgttcatccccttcctgcagcaggaggtgcacgagggcaccctggtgcacgccgtgagcgtgctggccctgtggtgcaacagattcaccatggaggtgcccaagaagctgaccgagtggttcaagaaggccttcagcctgaagaccagcaccagcgccgtgagacacgcctacctgcagtgcatgctggccagctacagaggcgacaccctgctgcaggccctggacctgctgcccctgctgatccagaccgtggagaaggccgccagccagagcacccaggtgcccaccatcaccgagggcgtggccgccgccctgctgctgctgaagctgagcgtggccgacagccaggccgaggccaagctgagcagcttctggcagctgatcgtggacgagaagaagcaggtgttcaccagcgagaagttcctggtgatggccagcgaggacgccctgtgcaccgtgctgcacctgaccgagagactgttcctggaccacccccacagactgaccggcaacaaggtgcagcagtaccacagagccctggtggccgtgctgctgagcagaacctggcacgtgagaagacaggcccagcagaccgtgagaaagctgctgagcagcctgggcggcttcaagctggcccacggcctgctggaggagctgaagaccgtgctgagcagccacaaggtgctgcccctggaggccctggtgaccgacgccggcgaggtgaccgaggccggcaaggcctacgtgccccccagagtgctgcaggaggccctgtgcgtgatcagcggcgtgcccggcctgaagggcgacgtgaccgacaccgagcagctggcccaggagatgctgatcatcagccaccaccccagcctggtggccgtgcagagcggcctgtggcccgccctgctggccagaatgaagatcgaccccgaggccttcatcaccagacacctggaccagatcatccccagaatgaccacccagagccccctgaaccagagcagcatgaacgccatgggcagcctgagcgtgctgagccccgacagagtgctgccccagctgatcagcaccatcaccgccagcgtgcagaaccccgccctgagactggtgaccagagaggagttcgccatcatgcagacccccgccggcgagctgtacgacaagagcatcatccagagcgcccagcaggacagcatcaagaaggccaacatgaagagagagaacaaggcctacagcttcaaggagcagatcatcgagctggagctgaaggaggagatcaagaagaagaagggcatcaaggaggaggtgcagctgaccagcaagcagaaggagatgctgcaggcccagctggacagagaggcccaggtgagaagaagactgcaggagctggacggcgagctggaggccgccctgggcctgctggacatcatcctggccaagaaccccagcggcctgacccagtacatccccgtgctggtggacagcttcctgcccctgctgaagagccccctggccgcccccagaatcaagaaccccttcctgagcctggccgcctgcgtgatgcccagcagactgaaggccctgggcaccctggtgagccacgtgaccctgagactgctgaagcccgagtgcgtgctggacaagagctggtgccaggaggagctgagcgtggccgtgaagagagccgtgatgctgctgcacacccacaccatcaccagcagagtgggcaagggcgagcccggcgccgcccccctgagcgcccccgccttcagcctggtgttccccttcctgaagatggtgctgaccgagatgccccaccacagcgaggaggaggaggagtggatggcccagatcctgcagatcctgaccgtgcaggcccagctgagagccagccccaacaccccccccggcagagtggacgagaacggccccgagctgctgcccagagtggccatgctgagactgctgacctgggtgatcggcaccggcagccccagactgcaggtgctggccagcgacaccctgaccaccctgtgcgccagcagcagcggcgacgacggctgcgccttcgccgagcaggaggaggtggacgtgctgctgtgcgccctgcagagcccctgcgccagcgtgagagagaccgtgctgagaggcctgatggagctgcacatggtgctgcccgcccccgacaccgacgagaagaacggcctgaacctgctgagaagactgtgggtggtgaagttcgacaaggaggaggagatcagaaagctggccgagagactgtggagcatgatgggcctggacctgcagcccgacctgtgcagcctgctgatcgacgacgtgatctaccacgaggccgccgtgagacaggccggcgccgaggccctgagccaggccgtggccagataccagagacaggccgccgaggtgatgggcagactgatggagatctaccaggagaagctgtacagacccccccccgtgctggacgccctgggcagagtgatcagcgagagcccccccgaccagtgggaggccagatgcggcctggccctggccctgaacaagctgagccagtacctggacagcagccaggtgaagcccctgttccagttcttcgtgcccgacgccctgaacgacagacaccccgacgtgagaaagtgcatgctggacgccgccctggccaccctgaacacccacggcaaggagaacgtgaacagcctgctgcccgtgttcgaggagttcctgaagaacgcccccaacgacgccagctacgacgccgtgagacagagcgtggtggtgctgatgggcagcctggccaagcacctggacaagagcgaccccaaggtgaagcccatcgtggccaagctgatcgccgccctgagcacccccagccagcaggtgcaggagagcgtggccagctgcctgccccccctggtgcccgccatcaaggaggacgccggcggcatgatccagagactgatgcagcagctgctggagagcgacaagtacgccgagagaaagggcgccgcctacggcctggccggcctggtgaagggcctgggcatcctgagcctgaagcagcaggagatgatggccgccctgaccgacgccatccaggacaagaagaacttcagaagaagagagggcgccctgttcgccttcgagatgctgtgcaccatgctgggcaagctgttcgagccctacgtggtgcacgtgctgccccacctgctgctgtgcttcggcgacggcaaccagtacgtgagagaggccgccgacgactgcgccaaggccgtgatgagcaacctgagcgcccacggcgtgaagctggtgctgcccagcctgctggccgccctggaggaggagagctggagaaccaaggccggcagcgtggagctgctgggcgccatggcctactgcgcccccaagcagctgagcagctgcctgcccaacatcgtgcccaagctgaccgaggtgctgaccgacagccacgtgaaggtgcagaaggccggccagcaggccctgagacagatcggcagcgtgatcagaaaccccgagatcctggccatcgcccccgtgctgctggacgccctgaccgaccccagcagaaagacccagaagtgcctgcagaccctgctggacaccaagttcgtgcacttcatcgacgcccccagcctggccctgatcatgcccatcgtgcagagagccttccaggacagaagcaccgacaccagaaagatggccgcccagatcatcggcaacatgtacagcctgaccgaccagaaggacctggccccctacctgcccagcgtgacccccggcctgaaggccagcctgctggaccccgtgcccgaggtgagaaccgtgagcgccaaggccctgggcgccatggtgaagggcatgggcgagagctgcttcgaggacctgctgccctggctgatggagaccctgacctacgagcagagcagcgtggacagaagcggcgccgcccagggcctggccgaggtgatggccggcctgggcgtggagaagctggagaagctgatgcccgagatcgtggccaccgccagcaaggtggacatcgccccccacgtgagagacggctacatcatgatgttcaactacctgcccatcaccttcggcgacaagttcaccccctacgtgggccccatcatcccctgcatcctgaaggccctggccgacgagaacgagttcgtgagagacaccgccctgagagccggccagagagtgatcagcatgtacgccgagaccgccatcgccctgctgctgccccagctggagcagggcctgttcgacgacctgtggagaatcagattcagcagcgtgcagctgctgggcgacctgctgttccacatcagcggcgtgaccggcaagatgaccaccgagaccgccagcgaggacgacaacttcggcaccgcccagagcaacaaggccatcatcaccgccctgggcgtggagagaagaaacagagtgctggccggcctgtacatgggcagaagcgacacccagctggtggtgagacaggccagcctgcacgtgtggaagatcgtggtgagcaacacccccagaaccctgagagagatcctgcccaccctgttcggcctgctgctgggcttcctggccagcacctgcgccgacaagagaaccatcgccgccagaaccctgggcgacctggtgagaaagctgggcgagaagatcctgcccgagatcatccccatcctggaggagggcctgagaagccagaagagcgacgagagacagggcgtgtgcatcggcctgagcgagatcatgaagagcaccagcagagacgccgtgctgtacttcagcgagagcctggtgcccaccgccagaaaggccctgtgcgaccccctggaggaggtgagagaggccgccgccaagaccttcgagcagctgcacagcaccatcggccaccaggccctggaggacatcctgcccttcctgctgaagcagctggacgacgaggaggtgagcgagttcgccctggacggcctgaagcaggtgatggccatcaagagcagagtggtgctgccctacctggtgcccaagctgaccaccccccccgtgaacaccagagtgctggccttcctgagcagcgtggccggcgacgccctgaccagacacctgggcgtgatcctgcccgccgtgatgctggccctgaaggagaagctgggcacccccgacgagcagctggagatggccaactgccaggccgtgatcctgagcgtggaggacgacaccggccacagaatcatcatcgagtacctgctggaggccaccagaagccccgaggtgggcatgagacaggccgccgccatcatcctgaacatctactgcagcagaagcaaggccgactacaccagccacctgagaagcctggtgagcggcctgatcagactgttcaacgacagcagccccgtggtgctggaggagagctgggacgccctgaacgccatcaccaagaagctggacgccggcaaccagctggccctgatcgaggagctgcacaaggagatcagactgatcggcaacgagagcaagggcgagcacgtgcccggcttctgcctgcccaagaagggcgtgaccagcatcctgcccgtgctgagagagggcgtgctgaccggcagccccgagcagaaggaggaggccgccaaggccctgggcctggtgatcagactgaccagcgccgacgccctgagacccagcgtggtgagcatcaccggccccctgatcagaatcctgggcgacagattcagctggaacgtgaaggccgccctgctggagaccctgagcctgctgctggccaaggtgggcatcgccctgaagcccttcctgccccagctgcagaccaccttcaccaaggccctgcaggacagcaacagaggcgtgagactgaaggccgccgacgccctgggcaagctgatcagcatccacatcaaggtggaccccctgttcaccgagctgctgaacggcatcagagccatggaggaccccggcgtgagagacaccatgctgcaggccctgagattcgtgatccagggcgccggcgccaaggtggacgccgtgatcagaaagaacatcgtgagcctgctgctgagcatgctgggccacgacgaggacaacaccagaatcagcagcgccggctgcctgggcgagctgtgcgccttcctgaccgaggaggagctgagcgccgtgctgcagcagtgcctgctggccgacgtgagcggcatcgactggatggtgagacacggcagaagcctggccctgagcgtggccgtgaacgtggcccccggcagactgtgcgccggcagatacagcagcgacgtgcaggagatgatcctgagcagcgccaccgccgacagaatccccatcgccgtgagcggcgtgagaggcatgggcttcctgatgagacaccacatcgagaccggcggcggccagctgcccgccaagctgagcagcctgttcgtgaagtgcctgcagaaccccagcagcgacatcagactggtggccgagaagatgatctggtgggccaacaaggaccccctgccccccctggacccccaggccatcaagcccatcctgaaggccctgctggacaacaccaaggacaagaacaccgtggtgagagcctacagcgaccaggccatcgtgaacctgctgaagatgagacagggcgaggaggtgttccagagcctgagcaagatcctggacgtggccagcctggaggtgctgaacgaggtgaacagaagaagcctgaagaagctggccagccaggccgacagcaccgagcaggtggacgacaccatcctgacctag

SEQ ID NO: 82814 - DNA, 1443 bp, Artificial Sequence
  Description of Artificial Sequence: Synthetic coding sequence
atggcccagcacgacttcgcccccgcctggctgaacttccccaccccccccagcagcaccaaggtgctgaccagcagcctgaagagcagcctgaacttcgagaagcacagcgagaacttcgcctggaccgagaacagatacgacgtgaacagaagaagacacaacagcagcgacggcttcgacagcgccatcggcagacccaacggcggcaacttcggcagaaaggagaagaacggctggagaacccacggcagaaacggcaccgagaacatcaaccacagaggcggctaccacggcggcagcagcagaagcagaagcagcatcttccacgccggcaagagccagggcctgcacgagaacaacatccccgacaacgagaccggcagaaaggaggacaagagagagagaaagcagttcgaggccgaggacttccccagcctgaaccccgagtacgagagagagcccaaccacaacaagagcctggccgccggcgtgtgggagtacccccccaaccccaagagcagagcccccagaatgctggtgatcaagaagggcaacaccaaggacctgcagctgagcggcttccccgtggtgggcaacctgcccagccagcccgtgaagaacggcaccggccccagcgtgtacaagggcctggtgcccaagcccgccgccccccccaccaagcccacccagtggaagagccagaccaaggagaacaaggtgggcaccagcttcccccacgagagcaccttcggcgtgggcaacttcaacgccttcaagagcaccgccaagaacttcagccccagcaccaacagcgtgaaggagtgcaacagaagcaacagcagcagccccgtggacaagctgaaccagcagcccagactgaccaagctgaccagaatgagaaccgacaagaagagcgagttcctgaaggccctgaagagagacagagtggaggaggagcacgaggacgagagcagagccggcagcgagaaggacgacgacagcttcaacctgcacaacagcaacagcacccaccaggagagagacatcaacagaaacttcgacgagaacgagatcccccaggagaacggcaacgccagcgtgatcagccagcagatcatcagaagcagcaccttcccccagaccgacgtgctgagcagcagcctggaggccgagcacagactgctgaaggagatgggctggcaggaggacagcgagaacgacgagacctgcgcccccctgaccgaggacgagatgagagagttccaggtgatcagcgagcagctgcagaagaacggcctgagaaagaacggcatcctgaagaacggcctgatctgcgacttcaagttcggcccctggaagaacagcaccttcaagcccaccaccgagaacgacgacaccgagaccagcagcagcgacaccagcgacgacgacgacgtgtag

SEQ ID NO: 82815 - DNA, 1482 bp, Artificial Sequence
  Description of Artificial Sequence: Synthetic coding sequence
atggcccagcacgacttcgcccccgcctggctgaacttccccaccccccccagcagcaccaagagcagcctgaacttcgagaagcacagcgagaacttcgcctggaccgagaacagatacgacgtgaacagaagaagacacaacagcagcgacggcttcgacagcgccatcggcagacccaacggcggcaacttcggcagaaaggagaagaacggctggagaacccacggcagaaacggcaccgagaacatcaaccacagaggcggctaccacggcggcagcagcagaagcagaagcagcatcttccacgccggcaagagccagggcctgcacgagaacaacatccccgacaacgagaccggcagaaaggaggacaagagagagagaaagcagttcgaggccgaggacttccccagcctgaaccccgagtacgagagagagcccaaccacaacaagagcctggccgccggcgtgtggggcctgcacgcccagacccacacctaccccaccaagaagatcagccaggcccccctgctggagtacccccccaaccccaagagcagagcccccagaatgctggtgatcaagaagggcaacaccaaggacctgcagctgagcggcttccccgtggtgggcaacctgcccagccagcccgtgaagaacggcaccggccccagcgtgtacaagggcctggtgcccaagcccgccgccccccccaccaagcccacccagtggaagagccagaccaaggagaacaaggtgggcaccagcttcccccacgagagcaccttcggcgtgggcaacttcaacgccttcaagagcaccgccaagaacttcagccccagcaccaacagcgtgaaggagtgcaacagaagcaacagcagcagccccgtggacaagctgaaccagcagcccagactgaccaagctgaccagaatgagaaccgacaagaagagcgagttcctgaaggccctgaagagagacagagtggaggaggagcacgaggacgagagcagagccggcagcgagaaggacgacgacagcttcaacctgcacaacagcaacagcacccaccaggagagagacatcaacagaaacttcgacgagaacgagatcccccaggagaacggcaacgccagcgtgatcagccagcagatcatcagaagcagcaccttcccccagaccgacgtgctgagcagcagcctggaggccgagcacagactgctgaaggagatgggctggcaggaggacagcgagaacgacgagacctgcgcccccctgaccgaggacgagatgagagagttccaggtgatcagcgagcagctgcagaagaacggcctgagaaagaacggcatcctgaagaacggcctgatctgcgacttcaagttcggcccctggaagaacagcaccttcaagcccaccaccgagaacgacgacaccgagaccagcagcagcgacaccagcgacgacgacgacgtgtag

SEQ ID NO: 82816 - DNA, 1482 bp, Artificial Sequence; identical to SEQ ID NO: 82815
  Description of Artificial Sequence: Synthetic coding sequence

SEQ ID NO: 82817 - DNA, 1422 bp, Artificial Sequence
  Description of Artificial Sequence: Synthetic coding sequence
atggcccagcacgacttcgcccccgcctggctgaacttccccaccccccccagcagcaccaagagcagcctgaacttcgagaagcacagcgagaacttcgcctggaccgagaacagatacgacgtgaacagaagaagacacaacagcagcgacggcttcgacagcgccatcggcagacccaacggcggcaacttcggcagaaaggagaagaacggctggagaacccacggcagaaacggcaccgagaacatcaaccacagaggcggctaccacggcggcagcagcagaagcagaagcagcatcttccacgccggcaagagccagggcctgcacgagaacaacatccccgacaacgagaccggcagaaaggaggacaagagagagagaaagcagttcgaggccgaggacttccccagcctgaaccccgagtacgagagagagcccaaccacaacaagagcctggccgccggcgtgtgggagtacccccccaaccccaagagcagagcccccagaatgctggtgatcaagaagggcaacaccaaggacctgcagctgagcggcttccccgtggtgggcaacctgcccagccagcccgtgaagaacggcaccggccccagcgtgtacaagggcctggtgcccaagcccgccgccccccccaccaagcccacccagtggaagagccagaccaaggagaacaaggtgggcaccagcttcccccacgagagcaccttcggcgtgggcaacttcaacgccttcaagagcaccgccaagaacttcagccccagcaccaacagcgtgaaggagtgcaacagaagcaacagcagcagccccgtggacaagctgaaccagcagcccagactgaccaagctgaccagaatgagaaccgacaagaagagcgagttcctgaaggccctgaagagagacagagtggaggaggagcacgaggacgagagcagagccggcagcgagaaggacgacgacagcttcaacctgcacaacagcaacagcacccaccaggagagagacatcaacagaaacttcgacgagaacgagatcccccaggagaacggcaacgccagcgtgatcagccagcagatcatcagaagcagcaccttcccccagaccgacgtgctgagcagcagcctggaggccgagcacagactgctgaaggagatgggctggcaggaggacagcgagaacgacgagacctgcgcccccctgaccgaggacgagatgagagagttccaggtgatcagcgagcagctgcagaagaacggcctgagaaagaacggcatcctgaagaacggcctgatctgcgacttcaagttcggcccctggaagaacagcaccttcaagcccaccaccgagaacgacgacaccgagaccagcagcagcgacaccagcgacgacgacgacgtgtag

SEQ ID NO: 82818 - DNA, 1398 bp, Artificial Sequence
  Description of Artificial Sequence: Synthetic coding sequence
atggcccagcacgacttcgcccccgcctggctgaacttccccaccccccccagcagcaccaaggtgctgaccagcagcctgaagagcagcctgaacttcgagaagcacagcgagaacttcgcctggaccgagaacagatacgacgtgaacagaagaagacacaacagcagcgacggcttcgacagcgccatcggcagacccaacggcggcaacttcggcagaaaggagaagaacggctggagaacccacggcagaaacggcaccgagaacatcaaccacagaggcggctaccacggcggcagcagcagaagcagaagcagcatcttccacgccggcaagagccagggcctgcacgagaacaacatccccgacaacgagaccggcagaaaggaggacaagagagagagaaagcagttcgaggccgaggacttccccagcctgaaccccgagtacgagagagagcccaaccacaacaagagcctggccgccggcgtgtgggagtacccccccaaccccaagagcagagcccccagaatgctggtgatcaagaagggcaacaccaaggacctgcagctgagcggcttccccgtggtgggcaacctgcccagccagcccgtgaagaacggcaccggccccagcgtgtacaagggcctggtgcccaagcccgccgccccccccaccaagcccacccagtggaagagccagaccaaggagaacaaggtgggcaccagcttcccccacgagagcaccttcggcgtgggcaacttcaacgccttcaagagcaccgccaagaacttcagccccagcaccaacagcgtgaaggagcagcccagactgaccaagctgaccagaatgagaaccgacaagaagagcgagttcctgaaggccctgaagagagacagagtggaggaggagcacgaggacgagagcagagccggcagcgagaaggacgacgacagcttcaacctgcacaacagcaacagcacccaccaggagagagacatcaacagaaacttcgacgagaacgagatcccccaggagaacggcaacgccagcgtgatcagccagcagatcatcagaagcagcaccttcccccagaccgacgtgctgagcagcagcctggaggccgagcacagactgctgaaggagatgggctggcaggaggacagcgagaacgacgagacctgcgcccccctgaccgaggacgagatgagagagttccaggtgatcagcgagcagctgcagaagaacggcctgagaaagaacggcatcctgaagaacggcctgatctgcgacttcaagttcggcccctggaagaacagcaccttcaagcccaccaccgagaacgacgacaccgagaccagcagcagcgacaccagcgacgacgacgacgtgtag

SEQ ID NO: 82819 - DNA, 909 bp, Artificial Sequence
  Description of Artificial Sequence: Synthetic coding sequence
atgctggtgatcaagaagggcaacaccaaggacctgcagctgagcggcttccccgtggtgggcaacctgcccagccagcccgtgaagaacggcaccggccccagcgtgtacaagggcctggtgcccaagcccgccgccccccccaccaagcccacccagtggaagagccagaccaaggagaacaaggtgggcaccagcttcccccacgagagcaccttcggcgtgggcaacttcaacgccttcaagagcaccgccaagaacttcagccccagcaccaacagcgtgaaggagtgcaacagaagcaacagcagcagccccgtggacaagctgaaccagcagcccagactgaccaagctgaccagaatgagaaccgacaagaagagcgagttcctgaaggccctgaagagagacagagtggaggaggagcacgaggacgagagcagagccggcagcgagaaggacgacgacagcttcaacctgcacaacagcaacagcacccaccaggagagagacatcaacagaaacttcgacgagaacgagatcccccaggagaacggcaacgccagcgtgatcagccagcagatcatcagaagcagcaccttcccccagaccgacgtgctgagcagcagcctggaggccgagcacagactgctgaaggagatgggctggcaggaggacagcgagaacgacgagacctgcgcccccctgaccgaggacgagatgagagagttccaggtgatcagcgagcagctgcagaagaacggcctgagaaagaacggcatcctgaagaacggcctgatctgcgacttcaagttcggcccctggaagaacagcaccttcaagcccaccaccgagaacgacgacaccgagaccagcagcagcgacaccagcgacgacgacgacgtgtag

SEQ ID NO: 82820 - DNA, 1443 bp, Artificial Sequence
  Description of Artificial Sequence: Synthetic coding sequence
atggcccagcacgacttcgcccccgcctggctgaacttccccaccccccccagcagcaccaaggtgctgagcaacaccctgaagagcagcctgaacttcgagaagcacagcgagaacttcgcctggaccgagaacagatacgacgtgaacagaagaagacacaacagcagcgacggcttcgacagcgccatcggcagacccaacggcggcaacttcggcagaaaggagaagaacggctggagaacccacggcagaaacggcaccgagaacatcaaccacagaggcggctaccacggcggcagcagcagaagcagaagcagcatcttccacgccggcaagagccagggcctgcacgagaacaacatccccgacaacgagaccggcagaaaggaggacaagagagagagaaagcagttcgaggccgaggacttccccagcctgaaccccgagtacgagagagagcccaaccacaacaagagcctggccgccggcgtgtgggagtacccccccaaccccaagagcagagcccccagaatgctggtgatcaagaagggcaacaccaaggacctgcagctgagcggcttccccgtggtgggcaacctgcccagccagcccgtgaagaacggcaccggccccagcgtgtacaagggcctggtgcccaagcccgccgccccccccaccaagcccacccagtggaagagccagaccaaggagaacaaggtgggcaccagcttcccccacgagagcaccttcggcgtgggcaacttcaacgccttcaagagcaccgccaagaacttcagccccagcaccaacagcgtgaaggagtgcaacagaagcaacagcagcagccccgtggacaagctgaaccagcagcccagactgaccaagctgaccagaatgagaaccgacaagaagagcgagttcctgaaggccctgaagagagacagagtggaggaggagcacgaggacgagagcagagccggcagcgagaaggacgacgacagcttcaacctgcacaacagcaacagcacccaccaggagagagacatcaacagaaacttcgacgagaacgagatcccccaggagaacggcaacgccagcgtgatcagccagcagatcatcagaagcagcaccttcccccagaccgacgtgctgagcagcagcctggaggccgagcacagactgctgaaggagatgggctggcaggaggacagcgagaacgacgagacctgcgcccccctgaccgaggacgagatgagagagttccaggtgatcagcgagcagctgcagaagaacggcctgagaaagaacggcatcctgaagaacggcctgatctgcgacttcaagttcggcccctggaagaacagcaccttcaagcccaccaccgagaacgacgacaccgagaccagcagcagcgacaccagcgacgacgacgacgtgtag

SEQ ID NO: 82821 - DNA, 1383 bp, Artificial Sequence
  Description of Artificial Sequence: Synthetic coding sequence
atgttcctggccaccctgtacttcgccctgcccctgctggacctgctgctgagcgccgaggtgagcggcggcgacagactggactgcgtgaaggccagcgaccagtgcctgaaggagcagagctgcagcaccaagtacagaaccctgagacagtgcgtggccggcaaggagaccaacttcagcctggccagcggcctggaggccaaggacgagtgcagaagcgccatggaggccctgaagcagaagagcctgtacaactgcagatgcaagagaggcatgaagaaggagaagaactgcctgagaatctactggagcatgtaccagagcctgcagggcaacgacctgctggaggacagcccctacgagcccgtgaacagcagactgagcgacatcttcagagtggtgcccttcatcagcgtggagcacatccccaagggcaacaactgcctggacgccgccaaggcctgcaacctggacgacatctgcaagaagtacagaagcgcctacatcaccccctgcaccaccagcgtgagcaacgacgtgtgcaacagaagaaagtgccacaaggccctgagacagttcttcgacaaggtgcccgccaagcacagctacggcatgctgttctgcagctgcagagacatcgcctgcaccgagagaagaagacagaccatcgtgcccgtgtgcagctacgaggagagagagaagcccaactgcctgaacctgcaggacagctgcaagaccaactacatctgcagaagcagactggccgacttcttcaccaactgccagcccgagagcagaagcgtgagcagctgcctgaaggagaactacgccgactgcctgctggcctacagcggcctgatcggcaccgtgatgacccccaactacatcgacagcagcagcctgagcgtggccccctggtgcgactgcagcaacagcggcaacgacctggaggagtgcctgaagttcctgaacttcttcaaggacaacacctgcctgaagaacgccatccaggccttcggcaacggcagcgacgtgaccgtgtggcagcccgccttccccgtgcagaccaccaccgccaccaccaccaccgccctgagagtgaagaacaagcccctgggccccgccggcagcgagaacgagatccccacccacgtgctgcccccctgcgccaacctgcaggcccagaagctgaagagcaacgtgagcggcaacacccacctgtgcatcagcaacggcaactacgagaaggagggcctgggcgccagcagccacatcaccaccaagagcatggccgccccccccagctgcggcctgagccccctgctggtgctggtggtgaccgccctgagcaccctgctgagcctgaccgagaccagctag

SEQ ID NO: 82822 - DNA, 1383 bp, Artificial Sequence; identical to SEQ ID NO: 82821
  Description of Artificial Sequence: Synthetic coding sequence

SEQ ID NO: 82823 - DNA, 1383 bp, Artificial Sequence; identical to SEQ ID NO: 82821
  Description of Artificial Sequence: Synthetic coding sequence

SEQ ID NO: 82824 - DNA, 1398 bp, Artificial Sequence
  Description of Artificial Sequence: Synthetic coding sequence
atgttcctggccaccctgtacttcgccctgcccctgctggacctgctgctgagcgccgaggtgagcggcggcgacagactggactgcgtgaaggccagcgaccagtgcctgaaggagcagagctgcagcaccaagtacagaaccctgagacagtgcgtggccggcaaggagaccaacttcagcctggccagcggcctggaggccaaggacgagtgcagaagcgccatggaggccctgaagcagaagagcctgtacaactgcagatgcaagagaggcatgaagaaggagaagaactgcctgagaatctactggagcatgtaccagagcctgcagggcaacgacctgctggaggacagcccctacgagcccgtgaacagcagactgagcgacatcttcagagtggtgcccttcatcagcgacgtgttccagcaggtggagcacatccccaagggcaacaactgcctggacgccgccaaggcctgcaacctggacgacatctgcaagaagtacagaagcgcctacatcaccccctgcaccaccagcgtgagcaacgacgtgtgcaacagaagaaagtgccacaaggccctgagacagttcttcgacaaggtgcccgccaagcacagctacggcatgctgttctgcagctgcagagacatcgcctgcaccgagagaagaagacagaccatcgtgcccgtgtgcagctacgaggagagagagaagcccaactgcctgaacctgcaggacagctgcaagaccaactacatctgcagaagcagactggccgacttcttcaccaactgccagcccgagagcagaagcgtgagcagctgcctgaaggagaactacgccgactgcctgctggcctacagcggcctgatcggcaccgtgatgacccccaactacatcgacagcagcagcctgagcgtggccccctggtgcgactgcagcaacagcggcaacgacctggaggagtgcctgaagttcctgaacttcttcaaggacaacacctgcctgaagaacgccatccaggccttcggcaacggcagcgacgtgaccgtgtggcagcccgccttccccgtgcagaccaccaccgccaccaccaccaccgccctgagagtgaagaacaagcccctgggccccgccggcagcgagaacgagatccccacccacgtgctgcccccctgcgccaacctgcaggcccagaagctgaagagcaacgtgagcggcaacacccacctgtgcatcagcaacggcaactacgagaaggagggcctgggcgccagcagccacatcaccaccaagagcatggccgccccccccagctgcggcctgagccccctgctggtgctggtggtgaccgccctgagcaccctgctgagcctgaccgagaccagctag

SEQ ID NO: 82825 - DNA, 1035 bp, Artificial Sequence
  Description of Artificial Sequence: Synthetic coding sequence
atgcaggagggcaagttctggaagggcatggccgagaccggcatgtggggctgcggcgagtggatccccgtggagcacatccccaagggcaacaactgcctggacgccgccaaggcctgcaacctggacgacatctgcaagaagtacagaagcgcctacatcaccccctgcaccaccagcgtgagcaacgacgtgtgcaacagaagaaagtgccacaaggccctgagacagttcttcgacaaggtgcccgccaagcacagctacggcatgctgttctgcagctgcagagacatcgcctgcaccgagagaagaagacagaccatcgtgcccgtgtgcagctacgaggagagagagaagcccaactgcctgaacctgcaggacagctgcaagaccaactacatctgcagaagcagactggccgacttcttcaccaactgccagcccgagagcagaagcgtgagcagctgcctgaaggagaactacgccgactgcctgctggcctacagcggcctgatcggcaccgtgatgacccccaactacatcgacagcagcagcctgagcgtggccccctggtgcgactgcagcaacagcggcaacgacctggaggagtgcctgaagttcctgaacttcttcaaggacaacacctgcctgaagaacgccatccaggccttcggcaacggcagcgacgtgaccgtgtggcagcccgccttccccgtgcagaccaccaccgccaccaccaccaccgccctgagagtgaagaacaagcccctgggccccgccggcagcgagaacgagatccccacccacgtgctgcccccctgcgccaacctgcaggcccagaagctgaagagcaacgtgagcggcaacacccacctgtgcatcagcaacggcaactacgagaaggagggcctgggcgccagcagccacatcaccaccaagagcatggccgccccccccagctgcggcctgagccccctgctggtgctggtggtgaccgccctgagcaccctgctgagcctgaccgagaccagctag

SEQ ID NO: 82826 - DNA, 1080 bp, Artificial Sequence
  Description of Artificial Sequence: Synthetic coding sequence
atgatcctggccaacgtgttctgcctgttcttcttcctgggcgaggagttctacgaggccagcccctacgagcccgtgaccagcagactgagcgacatcttcagactggccagcatcttcagcggcaccggcgccgaccccgtggtgagcgccaagagcaaccactgcctggacgccgccaaggcctgcaacctgaacgacaactgcaagaagctgagaagcagctacatcagcatctgcaacagagagatcagccccaccgagagatgcaacagaagaaagtgccacaaggccctgagacagttcttcgacagagtgcccagcgagtacacctacagaatgctgttctgcagctgccaggaccaggcctgcgccgagagaagaagacagaccatcctgcccagctgcagctacgaggacaaggagaagcccaactgcctggacctgagaggcgtgtgcagaaccgaccacctgtgcagaagcagactggccgacttccacgccaactgcagagccagctaccagaccgtgaccagctgccccgccgacaactaccaggcctgcctgggcagctacgccggcatgatcggcttcgacatgacccccaactacgtggacagcagccccaccggcatcgtggtgagcccctggtgcagctgcagaggcagcggcaacatggaggaggagtgcgagaagttcctgagagacttcaccgagaacccctgcctgagaaacgccatccaggccttcggcaacggcaccgacgtgaacgtgagccccaagggccccagcttccaggccacccaggcccccagagtggagaagacccccagcctgcccgacgacctgagcgacagcaccagcctgggcaccagcgtgatcaccacctgcaccagcgtgcaggagcagggcctgaaggccaacaacagcaaggagctgagcatgtgcttcaccgagctgaccaccaacatcatccccggcagcaacaaggtgatcaagcccaacagcggccccagcagagccagacccagcgccgccctgaccgtgctgagcgtgctgatgctgaagctggccctgtag

SEQ ID NO: 82827 - DNA, 1395 bp, Artificial Sequence
  Description of Artificial Sequence: Synthetic coding sequence
atgatcctggccaacgtgttctgcctgttcttcttcctggacgagaccctgagaagcctggccagccccagcagcctgcagggccccgagctgcacggctggagaccccccgtggactgcgtgagagccaacgagctgtgcgccgccgagagcaactgcagcagcagatacagaaccctgagacagtgcctggccggcagagacagaaacaccatgctggccaacaaggagtgccaggccgccctggaggtgctgcaggagagccccctgtacgactgcagatgcaagagaggcatgaagaaggagctgcagtgcctgcagatctactggagcatccacctgggcctgaccgagggcgaggagttctacgaggccagcccctacgagcccgtgaccagcagactgagcgacatcttcagactggccagcatcttcagcggcaccggcgccgaccccgtggtgagcgccaagagcaaccactgcctggacgccgccaaggcctgcaacctgaacgacaactgcaagaagctgagaagcagctacatcagcatctgcaacagagagatcagccccaccgagagatgcaacagaagaaagtgccacaaggccctgagacagttcttcgacagagtgcccagcgagtacacctacagaatgctgttctgcagctgccaggaccaggcctgcgccgagagaagaagacagaccatcctgcccagctgcagctacgaggacaaggagaagcccaactgcctggacctgagaggcgtgtgcagaaccgaccacctgtgcagaagcagactggccgacttccacgccaactgcagagccagctaccagaccgtgaccagctgccccgccgacaactaccaggcctgcctgggcagctacgccggcatgatcggcttcgacatgacccccaactacgtggacagcagccccaccggcatcgtggtgagcccctggtgcagctgcagaggcagcggcaacatggaggaggagtgcgagaagttcctgagagacttcaccgagaacccctgcctgagaaacgccatccaggccttcggcaacggcaccgacgtgaacgtgagccccaagggccccagcttccaggccacccaggcccccagagtggagaagacccccagcctgcccgacgacctgagcgacagcaccagcctgggcaccagcgtgatcaccacctgcaccagcgtgcaggagcagggcctgaaggccaacaacagcaaggagctgagcatgtgcttcaccgagctgaccaccaacatcatccccggcagcaacaaggtgatcaagcccaacagcggccccagcagagccagacccagcgccgccctgaccgtgctgagcgtgctgatgctgaagctggccctgtag

SEQ ID NO: 82828 - DNA, 996 bp, Artificial Sequence
  Description of Artificial Sequence: Synthetic coding sequence
atgatcctggccaacgtgttctgcctgttcttcttcctgggcaccggcgccgaccccgtggtgagcgccaagagcaaccactgcctggacgccgccaaggcctgcaacctgaacgacaactgcaagaagctgagaagcagctacatcagcatctgcaacagagagatcagccccaccgagagatgcaacagaagaaagtgccacaaggccctgagacagttcttcgacagagtgcccagcgagtacacctacagaatgctgttctgcagctgccaggaccaggcctgcgccgagagaagaagacagaccatcctgcccagctgcagctacgaggacaaggagaagcccaactgcctggacctgagaggcgtgtgcagaaccgaccacctgtgcagaagcagactggccgacttccacgccaactgcagagccagctaccagaccgtgaccagctgccccgccgacaactaccaggcctgcctgggcagctacgccggcatgatcggcttcgacatgacccccaactacgtggacagcagccccaccggcatcgtggtgagcccctggtgcagctgcagaggcagcggcaacatggaggaggagtgcgagaagttcctgagagacttcaccgagaacccctgcctgagaaacgccatccaggccttcggcaacggcaccgacgtgaacgtgagccccaagggccccagcttccaggccacccaggcccccagagtggagaagacccccagcctgcccgacgacctgagcgacagcaccagcctgggcaccagcgtgatcaccacctgcaccagcgtgcaggagcagggcctgaaggccaacaacagcaaggagctgagcatgtgcttcaccgagctgaccaccaacatcatccccggcagcaacaaggtgatcaagcccaacagcggccccagcagagccagacccagcgccgccctgaccgtgctgagcgtgctgatgctgaagctggccctgtag

SEQ ID NO: 82829 - DNA, 798 bp, Artificial Sequence
  Description of Artificial Sequence: Synthetic coding sequence
atgatcctggccaacgtgttctgcctgttcttcttcctggacgagaccctgagaagcctggccagccccagcagcctgcagggccccgagctgcacggctggagaccccccgtggactgcgtgagagccaacgagctgtgcgccgccgagagcaactgcagcagcagatacagaaccctgagacagtgcctggccggcagagacagaaacaccatgctggccaacaaggagtgccaggccgccctggaggtgctgcaggagagccccctgtacgactgcagatgcaagagaggcatgaagaaggagctgcagtgcctgcagatctactggagcatccacctgggcctgaccgagggcgaggagttctacgaggccagcccctacgagcccgtgaccagcagactgagcgacatcttcagactggccagcatcttcagcggcaccggcgccgaccccgtggtgagcgccaagagcaaccactgcctggacgccgccaaggcctgcaacctgaacgacaactgcaagaagctgagaagcagctacatcagcatctgcaacagagagatcagccccaccgagagatgcaacagaagaaagtgccacaaggccctgagacagttcttcgacagagtgcccagcgagtacacctacagaatgctgttctgcagctgccaggaccaggcctgcgccgagagaagaagacagaccatcctgcccagctgcagctacgaggacaaggagaagcccaactgcctggacctgagaggcgtgtgcagaaccgaccacctgtgcagatag

SEQ ID NO: 82830 - DNA, 1395 bp, Artificial Sequence; identical to SEQ ID NO: 82827
  Description of Artificial Sequence: Synthetic coding sequence

SEQ ID NO: 82831 - DNA, 1203 bp, Artificial Sequence
  Description of Artificial Sequence: Synthetic coding sequence
atggtgagacccctgaaccccagacccctgccccccgtggtgctgatgctgctgctgctgctgccccccagccccctgcccctggccgccggcgaccccctgcccaccgagagcagactgatgaacagctgcctgcaggccagaagaaagtgccaggccgaccccacctgcagcgccgcctaccaccacctggacagctgcaccagcagcatcagcacccccctgcccagcgaggagcccagcgtgcccgccgactgcctggaggccgcccagcagctgagaaacagcagcctgatcggctgcatgtgccacagaagaatgaagaaccaggtggcctgcctggacatctactggaccgtgcacagagccagaagcctgggcaactacgagctggacgtgagcccctacgaggacaccgtgaccagcaagccctggaagatgaacctgagcaagctgaacatgctgaagcccgacagcgacctgtgcctgaagttcgccatgctgtgcaccctgaacgacaagtgcgacagactgagaaaggcctacggcgaggcctgcagcggcccccactgccagagacacgtgtgcctgagacagctgctgaccttcttcgagaaggccgccgagccccacgcccagggcctgctgctgtgcccctgcgcccccaacgacagaggctgcggcgagagaagaagaaacaccatcgcccccaactgcgccctgccccccgtggcccccaactgcctggagctgagaagactgtgcttcagcgaccccctgtgcagaagcagactggtggacttccagacccactgccaccccatggacatcctgggcacctgcgccaccgagcagagcagatgcctgagagcctacctgggcctgatcggcaccgccatgacccccaacttcgtgagcaacgtgaacaccagcgtggccctgagctgcacctgcagaggcagcggcaacctgcaggaggagtgcgagatgctggagggcttcttcagccacaacccctgcctgaccgaggccatcgccgccaagatgagattccacagccagctgttcagccaggactggccccaccccaccttcgccgtgatggcccaccagaacgagaaccccgccgtgagaccccagccctgggtgcccagcctgttcagctgcaccctgcccctgatcctgctgctgagcctgtggtag

SEQ ID NO: 82832 - DNA, 1110 bp, Artificial Sequence
  Description of Artificial Sequence: Synthetic coding sequence
atggtgagacccctgaaccccagacccctgccccccgtggtgctgatgctgctgctgctgctgccccccagccccctgcccctggccgccggcgaccccctgcccaccgagagcagactgatgaacagctgcctgcaggccagaagaaagtgccaggccgaccccacctgcagcgccgcctaccaccacctggacagctgcaccagcagcatcagcacccccctgcccagcgaggagcccagcgtgcccgccgactgcctggaggccgcccagcagctgagaaacagcagcctgatcggctgcatgtgccacagaagaatgaagaaccaggtggcctgcctggacatctactggaccgtgcacagagccagaagcctggacagcgacctgtgcctgaagttcgccatgctgtgcaccctgaacgacaagtgcgacagactgagaaaggcctacggcgaggcctgcagcggcccccactgccagagacacgtgtgcctgagacagctgctgaccttcttcgagaaggccgccgagccccacgcccagggcctgctgctgtgcccctgcgcccccaacgacagaggctgcggcgagagaagaagaaacaccatcgcccccaactgcgccctgccccccgtggcccccaactgcctggagctgagaagactgtgcttcagcgaccccctgtgcagaagcagactggtggacttccagacccactgccaccccatggacatcctgggcacctgcgccaccgagcagagcagatgcctgagagcctacctgggcctgatcggcaccgccatgacccccaacttcgtgagcaacgtgaacaccagcgtggccctgagctgcacctgcagaggcagcggcaacctgcaggaggagtgcgagatgctggagggcttcttcagccacaacccctgcctgaccgaggccatcgccgccaagatgagattccacagccagctgttcagccaggactggccccaccccaccttcgccgtgatggcccaccagaacgagaaccccgccgtgagaccccagccctgggtgcccagcctgttcagctgcaccctgcccctgatcctgctgctgagcctgtggtag

SEQ ID NO: 82833 - DNA, 2136 bp, Artificial Sequence
  Description of Artificial Sequence: Synthetic coding sequence
atggagagcggcgccgtgctgctggagagcaagagcagccccttcaacctgctgcacgagatgcacgagctgagactgctgggccacctgtgcgacgtgaccgtgagcgtggagtaccagggcgtgagaaaggacttcatggcccacaaggccgtgctggccgccaccagcaagttcttcaaggaggtgttcctgaacgagaagagcgtggacggcaccagaaccaacgtgtacctgaacgaggtgcaggtggccgacttcgccagcttcctggagttcgtgtacaccgccaaggtgcaggtggaggaggacagagtgcagagaatgctggaggtggccgagaagctgaagtgcctggacctgagcgagacctgcttccagctgaagaagcagatgctggagagcgtgctgctggagctgcagaacttcagcgagagccaggaggtggaggtgagcagcggcagccaggtgagcgccgcccccgcccccagagccagcgtggccaccgacggcccccaccccagcggcctgaccgacagcctggactaccccggcgagagagccagcaacggcatgagcagcgacctgccccccaagaagagcaaggacaagctggacaagaagaaggaggtggtgaagcccccctaccccaagatcagaagagccagcggcagactggccggcagaaaggtgttcgtggagatccccaagaagaagtacaccagaagactgagagagcagcagaagaccgccgagggcgacgtgggcgactacagatgcccccaggaccagagccccgacagagtgggcaccgagatggagcaggtgagcaagaacgagggctgccaggccggcgccgagctggaggagctgagcaagaaggccggccccgaggaggaggaggaggaggaggaggaggacgaggagggcgagaagaagaagagcaacttcaagtgcagcatctgcgagaaggccttcctgtacgagaagagcttcctgaagcacagcaagcacagacacggcgtggccaccgaggtggtgtacagatgcgacacctgcggccagaccttcgccaacagatgcaacctgaagagccaccagagacacgtgcacagcagcgagagacacttcccctgcgagctgtgcggcaagaagttcaagagaaagaaggacgtgaagagacacgtgctgcaggtgcacgagggcggcggcgagagacacagatgcggccagtgcggcaagggcctgagcagcaagaccgccctgagactgcacgagagaacccacaccggcgacagaccctacggctgcaccgagtgcggcgccagattcagccagcccagcgccctgaagacccacatgagaatccacaccggcgagaagcccttcgtgtgcgacgagtgcggcgccagattcacccagaaccacatgctgatctaccacaagagatgccacaccggcgagagacccttcatgtgcgagacctgcggcaagagcttcgccagcaaggagtacctgaagcaccacaacagaatccacaccggcagcaagcccttcaagtgcgaggtgtgcttcagaaccttcgcccagagaaacagcctgtaccagcacatcaaggtgcacaccggcgagagaccctactgctgcgaccagtgcggcaagcagttcacccagctgaacgccctgcagagacacagaagaatccacaccggcgagagacccttcatgtgcaacgcctgcggcagaaccttcaccgacaagagcaccctgagaagacacaccagcatccacgacaagaacaccccctggaagagcttcctggtgatcgtggacggcagccccaagaacgacgacggccacaagaccgagcagcccgacgaggagtacgtgagcagcaagctgagcgacaagctgctgagcttcgccgagaacggccacttccacaacctggccgccgtgcaggacaccgtgcccaccatgcaggagaacagcagcgccgacaccgcctgcaaggccgacgacagcgtggtgagccaggacaccctgctggccaccaccatcagcgagctgagcgagctgaccccccagaccgacagcatgcccacccagctgcacagcctgagcaacatggagtag

SEQ ID NO: 82834 - DNA, 2136 bp, Artificial Sequence; identical to SEQ ID NO: 82833
  Description of Artificial Sequence: Synthetic coding sequence

SEQ ID NO: 82835 - DNA, 147 bp, Artificial Sequence
  Description of Artificial Sequence: Synthetic coding sequence
atggagagcggcgccgtgctgctggagagcaagagcagccccttcaacctgctgcacgagatgcacgagctgagactgctgggccacctgtgcgacgtgaccgtgagcgtggagtaccagggcgtgagaaaggacttcatggcctag

SEQ ID NO: 82836 - DNA, 663 bp, Artificial Sequence
  Description of Artificial Sequence: Synthetic coding sequence
atgtgcgagacctgcggcaagagcttcgccagcaaggagtacctgaagcaccacaacagaatccacaccggcagcaagcccttcaagtgcgaggtgtgcttcagaaccttcgcccagagaaacagcctgtaccagcacatcaaggtgcacaccggcgagagaccctactgctgcgaccagtgcggcaagcagttcacccagctgaacgccctgcagagacacagaagaatccacaccggcgagagacccttcatgtgcaacgcctgcggcagaaccttcaccgacaagagcaccctgagaagacacaccagcatccacgacaagaacaccccctggaagagcttcctggtgatcgtggacggcagccccaagaacgacgacggccacaagaccgagcagcccgacgaggagtacgtgagcagcaagctgagcgacaagctgctgagcttcgccgagaacggccacttccacaacctggccgccgtgcaggacaccgtgcccaccatgcaggagaacagcagcgccgacaccgcctgcaaggccgacgacagcgtggtgagccaggacaccctgctggccaccaccatcagcgagctgagcgagctgaccccccagaccgacagcatgcccacccagctgcacagcctgagcaacatggagtag

SEQ ID NO: 82837 - DNA, 708 bp, Artificial Sequence
  Description of Artificial Sequence: Synthetic coding sequence
atgctgatctaccacaagagatgccacaccggcgagagacccttcatgtgcgagacctgcggcaagagcttcgccagcaaggagtacctgaagcaccacaacagaatccacaccggcagcaagcccttcaagtgcgaggtgtgcttcagaaccttcgcccagagaaacagcctgtaccagcacatcaaggtgcacaccggcgagagaccctactgctgcgaccagtgcggcaagcagttcacccagctgaacgccctgcagagacacagaagaatccacaccggcgagagacccttcatgtgcaacgcctgcggcagaaccttcaccgacaagagcaccctgagaagacacaccagcatccacgacaagaacaccccctggaagagcttcctggtgatcgtggacggcagccccaagaacgacgacggccacaagaccgagcagcccgacgaggagtacgtgagcagcaagctgagcgacaagctgctgagcttcgccgagaacggccacttccacaacctggccgccgtgcaggacaccgtgcccaccatgcaggagaacagcagcgccgacaccgcctgcaaggccgacgacagcgtggtgagccaggacaccctgctggccaccaccatcagcgagctgagcgagctgaccccccagaccgacagcatgcccacccagctgcacagcctgagcaacatggagtag

SEQ ID NO: 82838 - DNA, 1254 bp, Artificial Sequence
  Description of Artificial Sequence: Synthetic coding sequence
atggacgaggagtacgacgtgatcgtgctgggcaccggcctgaccgagtgcatcctgagcggcatcatgagcgtgaacggcaagaaggtgctgcacatggacagaaacccctactacggcggcgagagcagcagcatcacccccctggaggagctgtacaagagattccagctgctggagggcccccccgagagcatgggcagaggcagagactggaacgtggacctgatccccaagttcctgatggccaacggccagctggtgaagatgctgctgtacaccgaggtgaccagatacctggacttcaaggtggtggagggcagcttcgtgtacaagggcggcaagatctacaaggtgcccagcaccgagaccgaggccctggccagcaacctgatgggcatgttcgagaacgaccccaagaccttcgagggcgtggacccccagaccaccagcatgagagacgtgtacagaaagttcgacctgggccaggacgtgatcgacttcaccggccacgccctggccctgtacagaaccgacgactacctggaccagccctgcctggagaccgtgaacagaatcaagctgtacagcgagagcctggccagatacggcaagagcccctacctgtaccccctgtacggcctgggcgagctgccccagggcttcgccagactgagcgccatctacggcggcacctacatgctgaacaagcccgtggacgacatcatcatggagaacggcaaggtggtgggcgtgaagagcgagggcgaggtggccagatgcaagcagctgatctgcgaccccagctacatccccgacagagtgagaaaggccggccaggtgatcagaatcatctgcatcctgagccaccccatcaagaacaccaacgacgccaacagctgccagatcatcatcccccagaaccaggtgaacagaaagagcgacatctacgtgtgcatgatcagctacgcccacaacgtggccgcccagggcaagtacatcgccatcgccagcaccaccgtggagaccaccgaccccgagaaggaggtggagcccgccctggagctgctggagcccatcgacgacggctgcgagagccaggtgttctgcagctgcagctacgacgccaccacccacttcgagaccacctgcaacgacatcaaggacatctacaagagaatggccggcaccgccttcgacttcgagaacatgaagagaaagcagaacgacgtgttcggcgaggccgagcagtag

SEQ ID NO: 82839 - DNA, 1344 bp, Artificial Sequence
  Description of Artificial Sequence: Synthetic coding sequence
atggacgaggagtacgacgtgatcgtgctgggcaccggcctgaccgagtgcatcctgagcggcatcatgagcgtgaacggcaagaaggtgctgcacatggacagaaacccctactacggcggcgagagcagcagcatcacccccctggaggagctgtacaagagattccagctgctggagggcccccccgagagcatgggcagaggcagagactggaacgtggacctgatccccaagttcctgatggccaacggccagctggtgaagatgctgctgtacaccgaggtgaccagatacctggacttcaaggtggtggagggcagcttcgtgtacaagggcggcaagatctacaaggtgcccagcaccgagaccgaggccctggccagcaacctgatgggcatgttcgagaagagaagattcagaaagttcctggtgttcgtggccaacttcgacgagaacgaccccaagaccttcgagggcgtggacccccagaccaccagcatgagagacgtgtacagaaagttcgacctgggccaggacgtgatcgacttcaccggccacgccctggccctgtacagaaccgacgactacctggaccagccctgcctggagaccgtgaacagaatcaagctgtacagcgagagcctggccagatacggcaagagcccctacctgtaccccctgtacggcctgggcgagctgccccagggcttcgccagactgagcgccatctacggcggcacctacatgctgaacaagcccgtggacgacatcatcatggagaacggcaaggtggtgggcgtgaagagcgagggcgaggtggccagatgcaagcagctgatctgcgaccccagctacatccccgacagagtgagaaaggccggccaggtgatcagaatcatctgcatcctgagccaccccatcaagaacaccaacgacgccaacagctgccagatcatcatcccccagaaccaggtgaacagaaagagcgacatctacgtgtgcatgatcagctacgcccacaacgtggccgcccagggcaagtacatcgccatcgccagcaccaccgtggagaccaccgaccccgagaaggaggtggagcccgccctggagctgctggagcccatcgaccagaagttcgtggccatcagcgacctgtacgagcccatcgacgacggctgcgagagccaggtgttctgcagctgcagctacgacgccaccacccacttcgagaccacctgcaacgacatcaaggacatctacaagagaatggccggcaccgccttcgacttcgagaacatgaagagaaagcagaacgacgtgttcggcgaggccgagcagtag

SEQ ID NO: 82840 - DNA, 447 bp, Artificial Sequence
  Description of Artificial Sequence: Synthetic coding sequence
atgagcctgggcaagagaaagcccagcaacttctacctggccaacttcctgggcaaggagtgcatcctgagcggcatcatgagcgtgaacggcaagaaggtgctgcacatggacagaaacccctactacggcggcgagagcgccagcatcacccccctggaggacctgtacaagagattcaagatccccggcagcccccccgagagcatgggcagaggcagagactggaacgtggacctgatccccaagttcctgatggccaacggccagctggtgaagatgctgctgtacaccgaggtgaccagatacctggacttcaaggtgaccgagggcagcttcgtgtacaagggcggcaagatctacaaggtgcccagcaccgaggccgaggccctggccagcagcctgatgggcctgttcgagaagagaagattcagaaagttcctgtag

SEQ ID NO: 82841 - DNA, 1350 bp, Artificial Sequence
  Description of Artificial Sequence: Synthetic coding sequence
atgagcctgggcaagagaaagcccagcaacttctacctggccaacttcctgggcaaggagtgcatcctgagcggcatcatgagcgtgaacggcaagaaggtgctgcacatggacagaaacccctactacggcggcgagagcgccagcatcacccccctggaggacctgtacaagagattcaagatccccggcagcccccccgagagcatgggcagaggcagagactggaacgtggacctgatccccaagttcctgatggccaacggccagctggtgaagatgctgctgtacaccgaggtgaccagatacctggacttcaaggtgaccgagggcagcttcgtgtacaagggcggcaagatctacaaggtgcccagcaccgaggccgaggccctggccagcagcctgatgggcctgttcgagaagagaagattcagaaagttcctggtgtacgtggccaacttcgacgagaaggaccccagaaccttcgagggcatcgaccccaagaagaccaccatgagagacgtgtacaagaagttcgacctgggccaggacgtgatcgacttcaccggccacgccctggccctgtacagaaccgacgactacctggaccagccctgctacgagaccatcaacagaatcaagctgtacagcgagagcctggccagatacggcaagagcccctacctgtaccccctgtacggcctgggcgagctgccccagggcttcgccagactgagcgccatctacggcggcacctacatgctgaacaagcccatcgaggagatcatcgtgcagaacggcaaggtgatcggcgtgaagagcgagggcgagatcgccagatgcaagcagctgatctgcgaccccagctacgtgaaggacagagtggagaaggtgggccaggtgatcagagtgatctgcatcctgagccaccccatcaagaacaccaacgacgccaacagctgccagatcatcatcccccagaaccaggtgaacagaaagagcgacatctacgtgtgcatgatcagcttcgcccacaacgtggccgcccagggcaagtacatcgccatcgtgagcaccaccgtggagaccaaggagcccgagaaggagatcagacccgccctggagctgctggagcccatcgagcagaagttcgtgagcatcagcgacctgctggtgcccaaggacctgggcaccgagagccagatcttcatcagcagaacctacgacgccaccacccacttcgagaccacctgcgacgacatcaagaacatctacaagagaatgaccggcagcgagttcgacttcgaggagatgaagagaaagaagaacgacatctacggcgaggactag

SEQ ID NO: 82842 - DNA, 627 bp, Artificial Sequence
  Description of Artificial Sequence: Synthetic coding sequence
atgagagacgtgtacaagaagttcgacctgggccaggacgtgatcgacttcaccggccacgccctggccctgtacagaaccgacgactacctggaccagccctgctacgagaccatcaacagaatcaagctgtacagcgagagcctggccagatacggcaagagcccctacctgtaccccctgtacggcctgggcgagctgccccagggcttcgccagactgagcgccatctacggcggcacctacatgctgaacaagcccatcgaggagatcatcgtgcagaacggcaaggtgatcggcgtgaagagcgagggcgagatcgccagatgcaagcagctgatctgcgaccccagctacgtgaaggacagagtggagaaggtgggccaggtgatcagagtgatctgcatcctgagccaccccatcaagaacaccaacgacgccaacagctgccagatcatcatcccccagaaccaggtgaacagaaagagcgacctgctggccagcgtgaccagctggtaccagaagacctgggagcagaaggccagaagcctgttccccgcccacatgatgccccccctgatcctgagacagagagtgatgaccctgaagaccagcatcagaggctag

SEQ ID NO: 82843 - DNA, 1203 bp, Artificial Sequence
  Description of Artificial Sequence: Synthetic coding sequence
atgaacgaggagtacgacgtgatcgtgctgggcaccggcctgaccgagtgcatcctgagcggcatcatgagcgtgaacggcaagaaggtgctgcacatggacagaaacccctactacggcggcgagagcgccagcatcacccccctggaggacctgtacaagagattcaagatccccggcagcccccccgagagcatgggcagaggcagagactggaacgtggacctgatccccaagttcctgatggccaacggcctgatgggcctgttcgagaagagaagattcagaaagttcctggtgtacgtggccaacttcgacgagaaggaccccagaaccttcgagggcatcgaccccaagaagaccaccatgagagacgtgtacaagaagttcgacctgggccaggacgtgatcgacttcaccggccacgccctggccctgtacagaaccgacgactacctggaccagccctgctacgagaccatcaacagaatcaagctgtacagcgagagcctggccagatacggcaagagcccctacctgtaccccctgtacggcctgggcgagctgccccagggcttcgccagactgagcgccatctacggcggcacctacatgctgaacaagcccatcgaggagatcatcgtgcagaacggcaaggtgatcggcgtgaagagcgagggcgagatcgccagatgcaagcagctgatctgcgaccccagctacgtgaaggacagagtggagaaggtgggccaggtgatcagagtgatctgcatcctgagccaccccatcaagaacaccaacgacgccaacagctgccagatcatcatcccccagaaccaggtgaacagaaagagcgacatctacgtgtgcatgatcagcttcgcccacaacgtggccgcccagggcaagtacatcgccatcgtgagcaccaccgtggagaccaaggagcccgagaaggagatcagacccgccctggagctgctggagcccatcgagcagaagttcgtgagcatcagcgacctgctggtgcccaaggacctgggcaccgagagccagatcttcatcagcagaacctacgacgccaccacccacttcgagaccacctgcgacgacatcaagaacatctacaagagaatgaccggcagcgagttcgacttcgaggagatgaagagaaagaagaacgacatctacggcgaggactag

SEQ ID NO: 82844 - DNA, 1338 bp, Artificial Sequence
  Description of Artificial Sequence: Synthetic coding sequence
atgaacgaggagtacgacgtgatcgtgctgggcaccggcctgaccgagtgcatcctgagcggcatcatgagcgtgaacggcaagaaggtgctgcacatggacagaaacccctactacggcggcgagagcgccagcatcacccccctggaggacctgtacaagagattcaagatccccggcagcccccccgagagcatgggcagaggcagagactggaacgtggacctgatccccaagttcctgatggccaacggccagctggtgaagatgctgctgtacaccgaggtgaccagatacctggacttcaaggtgaccgagggcagcttcgtgtacaagggcggcaagatctacaaggtgcccagcaccgaggccgaggccctggccagcagcctgatgggcctgttcgagaagagaagattcagaaagttcctggtgtacgtggccaacttcgacgagaaggaccccagaaccttcgagggcatcgaccccaagaagaccaccatgagagacgtgtacaagaagttcgacctgggccaggacgtgatcgacttcaccggccacgccctggccctgtacagaaccgacgactacctggaccagccctgctacgagaccatcaacagaatcaagctgtacagcgagagcctggccagatacggcaagagcccctacctgtaccccctgtacggcctgggcgagctgccccagggcttcgccagactgagcgccatctacggcggcacctacatgctgaacaagcccatcgaggagatcatcgtgcagaacggcaaggtgatcggcgtgaagagcgagggcgagatcgccagatgcaagcagctgatctgcgaccccagctacgtgaaggacagagtggagaaggtgggccaggtgatcagagtgatctgcatcctgagccaccccatcaagaacaccaacgacgccaacagctgccagatcatcatcccccagaaccaggtgaacagaaagagcgacatctacgtgtgcatgatcagcttcgcccacaacgtggccgcccagggcaagtacatcgccatcgtgagcaccaccgtggagaccaaggagcccgagaaggagatcagacccgccctggagctgctggagcccatcgagcagaagttcgtgagcatcagcgacctgctggtgcccaaggacctgggcaccgagagccagatcttcatcagcagaacctacgacgccaccacccacttcgagaccacctgcgacgacatcaagaacatctacaagagaatgaccggcagcgagttcgacttcgaggagatgaagagaaagaagaacgacatctacggcgaggactag

SEQ ID NO: 82845 - DNA, 468 bp, Artificial Sequence
  Description of Artificial Sequence: Synthetic coding sequence
atgaacgaggagtacgacgtgatcgtgctgggcaccggcctgaccctgtacaagagattcaagatccccggcagcccccccgagagcatgggcagaggcagagactggaacgtggacctgatccccaagttcctgatggccaacggccagctggtgaagatgctgctgtacaccgaggtgaccagatacctggacttcaaggtgaccgagggcagcttcgtgtacaagggcggcaagatctacaaggtgcccagcaccgaggccgaggccctggccagcagcctgatgggcctgttcgagaagagaagattcagaaagttcctggtgtacgtggccaacttcgacgagaaggaccccagaaccttcgagggcatcgaccccaagaagaccaccatgagagacgtgtacaagaagttcgacctgggccaggacgtgatcgacttcaccggccacgccctggccctgtag

SEQ ID NO: 82846 - DNA, 612 bp, Artificial Sequence
  Description of Artificial Sequence: Synthetic coding sequence
aagaagttcgacctgggccaggacgtgatcgacttcaccggccacgccctggccctgtacagaaccgacgactacctggaccagccctgctacgagaccatcaacagaatcaagctgtacagcgagagcctggccagatacggcaagagcccctacctgtaccccctgtacggcctgggcgagctgccccagggcttcgccagactgagcgccatctacggcggcacctacatgctgaacaagcccatcgaggagatcatcgtgcagaacggcaaggtgatcggcgtgaagagcgagggcgagatcgccagatgcaagcagctgatctgcgaccccagctacgtgaaggacagagtggagaaggtgggccaggtgatcagagtgatctgcatcctgagccaccccatcaagaacaccaacgacgccaacagctgccagatcatcatcccccagaaccaggtgaacagaaagagcgacctgctggccagcgtgaccagctggtaccagaagacctgggagcagaaggccagaagcctgttccccgcccacatgatgccccccctgatcctgagacagagagtgatgaccctgaagaccagcatcagaggctag

SEQ ID NO: 82847 - DNA, 792 bp, Artificial Sequence
  Description of Artificial Sequence: Synthetic coding sequence
atgaacgaggagtacgacgtgatcgtgctgggcaccggcctgaccgagtgcatcctgagcggcatcatgagcgtgaacggcaagaaggtgctgcacatggacagaaacccctactacggcggcgagagcgccagcatcacccccctggaggacctgtacaagagattcaagatccccggcagcccccccgagagcatgggcagaggcagagactggaacgtggacctgatccccaagttcctgatggccaacgaggtgaccagatacctggacttcaaggtgaccgagggcagcttcgtgtacaagggcggcaagatctacaaggtgcccagcaccgaggccgaggccctggccagcagcctgatgggcctgttcgagaagagaagattcagaaagttcctggtgtacgtggccaacttcgacgagaaggaccccagaaccttcgagggcatcgaccccaagaagaccaccatgagagacgtgtacaagaagttcgacctgggccaggacgtgatcgacttcaccggccacgccctggccctgtacagaaccgacgactacctggaccagccctgctacgagaccatcaacagaatcaagctgtacagcgagagcctggccagatacggcaagagcccctacctgtaccccctgtacggcctgggcgagctgccccagggcttcgccagactgagcgccatctacggcggcacctacatgctgaacaagcccatcgaggagatcatcgtgcagaacggcaaggtgatcggcgtgaagagcgagggcgagtag

SEQ ID NO: 82848 - DNA, 1119 bp, Artificial Sequence
  Description of Artificial Sequence: Synthetic coding sequence
atggcccacgcccccgccagatgccccagcgccagaggcagcggcgacggcgagatgggcaagcccagaaacgtggccctgatcaccggcatcaccggccaggacggcagctacctggccgagttcctgctggagaagggctacgaggtgcacggcatcgtgagaagaagcagcagcttcaacaccggcagaatcgagcacctgtacaagaacccccaggcccacatcgagggcaacatgaagctgcactacggcgacctgaccgacagcacctgcctggtgaagatcatcaacgaggtgaagcccaccgagatctacaacctgggcgcccagagccacgtgaagatcagcttcgacctggccgagtacaccgccgacgtggacggcgtgggcaccctgagactgctggacgccgtgaagacctgcggcctgatcaacagcgtgaagttctaccaggccagcaccagcgagctgtacggcaaggtgcaggagatcccccagaaggagaccacccccttctaccccagaagcccctacggcgccgccaagctgtacgcctactggatcgtggtgaacttcagagaggcctacaacctgttcgccgtgaacggcatcctgttcaaccacgagagccccagaagaggcgccaacttcgtgaccagaaagatcagcagaagcgtggccaagatctacctgggccagctggagtgcttcagcctgggcaacctggacgccaagagagactggggccacgccaaggactacgtggaggccatgtggctgatgctgcagaacgacgagcccgaggacttcgtgatcgccaccggcgaggtgcacagcgtgagagagttcgtggagaagagcttcctgcacatcggcaagaccatcgtgtgggagggcaagaacgagaacgaggtgggcagatgcaaggagaccggcaaggtgcacgtgaccgtggacctgaagtactacagacccaccgaggtggacttcctgcagggcgactgcaccaaggccaagcagaagctgaactggaagcccagagtggccttcgacgagctggtgagagagatggtgcacgccgacgtggagctgatgagaaccaaccccaacgcctag

SEQ ID NO: 82849 - DNA, 1029 bp, Artificial Sequence
  Description of Artificial Sequence: Synthetic coding sequence
atgtgcaagatggacggcagctacctggccgagttcctgctggagaagggctacgaggtgcacggcatcgtgagaagaagcagcagcttcaacaccggcagaatcgagcacctgtacaagaacccccaggcccacatcgagggcaacatgaagctgcactacggcgacctgaccgacagcacctgcctggtgaagatcatcaacgaggtgaagcccaccgagatctacaacctgggcgcccagagccacgtgaagatcagcttcgacctggccgagtacaccgccgacgtggacggcgtgggcaccctgagactgctggacgccgtgaagacctgcggcctgatcaacagcgtgaagttctaccaggccagcaccagcgagctgtacggcaaggtgcaggagatcccccagaaggagaccacccccttctaccccagaagcccctacggcgccgccaagctgtacgcctactggatcgtggtgaacttcagagaggcctacaacctgttcgccgtgaacggcatcctgttcaaccacgagagccccagaagaggcgccaacttcgtgaccagaaagatcagcagaagcgtggccaagatctacctgggccagctggagtgcttcagcctgggcaacctggacgccaagagagactggggccacgccaaggactacgtggaggccatgtggctgatgctgcagaacgacgagcccgaggacttcgtgatcgccaccggcgaggtgcacagcgtgagagagttcgtggagaagagcttcctgcacatcggcaagaccatcgtgtgggagggcaagaacgagaacgaggtgggcagatgcaaggagaccggcaaggtgcacgtgaccgtggacctgaagtactacagacccaccgaggtggacttcctgcagggcgactgcaccaaggccaagcagaagctgaactggaagcccagagtggccttcgacgagctggtgagagagatggtgcacgccgacgtggagctgatgagaaccaaccccaacgcctag

SEQ ID NO: 82850 - DNA, 2196 bp, Artificial Sequence
  Description of Artificial Sequence: Synthetic coding sequence
atggtggtggagcaccccgagttcctgaaggccggcaaggagcccggcctgcagatctggagagtggagaagttcgacctggtgcccgtgcccaccaacctgtacggcgacttcttcaccggcgacgcctacgtgatcctgaagaccgtgcagctgagaaacggcaacctgcagtacgacctgcactactggctgggcaacgagtgcagccaggacgagagcggcgccgccgccatcttcaccgtgcagctggacgactacctgaacggcagagccgtgcagcacagagaggtgcagggcttcgagagcgccaccttcctgggctacttcaagagcggcctgaagtacaagaagggcggcgtggccagcggcttcaagcacgtggtgcccaacgaggtggtggtgcagagactgttccaggtgaagggcagaagagtggtgagagccaccgaggtgcccgtgagctgggagagcttcaacaacggcgactgcttcatcctggacctgggcaacaacatccaccagtggtgcggcagcaacagcaacagatacgagagactgaaggccacccaggtgagcaagggcatcagagacaacgagagaagcggcagagccagagtgcacgtgagcgaggagggcaccgagcccgaggccatgctgcaggtgctgggccccaagcccgccctgcccgccggcaccgaggacaccgccaaggaggacgccgccaacagaaagctggccaagctgtacaaggtgagcaacggcgccggcaccatgagcgtgagcctggtggccgacgagaaccccttcgcccagggcgccctgaagagcgaggactgcttcatcctggaccacggcaaggacggcaagatcttcgtgtggaagggcaagcaggccaacaccgaggagagaaaggccgccctgaagaccgccagcgacttcatcaccaagatggactaccccaagcagacccaggtgagcgtgctgcccgagggcggcgagacccccctgttcaagcagttcttcaagaactggagagaccccgaccagaccgacggcctgggcctgagctacctgagcagccacatcgccaacgtggagagagtgcccttcgacgccgccaccctgcacaccagcaccgccatggccgcccagcacggcatggacgacgacggcaccggccagaagcagatctggagaatcgagggcagcaacaaggtgcccgtggaccccgccacctacggccagttctacggcggcgacagctacatcatcctgtacaactacagacacggcggcagacagggccagatcatctacaactggcagggcgcccagagcacccaggacgaggtggccgccagcgccatcctgaccgcccagctggacgaggagctgggcggcacccccgtgcagagcagagtggtgcagggcaaggagcccgcccacctgatgagcctgttcggcggcaagcccatgatcatctacaagggcggcaccagcagagagggcggccagaccgcccccgccagcaccagactgttccaggtgagagccaacagcgccggcgccaccagagccgtggaggtgctgcccaaggccggcgccctgaacagcaacgacgccttcgtgctgaagacccccagcgccgcctacctgtgggtgggcaccggcgccagcgaggccgagaagaccggcgcccaggagctgctgagagtgctgagagcccagcccgtgcaggtggccgagggcagcgagcccgacggcttctgggaggccctgggcggcaaggccgcctacagaaccagccccagactgaaggacaagaagatggacgcccacccccccagactgttcgcctgcagcaacaagatcggcagattcgtgatcgaggaggtgcccggcgagctgatgcaggaggacctggccaccgacgacgtgatgctgctggacacctgggaccaggtgttcgtgtgggtgggcaaggacagccaggaggaggagaagaccgaggccctgaccagcgccaagagatacatcgagaccgaccccgccaacagagacagaagaacccccatcaccgtggtgaagcagggcttcgagccccccagcttcgtgggctggttcctgggctgggacgacgactactggagcgtggaccccctggacagagccatggccgagctggccgcctag

SEQ ID NO: 82851 - DNA, 2196 bp, Artificial Sequence; identical to SEQ ID NO: 82850
  Description of Artificial Sequence: Synthetic coding sequence

SEQ ID NO: 82852 - DNA, 2349 bp, Artificial Sequence
  Description of Artificial Sequence: Synthetic coding sequence
atggccccccacagacccgcccccgccctgctgtgcgccctgagcctggccctgtgcgccctgagcctgcccgtgagagccgccaccgccagcagaggcgccagccaggccggcgccccccagggcagagtgcccgaggccagacccaacagcatggtggtggagcaccccgagttcctgaaggccggcaaggagcccggcctgcagatctggagagtggagaagttcgacctggtgcccgtgcccaccaacctgtacggcgacttcttcaccggcgacgcctacgtgatcctgaagaccgtgcagctgagaaacggcaacctgcagtacgacctgcactactggctgggcaacgagtgcagccaggacgagagcggcgccgccgccatcttcaccgtgcagctggacgactacctgaacggcagagccgtgcagcacagagaggtgcagggcttcgagagcgccaccttcctgggctacttcaagagcggcctgaagtacaagaagggcggcgtggccagcggcttcaagcacgtggtgcccaacgaggtggtggtgcagagactgttccaggtgaagggcagaagagtggtgagagccaccgaggtgcccgtgagctgggagagcttcaacaacggcgactgcttcatcctggacctgggcaacaacatccaccagtggtgcggcagcaacagcaacagatacgagagactgaaggccacccaggtgagcaagggcatcagagacaacgagagaagcggcagagccagagtgcacgtgagcgaggagggcaccgagcccgaggccatgctgcaggtgctgggccccaagcccgccctgcccgccggcaccgaggacaccgccaaggaggacgccgccaacagaaagctggccaagctgtacaaggtgagcaacggcgccggcaccatgagcgtgagcctggtggccgacgagaaccccttcgcccagggcgccctgaagagcgaggactgcttcatcctggaccacggcaaggacggcaagatcttcgtgtggaagggcaagcaggccaacaccgaggagagaaaggccgccctgaagaccgccagcgacttcatcaccaagatggactaccccaagcagacccaggtgagcgtgctgcccgagggcggcgagacccccctgttcaagcagttcttcaagaactggagagaccccgaccagaccgacggcctgggcctgagctacctgagcagccacatcgccaacgtggagagagtgcccttcgacgccgccaccctgcacaccagcaccgccatggccgcccagcacggcatggacgacgacggcaccggccagaagcagatctggagaatcgagggcagcaacaaggtgcccgtggaccccgccacctacggccagttctacggcggcgacagctacatcatcctgtacaactacagacacggcggcagacagggccagatcatctacaactggcagggcgcccagagcacccaggacgaggtggccgccagcgccatcctgaccgcccagctggacgaggagctgggcggcacccccgtgcagagcagagtggtgcagggcaaggagcccgcccacctgatgagcctgttcggcggcaagcccatgatcatctacaagggcggcaccagcagagagggcggccagaccgcccccgccagcaccagactgttccaggtgagagccaacagcgccggcgccaccagagccgtggaggtgctgcccaaggccggcgccctgaacagcaacgacgccttcgtgctgaagacccccagcgccgcctacctgtgggtgggcaccggcgccagcgaggccgagaagaccggcgcccaggagctgctgagagtgctgagagcccagcccgtgcaggtggccgagggcagcgagcccgacggcttctgggaggccctgggcggcaaggccgcctacagaaccagccccagactgaaggacaagaagatggacgcccacccccccagactgttcgcctgcagcaacaagatcggcagattcgtgatcgaggaggtgcccggcgagctgatgcaggaggacctggccaccgacgacgtgatgctgctggacacctgggaccaggtgttcgtgtgggtgggcaaggacagccaggaggaggagaagaccgaggccctgaccagcgccaagagatacatcgagaccgaccccgccaacagagacagaagaacccccatcaccgtggtgaagcagggcttcgagccccccagcttcgtgggctggttcctgggctgggacgacgactactggagcgtggaccccctggacagagccatggccgagctggccgcctag

SEQ ID NO: 82853 - DNA, 2196 bp, Artificial Sequence; identical to SEQ ID NO: 82850
  Description of Artificial Sequence: Synthetic coding sequence

SEQ ID NO: 82854 - DNA, 2148 bp, Artificial Sequence
  Description of Artificial Sequence: Synthetic coding sequence
atggtggtggagcaccccgagttcctgaaggccggcaaggagcccggcctgcagatctggagagtggagaagttcgacgcctacgtgatcctgaagaccgtgcagctgagaaacggcaacctgcagtacgacctgcactactggctgggcaacgagtgcagccaggacgagagcggcgccgccgccatcttcaccgtgcagctggacgactacctgaacggcagagccgtgcagcacagagaggtgcagggcttcgagagcgccaccttcctgggctacttcaagagcggcctgaagtacaagaagggcggcgtggccagcggcttcaagcacgtggtgcccaacgaggtggtggtgcagagactgttccaggtgaagggcagaagagtggtgagagccaccgaggtgcccgtgagctgggagagcttcaacaacggcgactgcttcatcctggacctgggcaacaacatccaccagtggtgcggcagcaacagcaacagatacgagagactgaaggccacccaggtgagcaagggcatcagagacaacgagagaagcggcagagccagagtgcacgtgagcgaggagggcaccgagcccgaggccatgctgcaggtgctgggccccaagcccgccctgcccgccggcaccgaggacaccgccaaggaggacgccgccaacagaaagctggccaagctgtacaaggtgagcaacggcgccggcaccatgagcgtgagcctggtggccgacgagaaccccttcgcccagggcgccctgaagagcgaggactgcttcatcctggaccacggcaaggacggcaagatcttcgtgtggaagggcaagcaggccaacaccgaggagagaaaggccgccctgaagaccgccagcgacttcatcaccaagatggactaccccaagcagacccaggtgagcgtgctgcccgagggcggcgagacccccctgttcaagcagttcttcaagaactggagagaccccgaccagaccgacggcctgggcctgagctacctgagcagccacatcgccaacgtggagagagtgcccttcgacgccgccaccctgcacaccagcaccgccatggccgcccagcacggcatggacgacgacggcaccggccagaagcagatctggagaatcgagggcagcaacaaggtgcccgtggaccccgccacctacggccagttctacggcggcgacagctacatcatcctgtacaactacagacacggcggcagacagggccagatcatctacaactggcagggcgcccagagcacccaggacgaggtggccgccagcgccatcctgaccgcccagctggacgaggagctgggcggcacccccgtgcagagcagagtggtgcagggcaaggagcccgcccacctgatgagcctgttcggcggcaagcccatgatcatctacaagggcggcaccagcagagagggcggccagaccgcccccgccagcaccagactgttccaggtgagagccaacagcgccggcgccaccagagccgtggaggtgctgcccaaggccggcgccctgaacagcaacgacgccttcgtgctgaagacccccagcgccgcctacctgtgggtgggcaccggcgccagcgaggccgagaagaccggcgcccaggagctgctgagagtgctgagagcccagcccgtgcaggtggccgagggcagcgagcccgacggcttctgggaggccctgggcggcaaggccgcctacagaaccagccccagactgaaggacaagaagatggacgcccacccccccagactgttcgcctgcagcaacaagatcggcagattcgtgatcgaggaggtgcccggcgagctgatgcaggaggacctggccaccgacgacgtgatgctgctggacacctgggaccaggtgttcgtgtgggtgggcaaggacagccaggaggaggagaagaccgaggccctgaccagcgccaagagatacatcgagaccgaccccgccaacagagacagaagaacccccatcaccgtggtgaagcagggcttcgagccccccagcttcgtgggctggttcctgggctgggacgacgactactggagcgtggaccccctggacagagccatggccgagctggccgcctag

SEQ ID NO: 82855 - DNA, 2229 bp, Artificial Sequence
  Description of Artificial Sequence: Synthetic coding sequence
atggagaagctgttctgctgcttccccaacagcatggtggtggagcaccccgagttcctgaaggccggcaaggagcccggcctgcagatctggagagtggagaagttcgacctggtgcccgtgcccaccaacctgtacggcgacttcttcaccggcgacgcctacgtgatcctgaagaccgtgcagctgagaaacggcaacctgcagtacgacctgcactactggctgggcaacgagtgcagccaggacgagagcggcgccgccgccatcttcaccgtgcagctggacgactacctgaacggcagagccgtgcagcacagagaggtgcagggcttcgagagcgccaccttcctgggctacttcaagagcggcctgaagtacaagaagggcggcgtggccagcggcttcaagcacgtggtgcccaacgaggtggtggtgcagagactgttccaggtgaagggcagaagagtggtgagagccaccgaggtgcccgtgagctgggagagcttcaacaacggcgactgcttcatcctggacctgggcaacaacatccaccagtggtgcggcagcaacagcaacagatacgagagactgaaggccacccaggtgagcaagggcatcagagacaacgagagaagcggcagagccagagtgcacgtgagcgaggagggcaccgagcccgaggccatgctgcaggtgctgggccccaagcccgccctgcccgccggcaccgaggacaccgccaaggaggacgccgccaacagaaagctggccaagctgtacaaggtgagcaacggcgccggcaccatgagcgtgagcctggtggccgacgagaaccccttcgcccagggcgccctgaagagcgaggactgcttcatcctggaccacggcaaggacggcaagatcttcgtgtggaagggcaagcaggccaacaccgaggagagaaaggccgccctgaagaccgccagcgacttcatcaccaagatggactaccccaagcagacccaggtgagcgtgctgcccgagggcggcgagacccccctgttcaagcagttcttcaagaactggagagaccccgaccagaccgacggcctgggcctgagctacctgagcagccacatcgccaacgtggagagagtgcccttcgacgccgccaccctgcacaccagcaccgccatggccgcccagcacggcatggacgacgacggcaccggccagaagcagatctggagaatcgagggcagcaacaaggtgcccgtggaccccgccacctacggccagttctacggcggcgacagctacatcatcctgtacaactacagacacggcggcagacagggccagatcatctacaactggcagggcgcccagagcacccaggacgaggtggccgccagcgccatcctgaccgcccagctggacgaggagctgggcggcacccccgtgcagagcagagtggtgcagggcaaggagcccgcccacctgatgagcctgttcggcggcaagcccatgatcatctacaagggcggcaccagcagagagggcggccagaccgcccccgccagcaccagactgttccaggtgagagccaacagcgccggcgccaccagagccgtggaggtgctgcccaaggccggcgccctgaacagcaacgacgccttcgtgctgaagacccccagcgccgcctacctgtgggtgggcaccggcgccagcgaggccgagaagaccggcgcccaggagctgctgagagtgctgagagcccagcccgtgcaggtggccgagggcagcgagcccgacggcttctgggaggccctgggcggcaaggccgcctacagaaccagccccagactgaaggacaagaagatggacgcccacccccccagactgttcgcctgcagcaacaagatcggcagattcgtgatcgaggaggtgcccggcgagctgatgcaggaggacctggccaccgacgacgtgatgctgctggacacctgggaccaggtgttcgtgtgggtgggcaaggacagccaggaggaggagaagaccgaggccctgaccagcgccaagagatacatcgagaccgaccccgccaacagagacagaagaacccccatcaccgtggtgaagcagggcttcgagccccccagcttcgtgggctggttcctgggctgggacgacgactactggagcgtggaccccctggacagagccatggccgagctggccgcctag

SEQ ID NO: 82856 - DNA, 2196 bp, Artificial Sequence; identical to SEQ ID NO: 82850
  Description of Artificial Sequence: Synthetic coding sequence

SEQ ID NO: 82857 - DNA, 783 bp, Artificial Sequence
  Description of Artificial Sequence: Synthetic coding sequence
atggtggtggagcaccccgagttcctgaaggccggcaaggagcccggcctgcagatctggagagtggagaagttcgacctggtgcccgtgcccaccaacctgtacggcgacttcttcaccggcgacgcctacgtgatcctgaagaccgtgcagctgagaaacggcaacctgcagtacgacctgcactactggctgggcaacgagtgcagccaggacgagagcggcgccgccgccatcttcaccgtgcagctggacgactacctgaacggcagagccgtgcagcacagagaggtgcagggcttcgagagcgccaccttcctgggctacttcaagagcggcctgaagtacaagaagggcggcgtggccagcggcttcaagcacgtggtgcccaacgaggtggtggtgcagagactgttccaggtgaagggcagaagagtggtgagagccaccgaggtgcccgtgagctgggagagcttcaacaacggcgactgcttcatcctggacctgggcaacaacatccaccagtggtgcggcagcaacagcaacagatacgagagactgaaggccacccaggtgagcaagggcatcagagacaacgagagaagcggcagagccagagtgcacgtgagcgaggagggcaccgagcccgaggccatgctgcaggtgctgggccccaagcccgccctgcccgccggcaccgaggacaccgccaaggaggacgccgccaacagaaagctggccaagctgtacaaggtgagcaacggcgccggcaccatgagctag

SEQ ID NO: 82858 - DNA, 2229 bp, Artificial Sequence; identical to SEQ ID NO: 82855
  Description of Artificial Sequence: Synthetic coding sequence

SEQ ID NO: 82859 - DNA, 2196 bp, Artificial Sequence; identical to SEQ ID NO: 82850
  Description of Artificial Sequence: Synthetic coding sequence

SEQ ID NO: 82860 - DNA, 2118 bp, Artificial Sequence
  Description of Artificial Sequence: Synthetic coding sequence
atggtggtggagcaccccgagttcctgaaggccggcaaggagcccggcctgcagatctggagagtggagaagttcgacctggtgcccgtgcccaccaacctgtacggcgacttcttcaccggcgacgcctacgtgatcctgaagaccgtgcagctgagaaacggcaacctgcagtacgacctgcactactggctgggcaacgagtgcagccaggacgagagcggcgccgccgccatcttcaccgtgcagctggacgactacctgaagtacaagaagggcggcgtggccagcggcttcaagcacgtggtgcccaacgaggtggtggtgcagagactgttccaggtgaagggcagaagagtggtgagagccaccgaggtgcccgtgagctgggagagcttcaacaacggcgactgcttcatcctggacctgggcaacaacatccaccagtggtgcggcagcaacagcaacagatacgagagactgaaggccacccaggtgagcaagggcatcagagacaacgagagaagcggcagagccagagtgcacgtgagcgaggagggcaccgagcccgaggccatgctgcaggtgctgggccccaagcccgccctgcccgccggcaccgaggacaccgccaaggaggacgccgccaacagaaagctggccaagctgtacaaggtgagcaacggcgccggcaccatgagcgtgagcctggtggccgacgagaaccccttcgcccagggcgccctgaagagcgaggactgcttcatcctggaccacggcaaggacggcaagatcttcgtgtggaagggcaagcaggccaacaccgaggagagaaaggccgccctgaagaccgccagcgacttcatcaccaagatggactaccccaagcagacccaggtgagcgtgctgcccgagggcggcgagacccccctgttcaagcagttcttcaagaactggagagaccccgaccagaccgacggcctgggcctgagctacctgagcagccacatcgccaacgtggagagagtgcccttcgacgccgccaccctgcacaccagcaccgccatggccgcccagcacggcatggacgacgacggcaccggccagaagcagatctggagaatcgagggcagcaacaaggtgcccgtggaccccgccacctacggccagttctacggcggcgacagctacatcatcctgtacaactacagacacggcggcagacagggccagatcatctacaactggcagggcgcccagagcacccaggacgaggtggccgccagcgccatcctgaccgcccagctggacgaggagctgggcggcacccccgtgcagagcagagtggtgcagggcaaggagcccgcccacctgatgagcctgttcggcggcaagcccatgatcatctacaagggcggcaccagcagagagggcggccagaccgcccccgccagcaccagactgttccaggtgagagccaacagcgccggcgccaccagagccgtggaggtgctgcccaaggccggcgccctgaacagcaacgacgccttcgtgctgaagacccccagcgccgcctacctgtgggtgggcaccggcgccagcgaggccgagaagaccggcgcccaggagctgctgagagtgctgagagcccagcccgtgcaggtggccgagggcagcgagcccgacggcttctgggaggccctgggcggcaaggccgcctacagaaccagccccagactgaaggacaagaagatggacgcccacccccccagactgttcgcctgcagcaacaagatcggcagattcgtgatcgaggaggtgcccggcgagctgatgcaggaggacctggccaccgacgacgtgatgctgctggacacctgggaccaggtgttcgtgtgggtgggcaaggacagccaggaggaggagaagaccgaggccctgaccagcgccaagagatacatcgagaccgaccccgccaacagagacagaagaacccccatcaccgtggtgaagcagggcttcgagccccccagcttcgtgggctggttcctgggctgggacgacgactactggagcgtggaccccctggacagagccatggccgagctggccgcctag

SEQ ID NO: 82861 - DNA, 2220 bp, Artificial Sequence
  Description of Artificial Sequence: Synthetic coding sequence
atgcccctgtgcacccccaacagcatggtggtggagcaccccgagttcctgaaggccggcaaggagcccggcctgcagatctggagagtggagaagttcgacctggtgcccgtgcccaccaacctgtacggcgacttcttcaccggcgacgcctacgtgatcctgaagaccgtgcagctgagaaacggcaacctgcagtacgacctgcactactggctgggcaacgagtgcagccaggacgagagcggcgccgccgccatcttcaccgtgcagctggacgactacctgaacggcagagccgtgcagcacagagaggtgcagggcttcgagagcgccaccttcctgggctacttcaagagcggcctgaagtacaagaagggcggcgtggccagcggcttcaagcacgtggtgcccaacgaggtggtggtgcagagactgttccaggtgaagggcagaagagtggtgagagccaccgaggtgcccgtgagctgggagagcttcaacaacggcgactgcttcatcctggacctgggcaacaacatccaccagtggtgcggcagcaacagcaacagatacgagagactgaaggccacccaggtgagcaagggcatcagagacaacgagagaagcggcagagccagagtgcacgtgagcgaggagggcaccgagcccgaggccatgctgcaggtgctgggccccaagcccgccctgcccgccggcaccgaggacaccgccaaggaggacgccgccaacagaaagctggccaagctgtacaaggtgagcaacggcgccggcaccatgagcgtgagcctggtggccgacgagaaccccttcgcccagggcgccctgaagagcgaggactgcttcatcctggaccacggcaaggacggcaagatcttcgtgtggaagggcaagcaggccaacaccgaggagagaaaggccgccctgaagaccgccagcgacttcatcaccaagatggactaccccaagcagacccaggtgagcgtgctgcccgagggcggcgagacccccctgttcaagcagttcttcaagaactggagagaccccgaccagaccgacggcctgggcctgagctacctgagcagccacatcgccaacgtggagagagtgcccttcgacgccgccaccctgcacaccagcaccgccatggccgcccagcacggcatggacgacgacggcaccggccagaagcagatctggagaatcgagggcagcaacaaggtgcccgtggaccccgccacctacggccagttctacggcggcgacagctacatcatcctgtacaactacagacacggcggcagacagggccagatcatctacaactggcagggcgcccagagcacccaggacgaggtggccgccagcgccatcctgaccgcccagctggacgaggagctgggcggcacccccgtgcagagcagagtggtgcagggcaaggagcccgcccacctgatgagcctgttcggcggcaagcccatgatcatctacaagggcggcaccagcagagagggcggccagaccgcccccgccagcaccagactgttccaggtgagagccaacagcgccggcgccaccagagccgtggaggtgctgcccaaggccggcgccctgaacagcaacgacgccttcgtgctgaagacccccagcgccgcctacctgtgggtgggcaccggcgccagcgaggccgagaagaccggcgcccaggagctgctgagagtgctgagagcccagcccgtgcaggtggccgagggcagcgagcccgacggcttctgggaggccctgggcggcaaggccgcctacagaaccagccccagactgaaggacaagaagatggacgcccacccccccagactgttcgcctgcagcaacaagatcggcagattcgtgatcgaggaggtgcccggcgagctgatgcaggaggacctggccaccgacgacgtgatgctgctggacacctgggaccaggtgttcgtgtgggtgggcaaggacagccaggaggaggagaagaccgaggccctgaccagcgccaagagatacatcgagaccgaccccgccaacagagacagaagaacccccatcaccgtggtgaagcagggcttcgagccccccagcttcgtgggctggttcctgggctgggacgacgactactggagcgtggaccccctggacagagccatggccgagctggccgcctag

SEQ ID NO: 82862 - DNA, 4527 bp, Artificial Sequence
  Description of Artificial Sequence: Synthetic coding sequence
atgggccaggagcccagaaccctgccccccagccccaactggtactgcgccagatgcagcgacgccgtgcccggcggcctgttcggcttcgccgccagaaccagcgtgttcctggtgagagtgggccccggcgccggcgagagccccggcaccccccccttcagagtgatcggcgagctggtgggccacaccgagagagtgagcggcttcaccttcagccaccaccccggccagtacaacctgtgcgccaccagcagcgacgacggcaccgtgaagatctgggacgtggagaccaagaccgtggtgaccgagcacgccctgcaccagcacaccatcagcaccctgcactggagccccagagtgaaggacctgatcgtgagcggcgacgagaagggcgtggtgttctgctactggttcaacagaaacgacagccagcacctgttcatcgagcccagaaccatcttctgcctgacctgcagcccccaccacgaggacctggtggccatcggctacaaggacggcatcgtggtgatcatcgacatcagcaagaagggcgaggtgatccacagactgagaggccacgacgacgagatccacagcatcgcctggtgccccctgcccggcgaggactgcctgagcatcaaccaggaggagaccagcgaggaggccgagatcaccaacggcaacgccgtggcccaggcccccgtgaccaagggctgctacctggccaccggcagcaaggaccagaccatcagaatctggagctgcagcagaggcagaggcgtgatgatcctgaagctgcccttcctgaagagaagaggcggcggcatcgaccccaccgtgaaggagagactgtggctgaccctgcactggcccagcaaccagcccacccagctggtgagcagctgcttcggcggcgagctgctgcagtgggacctgacccagagctggagaagaaagtacaccctgttcagcgccagcagcgagggccagaaccacagcagaatcgtgttcaacctgtgccccctgcagaccgaggacgacaagcagctgctgctgagcaccagcatggacagagacgtgaagtgctgggacatcgccaccctggagtgcagctggaccctgcccagcctgggcggcttcgcctacagcctggccttcagcagcgtggacatcggcagcctggccatcggcgtgggcgacggcatgatcagagtgtggaacaccctgagcatcaagaacaactacgacgtgaagaacttctggcagggcgtgaagagcaaggtgaccgccctgtgctggcaccccaccaaggagggctgcctggccttcggcaccgacgacggcaaggtgggcctgtacgacacctacagcaacaagcccccccagatcagcagcacctaccacaagaagaccgtgtacaccctggcctggggcccccccgtgccccccatgagcctgggcggcgagggcgacagacccagcctggccctgtacagctgcggcggcgagggcatcgtgctgcagcacaacccctggaagctgagcggcgaggccttcgacatcaacaagctgatcagagacaccaacagcatcaagtacaagctgcccgtgcacaccgagatcagctggaaggccgacggcaagatcatggccctgggcaacgaggacggcagcatcgagatcttccagatccccaacctgaagctgatctgcaccatccagcagcaccacaagctggtgaacaccatcagctggcaccacgagcacggcagccagcccgagctgagctacctgatggccagcggcagcaacaacgccgtgatctacgtgcacaacctgaagaccgtgatcgagagcagccccgagagccccgtgaccatcaccgagccctacagaaccctgagcggccacaccgccaagatcaccagcgtggcctggagcccccaccacgacggcagactggtgagcgccagctacgacggcaccgcccaggtgtgggacgccctgagagaggagcccctgtgcaacttcagaggccacagaggcagactgctgtgcgtggcctggagccccctggaccccgactgcatctacagcggcgccgacgacttctgcgtgcacaagtggctgaccagcatgcaggaccacagcagacccccccagggcaagaagagcatcgagctggagaagaagagactgagccagcccaaggccaagcccaagaagaagaagaagcccaccctgagaacccccgtgaagctggagagcatcgacggcaacgaggaggagagcatgaaggagaacagcggccccgtggagaacggcgtgagcgaccaggagggcgaggagcaggccagagagcccgagctgccctgcggcctggcccccgccgtgagcagagagcccgtgatctgcacccccgtgagcagcggcttcgagaagagcaaggtgaccatcaacaacaaggtgatcctgctgaagaaggagccccccaaggagaagcccgagaccctgatcaagaagagaaaggccagaagcctgctgcccctgagcaccagcctggaccacagaagcaaggaggagctgcaccaggactgcctggtgctggccaccgccaagcacagcagagagctgaacgaggacgtgagcgccgacgtggaggagagattccacctgggcctgttcaccgacagagccaccctgtacagaatgatcgacatcgagggcaagggccacctggagaacggccaccccgagctgttccaccagctgatgctgtggaagggcgacctgaagggcgtgctgcagaccgccgccgagagaggcgagctgaccgacaacctggtggccatggcccccgccgccggctaccacgtgtggctgtgggccgtggaggccttcgccaagcagctgtgcttccaggaccagtacgtgaaggccgccagccacctgctgagcatccacaaggtgtacgaggccgtggagctgctgaagagcaaccacttctacagagaggccatcgccatcgccaaggccagactgagacccgaggaccccgtgctgaaggacctgtacctgagctggggcaccgtgctggagagagacggccactacgccgtggccgccaagtgctacctgggcgccacctgcgcctacgacgccgccaaggtgctggccaagaagggcgacgccgccagcctgagaaccgccgccgagctggccgccatcgtgggcgaggacgagctgagcgccagcctggccctgagatgcgcccaggagctgctgctggccaacaactgggtgggcgcccaggaggccctgcagctgcacgagagcctgcagggccagagactggtgttctgcctgctggagctgctgagcagacacctggaggagaagcagctgagcgagggcaagagcagcagcagctaccacacctggaacaccggcaccgagggccccttcgtggagagagtgaccgccgtgtggaagagcatcttcagcctggacacccccgagcagtaccaggaggccttccagaagctgcagaacatcaagtaccccagcgccaccaacaacacccccgccaagcagctgctgctgcacatctgccacgacctgaccctggccgtgctgagccagcagatggccagctgggacgaggccgtgcaggccctgctgagagccgtggtgagaagctacgacagcggcagcttcaccatcatgcaggaggtgtacagcgccttcctgcccgacggctgcgaccacctgagagacaagctgggcgaccaccagagccccgccacccccgccttcaagagcctggaggccttcttcctgtacggcagactgtacgagttctggtggagcctgagcagaccctgccccaacagcagcgtgtgggtgagagccggccacagaaccctgagcgtggagcccagccagcagctggacaccgccagcaccgaggagaccgaccccgagaccagccagcccgagcccaacagacccagcgagctggacctgagactgaccgaggagggcgagagaatgctgagcaccttcaaggagctgttcagcgagaagcacgccagcctgcagaacagccagagaaccgtggccgaggtgcaggagaccctggccgagatgatcagacagcaccagaagagccagctgtgcaagagcaccgccaacggccccgacaagaacgagcccgaggtggaggccgagcagcccctgtgcagcagccagagccagtgcaaggaggagaagaacgagcccctgagcctgcccgagctgaccaagagactgaccgaggccaaccagagaatggccaagttccccgagagcatcaaggcctggcccttccccgacgtgctggagtgctgcctggtgctgctgctgatcagaagccacttccccggctgcctggcccaggagatgcagcagcaggcccaggagctgctgcagaagtacggcaacaccaagacctacagaagacactgccagaccttctgcatgtag

SEQ ID NO: 82863 - DNA, 396 bp, Artificial Sequence
  Description of Artificial Sequence: Synthetic coding sequence
atgcagacccccgtgaacatccccgtgcccgtgctgagactgcccagaggccccgacggcttcagcagaggcttcgcccccgacggcagaagagcccccctgagacccgaggtgcccgagatccaggagtgccccatcgcccaggagagcctggagagccaggagcagagagccagagccgccctgagagagagatacctgagaagcctgctggccatggtgggccaccaggtgagcttcaccctgcacgagggcgtgagagtggccgcccacttcggcgccaccgacctggacgtggccaacttctacgtgagccagctgcagacccccatcggcgtgcaggccgaggccctgctgagatgcagcgacatcatcagctacaccttcaagccctag

SEQ ID NO: 82864 - DNA, 396 bp, Artificial Sequence; identical to SEQ ID NO: 82863
  Description of Artificial Sequence: Synthetic coding sequence

SEQ ID NO: 82865 - DNA, 2913 bp, Artificial Sequence
  Description of Artificial Sequence: Synthetic coding sequence
atggacgccgccgagcccggcctgccccccggccccgagggcagaaagagatacagcgacatcttcagaagcctggacaacctggagatcagcctgggcaacgtgaccctggagatgctggccggcgaccccctgctgagcgaggaccccgagcccgacaagacccccaccgccaccgtgaccaacgaggccagctgctggagcggccccagccccgagggccccgtgcccctgaccggcgaggagctggacctgagactgatcagaaccaagggcggcgtggacgccgccctggagtacgccaagacctggagcagatacgccaaggagctgctggcctggaccgagaagagagccagctacgagctggagttcgccaagagcaccatgaagatcgccgaggccggcaaggtgagcatccagcagcagagccacatgcccctgcagtacatctacaccctgttcctggagcacgacctgagcctgggcaccctggccatggagaccgtggcccagcagaagagagactactaccagcccctggccgccaagagaaccgagatcgagaagtggagaaaggagttcaaggagcagtggatgaaggagcagaagagaatgaacgaggccgtgcaggccctgagaagagcccagctgcagtacgtgcagagaagcgaggacctgagagccagaagccagggcagccccgaggacagcgccccccaggccagccccggccccagcaagcagcaggagagaagaagaagaagcagagaggaggcccaggccaaggcccaggaggccgaggccctgtaccaggcctgcgtgagagaggccaacgccagacagcaggacctggagatcgccaagcagagaatcgtgagccacgtgagaaagctggtgttccagggcgacgaggtgctgagaagagtgaccctgagcctgttcggcctgagaggcgcccaggccgagagaggccccagagccttcgccgccctggccgagtgctgcgcccccttcgagcccggccagagataccaggagttcgtgagagccctgagacccgaggccccccccccccccccccccgccttcagcttccaggagttcctgcccagcctgaacagcagccccctggacatcagaaagaagctgagcggccccctgccccccagactggacgagaacagcgccgagcccggcccctgggaggaccccggcaccggctggagatggcagggcacccccggccccacccccggcagcgacgtggacagcgtgggcggcggcagcgagagcagaagcctggacagccccaccagcagccccggcgccggcaccagacagctggtgaaggccagcagcaccggcaccgagagcagcgacgacttcgaggagagagaccccgacctgggcgacggcctggagaacggcctgggcagccccttcggcaagtggaccctgagcagcgccgcccagacccaccagctgagaagactgagaggccccgccaagtgcagagagtgcgaggccttcatggtgagcggcaccgagtgcgaggagtgcttcctgacctgccacaagagatgcctggagaccctgctgatcctgtgcggccacagaagactgcccgccagaacccccctgttcggcgtggacttcctgcagctgcccagagacttccccgaggaggtgcccttcgtggtgaccaagtgcaccgccgagatcgagcacagagccctggacgtgcagggcatctacagagtgagcggcagcagagtgagagtggagagactgtgccaggccttcgagaacggcagagccctggtggagctgagcggcaacagcccccacgacgtgagcagcgtgctgaagagattcctgcaggagctgaccgagcccgtgatccccttccacctgtacgacgccttcatcagcctggccaagaccctgcacgccgaccccggcgacgaccccggcacccccagccccagccccgaggtgatcagaagcctgaagaccctgctggtgcagctgcccgacagcaactacaacaccctgagacacctggtggcccacctgttcagagtggccgccagattcatggagaacaagatgagcgccaacaacctgggcatcgtgttcggccccaccctgctgagaccccccgacggccccagagccgccagcgccatccccgtgacctgcctgctggacagcggccaccaggcccagctggtggagttcctgatcgtgcactacgagcagatcttcggcatggacgagctgccccaggccaccgagccccccccccaggacagcagccccgcccccggccccctgaccaccagcagccagcccccccccccccacctggaccccgacagccagccccccgtgctggccagcgaccccggccccgacccccagcaccacagcaccctggagcagcaccccaccgccacccccaccgagatccccaccccccagagcgaccagagagaggacgtggccgaggacaccaaggacggcggcggcgaggtgagcagccagggccccgaggacagcctgctgggcacccagagcagaggccacttcagcagacagcccgtgaagtaccccagaggcggcgtgagacccgtgacccaccagctgagcagcctggccctggtggccagcaagctgtgcgaggagacccccatcaccagcgtgcccagaggcagcctgagaggcagaggccccagccccgccgccgccagccccgagggcagccccctgagaagaacccccctgcccaagcacttcgagatcacccaggagaccgccagactgctgagcaagctggacagcgaggccgtgcccagagccacctgctgccccgacgtgcagcccgaggaggccgaggaccacctgtag

SEQ ID NO: 82866 - DNA, 2826 bp, Artificial Sequence
  Description of Artificial Sequence: Synthetic coding sequence
atggacgccgccgagcccggcctgccccccggccccgagggcagaaagagatacagcgacatcttcagaagcctggacaacctggagatcagcctgggcaacgtgaccctggagatgctggccggcgaccccctgctgagcgaggaccccgagcccgacaagacccccaccgccaccgtgaccaacgaggccagctgctggagcggccccagccccgagggccccgtgcccctgaccggcgaggagctggacctgagactgatcagaaccaagggcggcgtggacgccgccctggagtacgccaagacctggagcagatacgccaaggagctgctggcctggaccgagaagagagccagctacgagctggagttcgccaagagcaccatgaagatcgccgaggccggcaaggtgagcatccagcagcagagccacatgcccctgcagtacatctacaccctgttcctggagcacgacctgagcctgggcaccctggccatggagaccgtggcccagcagaagagagactactaccagcccctggccgccaagagaaccgagatcgagaagtggagaaaggagttcaaggagcagtggatgaaggagcagaagagaatgaacgaggccgtgcaggccctgagaagagcccagctgcagtacgtgcagagaagcgaggacctgagagccagaagccagggcagccccgaggacagcgccccccaggccagccccggccccagcaagcagcaggagagaagaagaagaagcagagaggaggcccaggccaaggcccaggaggccgaggccctgtaccaggcctgcgtgagagaggccaacgccagacagcaggacctggagatcgccaagcagagaatcgtgagccacgtgagaaagctggtgttccagggcgacgaggtgctgagaagagtgaccctgagcctgttcggcctgagaggcgcccaggccgagagaggccccagagccttcgccgccctggccgagtgctgcgcccccttcgagcccggccagagataccaggagttcgtgagagccctgagacccgaggccccccccccccccccccccgccttcagcttccaggagttcctgcccagcctgaacagcagccccctggacatcagaaagaagctgagcggccccctgccccccagactggacgagaacagcgccgagcccggcccctgggaggaccccggcaccggctggagatggcagggccccacccccggcagcgacgtggacagcgtgggcggcggcagcgagagcagaagcctggacagccccaccagcagccccgacctgggcgacggcctggagaacggcctgggcagccccttcggcaagtggaccctgagcagcgccgcccagacccaccagctgagaagactgagaggccccgccaagtgcagagagtgcgaggccttcatggtgagcggcaccgagtgcgaggagtgcttcctgacctgccacaagagatgcctggagaccctgctgatcctgtgcggccacagaagactgcccgccagaacccccctgttcggcgtggacttcctgcagctgcccagagacttccccgaggaggtgcccttcgtggtgaccaagtgcaccgccgagatcgagcacagagccctggacgtgcagggcatctacagagtgagcggcagcagagtgagagtggagagactgtgccaggccttcgagaacggcagagccctggtggagctgagcggcaacagcccccacgacgtgagcagcgtgctgaagagattcctgcaggagctgaccgagcccgtgatccccttccacctgtacgacgccttcatcagcctggccaagaccctgcacgccgaccccggcgacgaccccggcacccccagccccagccccgaggtgatcagaagcctgaagaccctgctggtgcagctgcccgacagcaactacaacaccctgagacacctggtggcccacctgttcagagtggccgccagattcatggagaacaagatgagcgccaacaacctgggcatcgtgttcggccccaccctgctgagaccccccgacggccccagagccgccagcgccatccccgtgacctgcctgctggacagcggccaccaggcccagctggtggagttcctgatcgtgcactacgagcagatcttcggcatggacgagctgccccaggccaccgagccccccccccaggacagcagccccgcccccggccccctgaccaccagcagccagcccccccccccccacctggaccccgacagccagccccccgtgctggccagcgaccccggccccgacccccagcaccacagcaccctggagcagcaccccaccgccacccccaccgagatccccaccccccagagcgaccagagagaggacgtggccgaggacaccaaggacggcggcggcgaggtgagcagccagggccccgaggacagcctgctgggcacccagagcagaggccacttcagcagacagcccgtgaagtaccccagaggcggcgtgagacccgtgacccaccagctgagcagcctggccctggtggccagcaagctgtgcgaggagacccccatcaccagcgtgcccagaggcagcctgagaggcagaggccccagccccgccgccgccagccccgagggcagccccctgagaagaacccccctgcccaagcacttcgagatcacccaggagaccgccagactgctgagcaagctggacagcgaggccgtgcccagagccacctgctgccccgacgtgcagcccgaggaggccgaggaccacctgtag

SEQ ID NO: 82867 - DNA, 1005 bp, Artificial Sequence
  Description of Artificial Sequence: Synthetic coding sequence
atgaacaccatcctgccctgccaggaccagtacttcgtgggcggccagagctacaactgcccctacagcaccaccaccagcgagagcagcgtggacgtgagcaccgagacctgggtgagcttctgggccgccggcctgctggacaacagagagctgcagcaggccccccaggcccaggagagcttcagcgacagcaacttccccctgcccgacctgtgcagctgggaggaggcccagctgagcagccagctgtacagaaacaagcagctgcaggacaccctggtgcagaaggaggaggagctggccagactgcacgaggagaacaaccacctgagacagtacctgaacagcgccctggtgaagtgcctggaggagaaggccaagaagctgctgagcagcgacgagttcagcaaggcctacggcaagttcagaaagggcaagagaaagagcaaggagcagagatacagccccgccgagatcccccaccccaagaacgccaagagaaacctgagcagcgagttcgccaactgcgaggagcaggccggcccccccgtggacccctgggtgctgcagaccctgggcctgaaggacctggacaccatcgacgacaccagcagcgccaactacagcgccctggccagccaccccagaagagtggccagcaccttcagccagttccccgacgacgccgtggactacaagaacatccccagagaggacatgcccatcgactacagaggcgacagaaccacccccctgcacagcaccgccacccacggcgaggacttccacatcctgagccagctgagcaacccccccgtgggcctgaagaccctgccctactacaccgcccacgtgagccccaacaagaccgagatggccttcagcaccagcctgagcccccactgcaacgtgaagacccacagcttccaccagggccaggccttcgtgagaagagacgaggagggcggctggaagttcacctgggtgcccaagcagagctag

SEQ ID NO: 82868 - DNA, 2727 bp, Artificial Sequence
  Description of Artificial Sequence: Synthetic coding sequence
atgggcgtgaacgacctgtggcagatcctggagcccgtgaagcagcacatccccctgagaaacctgggcggcaagaccatcgccgtggacctgagcctgtgggtgtgcgaggcccagaccgtgaagaagatgatgggcagcgtgatgaagccccacctgagaaacctgttcttcagaatcagctacctgacccagatggacgtgaagctggtgttcgtgatggagggcgagccccccaagctgaaggccgacgtgatcagcaagagaaaccagagcagatacggcagcagcggcaagagctggagccagaagaccggcagaagccacttcaagagcgtgctgagagagtgcctgcacatgctggagtgcctgggcatcccctgggtgcaggccgccggcgaggccgaggccatgtgcgcctacctgaacgccggcggccacgtggacggctgcctgaccaacgacggcgacaccttcctgtacggcgcccagaccgtgtacagaaacttcaccatgaacaccaaggacccccacgtggactgctacaccatgagcagcatcaagagcaagctgggcctggacagagacgccctggtgggcctggccatcctgctgggctgcgactacctgcccaagggcgtgcccggcgtgggcaaggagcaggccctgaagctgatccagatcctgaagggccagagcctgctgcagagattcaacagatggaacgagaccagctgcaacagcagcccccagctgctggtgaccaagaagctggcccactgcagcgtgtgcagccaccccggcagccccaaggaccacgagagaaacggctgcagactgtgcaagagcgacaagtactgcgagccccacgactacgagtactgctgcccctgcgagtggcacagaaccgagcacgacagacagctgagcgaggtggagaacaacatcaagaagaaggcctgctgctgcgagggcttccccttccacgaggtgatccaggagttcctgctgaacaaggacaagctggtgaaggtgatcagataccagagacccgacctgctgctgttccagagattcaccctggagaagatggagtggcccaaccactacgcctgcgagaagctgctggtgctgctgacccactacgacatgatcgagagaaagctgggcagcagaaacagcaaccagctgcagcccatcagaatcgtgaagaccagaatcagaaacggcgtgcactgcttcgagatcgagtgggagaagcccgagcactacgccatggaggacaagcagcacggcgagttcgccctgctgaccatcgaggaggagagcctgttcgaggccgcctaccccgagatcgtggccgtgtaccagaagcagaagctggagatcaagggcaagaagcagaagagaatcaagcccaaggagaacaacctgcccgagcccgacgaggtgatgagcttccagagccacatgaccctgaagcccacctgcgagatcttccacaagcagaacagcaagctgaacagcggcatcagccccgaccccaccctgccccaggagagcatcagcgccagcctgaacagcctgctgctgcccaagaacaccccctgcctgaacgcccaggagcagttcatgagcagcctgagacccctggccatccagcagatcaaggccgtgagcaagagcctgatcagcgagagcagccagcccaacaccagcagccacaacatcagcgtgatcgccgacctgcacctgagcaccatcgactgggagggcaccagcttcagcaacagccccgccatccagagaaacaccttcagccacgacctgaagagcgaggtggagagcgagctgagcgccatccccgacggcttcgagaacatccccgagcagctgagctgcgagagcgagagatacaccgccaacatcaagaaggtgctggacgaggacagcgacggcatcagccccgaggagcacctgctgagcggcatcaccgacctgtgcctgcaggacctgcccctgaaggagagaatcttcaccaagctgagctacccccaggacaacctgcagcccgacgtgaacctgaagaccctgagcatcctgagcgtgaaggagagctgcatcgccaacagcggcagcgactgcaccagccacctgagcaaggacctgcccggcatccccctgcagaacgagagcagagacagcaagatcctgaagggcgaccagctgctgcaggaggactacaaggtgaacaccagcgtgccctacagcgtgagcaacaccgtggtgaagacctgcaacgtgagaccccccaacaccgccctggaccacagcagaaaggtggacatgcagaccaccagaaagatcctgatgaagaagagcgtgtgcctggacagacacagcagcgacgagcagagcgcccccgtgttcggcaaggccaagtacaccacccagagaatgaagcacagcagccagaagcacaacagcagccacttcaaggagagcggccacaacaagctgagcagccccaagatccacatcaaggagaccgagcagtgcgtgagaagctacgagaccgccgagaacgaggagagctgcttccccgacagcaccaagagcagcctgagcagcctgcagtgccacaagaaggagaacaacagcggcacctgcctggacagccccctgcccctgagacagagactgaagctgagattccagagcacctag

SEQ ID NO: 82869 - DNA, 2727 bp, Artificial Sequence; identical to SEQ ID NO: 82868
  Description of Artificial Sequence: Synthetic coding sequence

SEQ ID NO: 82870 - DNA, 381 bp, Artificial Sequence
  Description of Artificial Sequence: Synthetic coding sequence
atgggcgtgaacgacctgtggcagatcctggagcccgtgaagcagcacatccccctgagaaacctgggcggcaagaccatcgccgtggacctgagcctgtgggtgtgcgaggcccagaccgtgaagaagatgatgggcagcgtgatgaagccccacctgagaaacctgttcttcagaatcagctacctgacccagatggacgtgaagctggtgttcgtgatggagggcgagccccccaagctgaaggccgacgtgatcagcaagagaaaccagagcagatacggcagcagcggcaagagctggagccagaagaccggcagaagccacttcaagagcgtgctgagagagtgcctgcacatgctggagtgcctgggcatctag

SEQ ID NO: 82871 - DNA, 282 bp, Artificial Sequence
  Description of Artificial Sequence: Synthetic coding sequence
atgggcgtgaacgacctgtggcagatcctggagcccgtgaagcagcacatccccctgagaaacctgggcggcaagaccatcgccgtggacctgagcctgtgggtgtgcgaggcccagaccgtgaagaagatgatgggcagcgtgatgaagccccacctgagaaacctgttcttcagaatcagctacctgacccagatggacgtgaagctggtgttcgtgatggagggcgagccccccaagctgaaggccgacgtgatcagcaagagaaaccagagcagatag

SEQ ID NO: 82872 - DNA, 1431 bp, Artificial Sequence
  Description of Artificial Sequence: Synthetic coding sequence
atggagtggcccaaccactacgcctgcgagaagctgctggtgctgctgacccactacgacatgatcgagagaaagctgggcagcagaaacagcaaccagctgcagcccatcagaatcgtgaagaccagaatcagaaacggcgtgcactgcttcgagatcgagtgggagaagcccgagcactacgccatggaggacaagcagcacggcgagttcgccctgctgaccatcgaggaggagagcctgttcgaggccgcctaccccgagatcgtggccgtgtaccagaagcagaagctggagatcaagggcaagaagcagaagagaatcaagcccaaggagaacaacctgcccgagcccgacgaggtgatgagcttccagagccacatgaccctgaagcccacctgcgagatcttccacaagcagaacagcaagctgaacagcggcatcagccccgaccccaccctgccccaggagagcatcagcgccagcctgaacagcctgctgctgcccaagaacaccccctgcctgaacgcccaggagcagttcatgagcagcctgagacccctggccatccagcagatcaaggccgtgagcaagagcctgatcagcgagagcagccagcccaacaccagcagccacaacatcagcgtgatcgccgacctgcacctgagcaccatcgactgggagggcaccagcttcagcaacagccccgccatccagagaaacaccttcagccacgacctgaagagcgaggtggagagcgagctgagcgccatccccgacggcttcgagaacatccccgagcagctgagctgcgagagcgagagatacaccgccaacatcaagaaggtgctggacgaggacagcgacggcatcagccccgaggagcacctgctgagcggcatcaccgacctgtgcctgcaggacctgcccctgaaggagagaatcttcaccaagctgagctacccccaggacaacctgcagcccgacgtgaacctgaagaccctgagcatcctgagcgtgaaggagagctgcatcgccaacagcggcagcgactgcaccagccacctgagcaaggacctgcccggcatccccctgcagaacgagagcagagacagcaagatcctgaagggcgaccagctgctgcaggaggactacaaggtgaacaccagcgtgccctacagcgtgagcaacaccgtggtgaagacctgcaacgtgagaccccccaacaccgccctggaccacagcagaaaggtggacatgcagaccaccagaaagatcctgatgaagaagagcgtgtgcctggacagacacagcagcgacgagcagagcgcccccgtgttcggcaaggccaagtacaccacccagagaatgaagcacagcagccagaagcacaacagcagccacttcaaggagagcggccacaacgagtag

SEQ ID NO: 82873 - DNA, 1437 bp, Artificial Sequence
  Description of Artificial Sequence: Synthetic coding sequence
atggcctgcctgaaccccgtgcccaagctgtacagaagcgtgatcgaggacgtgatcgagggcgtgagaaacctgttcgccgaggagggcatcgaggagcaggtgctgaaggacctgaagcagctgtgggagaccaaggtgctgcagagcaaggccaccgaggacttcttcagaaacagcatccagagccccctgttcaccctgcagctgccccacagcctgcaccagaccctgcagagcagcaccgccagcctggtgatccccgccggcagaaccctgcccagcttcaccaccgccgagctgggcaccagcaacagcagcgccaacttcaccttccccggctaccccatccacgtgcccgccggcgtgaccctgcagaccgtgagcggccacctgtacaaggtgaacgtgcccatcatggtgaccgagaccagcggcagagccggcatcctgcagcaccccatccagcaggtgttccagcagctgggccagcccagcgtgatccagaccagcgtgccccagctgaacccctggagcctgcaggccaccaccgagaagagccagagaatcgagaccgtgctgcagcagcccgccatcctgcccagcggccccgtggacagaaagcacctggagaacgccaccagcgacatcctggtgagccccggcaacgagcacaagatcgtgcccgaggccctgctgtgccaccaggagagcagccactacatcagcctgcccggcgtggtgttcagcccccaggtgagccagaccaacagcaacgtggagagcgtgctgagcggcagcgccagcatggcccagaacctgcacgacgagagcctgagcaccagcccccacggcgccctgcaccagcacgtgaccgacatccagctgcacatcctgaagaacagaatgtacggctgcgacagcgtgaagcagcccagaaacatcgaggagcccagcaacatccccgtgagcgagaaggacagcaacagccaggtggacctgagcatcagagtgaccgacgacgacatcggcgagatcatccaggtggacggcagcggcgacaccagcagcaacgaggagatcggcagcaccagagacgccgacgagaacgagttcctgggcaacatcgacggcggcgacctgaaggtgcccgaggaggaggccgacagcatcagcaacgaggacagcgccaccaacagcagcgacaacgaggacccccaggtgaacatcgtggaggaggaccccctgaacagcggcgacgacgtgagcgagcaggacgtgcccgacctgttcgacaccgacaacgtgatcgtgtgccagtacgacaagatccacagaagcaagaacaagtggaagttctacctgaaggacggcgtgatgtgcttcggcggcagagactacgtgttcgccaaggccatcggcgacgccgagtggtag

SEQ ID NO: 82874 - DNA, 1335 bp, Artificial Sequence
  Description of Artificial Sequence: Synthetic coding sequence
atggcctgcctgaaccccgtgctgtgggagaccaaggtgctgcagagcaaggccaccgaggacttcttcagaaacagcatccagagccccctgttcaccctgcagctgccccacagcctgcaccagaccctgcagagcagcaccgccagcctggtgatccccgccggcagaaccctgcccagcttcaccaccgccgagctgggcaccagcaacagcagcgccaacttcaccttccccggctaccccatccacgtgcccgccggcgtgaccctgcagaccgtgagcggccacctgtacaaggtgaacgtgcccatcatggtgaccgagaccagcggcagagccggcatcctgcagcaccccatccagcaggtgttccagcagctgggccagcccagcgtgatccagaccagcgtgccccagctgaacccctggagcctgcaggccaccaccgagaagagccagagaatcgagaccgtgctgcagcagcccgccatcctgcccagcggccccgtggacagaaagcacctggagaacgccaccagcgacatcctggtgagccccggcaacgagcacaagatcgtgcccgaggccctgctgtgccaccaggagagcagccactacatcagcctgcccggcgtggtgttcagcccccaggtgagccagaccaacagcaacgtggagagcgtgctgagcggcagcgccagcatggcccagaacctgcacgacgagagcctgagcaccagcccccacggcgccctgcaccagcacgtgaccgacatccagctgcacatcctgaagaacagaatgtacggctgcgacagcgtgaagcagcccagaaacatcgaggagcccagcaacatccccgtgagcgagaaggacagcaacagccaggtggacctgagcatcagagtgaccgacgacgacatcggcgagatcatccaggtggacggcagcggcgacaccagcagcaacgaggagatcggcagcaccagagacgccgacgagaacgagttcctgggcaacatcgacggcggcgacctgaaggtgcccgaggaggaggccgacagcatcagcaacgaggacagcgccaccaacagcagcgacaacgaggacccccaggtgaacatcgtggaggaggaccccctgaacagcggcgacgacgtgagcgagcaggacgtgcccgacctgttcgacaccgacaacgtgatcgtgtgccagtacgacaagatccacagaagcaagaacaagtggaagttctacctgaaggacggcgtgatgtgcttcggcggcagagactacgtgttcgccaaggccatcggcgacgccgagtggtag

SEQ ID NO: 82875 - DNA, 951 bp, Artificial Sequence
  Description of Artificial Sequence: Synthetic coding sequence
atggccagcaccagcagactggacgccctgcccagagtgacctgccccaaccaccccgacgccatcctggtggaggactacagagccggcgacatgatctgccccgagtgcggcctggtggtgggcgacagagtgatcgacgtgggcagcgagtggagaaccttcagcaacgacaaggccaccaaggaccccagcagagtgggcgacagccagaaccccctgctgagcgacggcgacctgagcaccatgatcggcaagggcaccggcgccgccagcttcgacgagttcggcaacagcaagtaccagaacagaagaaccatgagcagcagcgacagagccatgatgaacgccttcaaggagatcaccaccatggccgacagaatcaacctgcccagaaacatcgtggacagaaccaacaacctgttcaagcaggtgtacgagcagaagagcctgaagggcagagccaacgacgccatcgccagcgcctgcctgtacatcgcctgcagacaggagggcgtgcccagaaccttcaaggagatctgcgccgtgagcagaatcagcaagaaggagatcggcagatgcttcaagctgatcctgaaggccctggagaccagcgtggacctgatcaccaccggcgacttcatgagcagattctgcagcaacctgtgcctgcccaagcaggtgcagatggccgccacccacatcgccagaaaggccgtggagctggacctggtgcccggcagaagccccatcagcgtggccgccgccgccatctacatggccagccaggccagcgccgagaagagaacccagaaggagatcggcgacatcgccggcgtggccgacgtgaccatcagacagagctacagactgatctaccccagagcccccgacctgttccccaccgacttcaagttcgacacccccgtggacaagctgccccagctgtag

SEQ ID NO: 82876 - DNA, 696 bp, Artificial Sequence
  Description of Artificial Sequence: Synthetic coding sequence
atggccagcaccagcagactggacgccctgcccagagtgacctgccccaaccaccccgacgccatcctggtggaggactacagagccggcgacatgatctgccccgagtgcgacagagtgatcgacgtgggcagcgagtggagaaccttcagcaacgacaaggccaccaaggaccccagcagagtgggcgacagccagaaccccctgctgagcgacggcgacctgagcaccatgatcggcaagggcaccggcgccgccagcttcgacgagttcggcaacagcaagtaccagaacagaagaaccatgagcagcagcgacagagccatgatgaacgccttcaaggagatcaccaccatggccgacagaatcaacctgcccagaaacatcgtggacagaaccaacaacctgttcaagcaggtgtacgagcagaagagcctgaagggcagagccaacgacgccatcgccagcgcctgcctgtacatcgcctgcagacaggagggcgtgcccagaaccttcaaggagatctgcgccgtgagcagaatcagcaagaaggagatcggcagatgcttcaagctgatcctgaaggccctggagaccagcgtggacctgatcaccaccggcgacttcatgagcagattctgcagcaacctgtgcctgcccaagcaggtgcagatggccgccacccacatcgcctag

SEQ ID NO: 82877 - DNA, 675 bp, Artificial Sequence
  Description of Artificial Sequence: Synthetic coding sequence
gccagcaccagcagactggacgccctgcccagagtgacctgccccaaccaccccgacgccatcctggtggaggactacagagccggcgacatgatctgccccgagtgcggcctggtggtgggcgacagagtgatcgacgtgggcagcgagtggagaaccttcagcaacgacaaggccaccaaggaccccagcagagtgggcgacagccagaaccccctgctgagcgacggcgacctgagcaccatgatcggcaagggcaccggcgccgccagcttcgacgagttcggcaacagcaagtaccagaacagaagaaccatgagcagcagcgacagagccatgatgaacgccttcaaggagatcaccaccatggccgacagaatcaacctgcccagaaacatcgtggacagaaccaacaacctgttcaagcaggtgtacgagcagaagagcctgaagggcagagccaacgacgccatcgccagcgcctgcctgtacatcgcctgcagacaggagggcgtgcccagaaccttcaaggagatctgcgccgtgagcagaatcagcaagaaggagatcggcagatgcttcaagctgatcctgaaggccctggagaccagcgtggacctgatcaccaccggcgacttcatgagcagaaactggagatactgctggtgctgctag

SEQ ID NO: 82878 - DNA, 876 bp, Artificial Sequence
  Description of Artificial Sequence: Synthetic coding sequence
atggaccccagcctgctgagagagagagagctgttcaagaagagagccctgagcacccccgtggtggagaagagaagcgccagcagcgagagcagcagcagcagcagcaagaagaagaagaccaaggtggagcacggcggcagcagcggcagcaagcagaacagcgaccacagcaacggcagcttcaacctgaaggccctgagcggcagcagcggctacaagttcggcgtgctggccaagatcgtgaactacatgaagaccagacaccagagaggcgacacccaccccctgaccctggacgagatcctggacgagacccagcacctggacatcggcctgaagcagaagcagtggctgatgaccgaggccctggtgaacaaccccaagatcgaggtgatcgacggcaagtacgccttcaagcccaagtacaacgtgagagacaagaaggccctgctgagactgctggaccagcacgaccagagaggcctgggcggcatcctgctggaggacatcgaggaggccctgcccaacagccagaaggccgtgaaggccctgggcgaccagatcctgttcgtgaacagacccgacaagaagaagatcctgttcttcaacgacaagagctgccagttcagcgtggacgaggagttccagaagctgtggagaagcgtgaccgtggacagcatggacgaggagaagatcgaggagtacctgaagagacagggcatcagcagcatgcaggagagcggccccaagaaggtggcccccatccagagaagaaagaagcccgccagccagaagaagagaagattcaagacccacaacgagcacctggccggcgtgctgaaggactacagcgacatcaccagcagcaagtag

SEQ ID NO: 82879 - DNA, 381 bp, Artificial Sequence
  Description of Artificial Sequence: Synthetic coding sequence
atggaccccagcctgctgagagagagagagctgttcaagaagagagccctgagcacccccgtggtggagaagagaagcgccagcagcgagagcagcagcagcagcagcaagaagaagaagaccaaggtggagcacggcggcagcagcggcagcaagcagaacagcgaccacagcaacggcagcttcaacctgaaggccctgagcggcagcagcggctacaagttcggcgtgctggccaagatcgtgaactacatgaagaccagacaccagagaggcgacacccaccccctgaccctggacgagatcctggacgagacccagcacctggacatcggcctgaagcagaagcagtggctgatgaccgaggccctggtgaactag

SEQ ID NO: 82880 - DNA, 597 bp, Artificial Sequence
  Description of Artificial Sequence: Synthetic coding sequence
atggaccccagcctgctgagagagagagagctgttcaagaagagagccctgagcacccccgtggtggagaagagaagcgccagcagcgagagcagcagcagcagcagcaagaagaagaagaccaaggtggagcacggcggcagcagcggcagcaagcagaacagcgaccacagcaacggcagcttcaacctgaaggccctgagcggcagcagcggctacaagttcggcgtgctggccaagatcgtgaactacatgaagaccagacaccagagaggcgacacccaccccctgaccctggacgagatcctggacgagacccagcacctggacatcggcctgaagcagaagcagtggctgatgaccgaggccctggtgaacaaccccaagatcgaggtgatcgacggcaagtacgccttcaagcccaagtacaacgtgagagacaagaaggccctgctgagactgctggaccagcacgaccagagaggcctgggcggcatcctgctggaggacatcgaggaggccctgcccaacagccagaaggccgtgaaggccctgggcgaccagatcctgttcgtgaacagacccgacaagaagtag

SEQ ID NO: 82881 - DNA, 1554 bp, Artificial Sequence
  Description of Artificial Sequence: Synthetic coding sequence
atggccgccctgggccccagcagccagaacgtgaccgagtacgtggtgagagtgcccaagaacaccaccaagaagtacaacatcatggccttcaacgccgccgacaaggtgaacttcgccacctggaaccaggccagactggagagagacctgagcaacaagaagatctaccaggaggaggagatgcccgagagcggcgccggcagcgagttcaacagaaagctgagagaggaggccagaagaaagaagtacggcatcgtgctgaaggagttcagacccgaggaccagccctggctgctgagagtgaacggcaagagcggcagaaagttcaagggcatcaagaagggcggcgtgaccgagaacaccagctactacatcttcacccagtgccccgacggcgccttcgaggccttccccgtgcacaactggtacaacttcacccccctggccagacacagaaccctgaccgccgaggaggccgaggaggagtgggagagaagaaacaaggtgctgaaccacttcagcatcatgcagcagagaagactgaaggaccaggaccaggacgaggacgaggaggagaaggagaagagaggcagaagaaaggccagcgagctgagaatccacgacctggaggacgacctggagatgagcagcgacgccagcgacgccagcggcgaggagggcggcagagtgcccaaggccaagaagaaggcccccctggccaagggcggcagaaagaagaagaagaagaagggcagcgacgacgaggccttcgaggacagcgacgacggcgacttcgagggccaggaggtggactacatgagcgacggcagcagcagcagccaggaggagcccgagagcaaggccaaggccccccagcaggaggagggccccaagggcgtggacgagcagagcgacagcagcgaggagagcgaggaggagaagccccccgaggaggacaaggaggaggaggaggagaagaaggcccccaccccccaggagaagaagagaagaaaggacagcagcgaggagagcgacagcagcgaggagagcgacatcgacagcgaggccagcagcgccctgttcatggccaagaagaagaccccccccaagagagagagaaagcccagcggcggcagcagcagaggcaacagcagacccggcacccccagcgccgagggcggcagcaccagcagcaccctgagagccgccgccagcaagctggagcagggcaagagagtgagcgagatgcccgccgccaagagactgagactggacaccggcccccagagcctgagcggcaagagcaccccccagccccccagcggcaagaccacccccaacagcggcgacgtgcaggtgaccgaggacgccgtgagaagatacctgaccagaaagcccatgaccaccaaggacctgctgaagaagttccagaccaagaagaccggcctgagcagcgagcagaccgtgaacgtgctggcccagatcctgaagagactgaaccccgagagaaagatgatcaacgacaagatgcacttcagcctgaaggagtag

SEQ ID NO: 82882 - DNA, 1299 bp, Artificial Sequence
  Description of Artificial Sequence: Synthetic coding sequence
atggccttcaacgccgccgacaaggtgaacttcgccacctggaaccaggccagactggagagagacctgagcaacaagaagatctaccaggaggaggagatgcccgagagcggcgccggcagcgagttcaacagaaagctgagagaggaggccagaagaaagaagtacggcatcgtgctgaaggagttcagacccgaggaccagccctggctgctgagagtgaacggcaagagcggcagaaagagaaacaaggtgctgaaccacttcagcatcatgcagcagagaagactgaaggaccaggaccaggacgaggacgaggaggagaaggagaagagaggcagaagaaaggccagcgagctgagaatccacgacctggaggacgacctggagatgagcagcgacgccagcgacgccagcggcgaggagggcggcagagtgcccaaggccaagaagaaggcccccctggccaagggcggcagaaagaagaagaagaagaagggcagcgacgacgaggccttcgaggacagcgacgacggcgacttcgagggccaggaggtggactacatgagcgacggcagcagcagcagccaggaggagcccgagagcaaggccaaggccccccagcaggaggagggccccaagggcgtggacgagcagagcgacagcagcgaggagagcgaggaggagaagccccccgaggaggacaaggaggaggaggaggagaagaaggcccccaccccccaggagaagaagagaagaaaggacagcagcgaggagagcgacagcagcgaggagagcgacatcgacagcgaggccagcagcgccctgttcatggccaagaagaagaccccccccaagagagagagaaagcccagcggcggcagcagcagaggcaacagcagacccggcacccccagcgccgagggcggcagcaccagcagcaccctgagagccgccgccagcaagctggagcagggcaagagagtgagcgagatgcccgccgccaagagactgagactggacaccggcccccagagcctgagcggcaagagcaccccccagccccccagcggcaagaccacccccaacagcggcgacgtgcaggtgaccgaggacgccgtgagaagatacctgaccagaaagcccatgaccaccaaggacctgctgaagaagttccagaccaagaagaccggcctgagcagcgagcagaccgtgaacgtgctggcccagatcctgaagagactgaaccccgagagaaagatgatcaacgacaagatgcacttcagcctgaaggagtag

SEQ ID NO: 82883 - DNA, 384 bp, Artificial Sequence
  Description of Artificial Sequence: Synthetic coding sequence
atggccgccctgggccccagcagccagaacgtgaccgagtacgtggtgagagtgcccaagaacaccaccaagaagtacaacatcatggccttcaacgccgccgacaaggtgaacttcgccacctggaaccaggccagactggagagagacctgagcaacaagaagatctaccaggaggaggagatgcccgagagcggcgccggcagcgagttcaacagaaagctgagagaggaggccagaagaaagaagtacggcatcgtgctgaaggagttcagacccgaggaccagccctggctgctgagagtgaacggcaagagcggcagaaagttcaagggcatcaagaagggcggcgtgaccgagaacaccagctactacatcttctag

SEQ ID NO: 82884 - DNA, 1647 bp, Artificial Sequence
  Description of Artificial Sequence: Synthetic coding sequence
atggccaccagcagcgaggaggtgctgctgatcgtgaagaaggtgagacagaagaagcaggacggcgccctgtacctgatggccgagagaatcgcctgggcccccgagggcaaggacagattcaccatcagccacatgtacgccgacatcaagtgccagaagatcagccccgagggcaaggccaagatccagctgcagctggtgctgcacgccggcgacaccaccaacttccacttcagcaacgagagcaccgccgtgaaggagagagacgccgtgaaggacctgctgcagcagctgctgcccaagttcaagagaaaggccaacaaggagctggaggagaagaacagaatgctgcaggaggaccccgtgctgttccagctgtacaaggacctggtggtgagccaggtgatcagcgccgaggagttctgggccaacagactgaacgtgaacgccaccgacagcagcagcaccagcaaccacaagcaggacgtgggcatcagcgccgccttcctggccgacgtgagaccccagaccgacggctgcaacggcctgagatacaacctgaccagcgacatcatcgagagcatcttcagaacctaccccgccgtgaagatgaagtacgccgagaacgtgccccacaacatgaccgagaaggagttctggaccagattcttccagagccactacttccacagagacagactgaacaccggcagcaaggacctgttcgccgagtgcgccaagatcgacgagaagggcctgaagaccatggtgagcctgggcgtgaagaaccccctgctggacctgaccgccctggaggacaagcccctggacgagggctacggcatcagcagcgtgcccagcgccagcaacagcaagagcatcaaggagaacagcaacgccgccatcatcaagagattcaaccaccacagcgccatggtgctggccgccggcctgagaaagcaggaggcccagaacgagcagaccagcgagcccagcaacatggacggcaacagcggcgacgccgactgcttccagcccgccgtgaagagagccaagctgcaggagagcatcgagtacgaggacctgggcaagaacaacagcgtgaagaccatcgccctgaacctgaagaagagcgacagatactaccacggccccacccccatccagagcctgcagtacgccaccagccaggacatcatcaacagcttccagagcatcagacaggagatggaggcctacacccccaagctgacccaggtgctgagcagcagcgccgccagcagcaccatcaccgccctgagccccggcggcgccctgatgcagggcggcacccagcaggccatcaaccagatggtgcccaacgacatccagagcgagctgaagcacctgtacgtggccgtgggcgagctgctgagacacttctggagctgcttccccgtgaacacccccttcctggaggagaaggtggtgaagatgaagagcaacctggagagattccaggtgaccaagctgtgccccttccaggagaagatcagaagacagtacctgagcaccaacctggtgagccacatcgaggagatgctgcagaccgcctacaacaagctgcacacctggcagagcagaagactgatgaagaagacctag

SEQ ID NO: 82885 - DNA, 1647 bp, Artificial Sequence; identical to SEQ ID NO: 82884
  Description of Artificial Sequence: Synthetic coding sequence

SEQ ID NO: 82886 - DNA, 288 bp, Artificial Sequence
  Description of Artificial Sequence: Synthetic coding sequence
atggccaccagcagcgaggaggtgctgctgatcgtgaagaaggtgagacagaagaagcaggacggcgccctgtacctgatggccgagagaatcgcctgggcccccgagggcaaggacagattcaccatcagccacatgtacgccgacatcaagtgccagaagatcagccccgagggcaaggccaagatccagctgcagctggtgctgcacgccggcgacaccaccaacttccacttcagcaacgagagcaccgccgtgaaggagagagacgccgtgaaggacctgtag

SEQ ID NO: 82887 - DNA, 1299 bp, Artificial Sequence
  Description of Artificial Sequence: Synthetic coding sequence
atgctgcaggaggaccccgtgctgttccagctgtacaaggacctggtggtgagccaggtgatcagcgccgaggagttctgggccaacagactgaacgtgaacgccaccgacagcagcagcaccagcaaccacaagcaggacgtgggcatcagcgccgccttcctggccgacgtgagaccccagaccgacggctgcaacggcctgagatacaacctgaccagcgacatcatcgagagcatcttcagaacctaccccgccgtgaagatgaagtacgccgagaacgtgccccacaacatgaccgagaaggagttctggaccagattcttccagagccactacttccacagagacagactgaacaccggcagcaaggacctgttcgccgagtgcgccaagatcgacgagaagggcctgaagaccatggtgagcctgggcgtgaagaaccccctgctggacctgaccgccctggaggacaagcccctggacgagggctacggcatcagcagcgtgcccagcgccagcaacagcaagagcatcaaggagaacagcaacgccgccatcatcaagagattcaaccaccacagcgccatggtgctggccgccggcctgagaaagcaggaggcccagaacgagcagaccagcgagcccagcaacatggacggcaacagcggcgacgccgactgcttccagcccgccgtgaagagagccaagctgcaggagagcatcgagtacgaggacctgggcaagaacaacagcgtgaagaccatcgccctgaacctgaagaagagcgacagatactaccacggccccacccccatccagagcctgcagtacgccaccagccaggacatcatcaacagcttccagagcatcagacaggagatggaggcctacacccccaagctgacccaggtgctgagcagcagcgccgccagcagcaccatcaccgccctgagccccggcggcgccctgatgcagggcggcacccagcaggccatcaaccagatggtgcccaacgacatccagagcgagctgaagcacctgtacgtggccgtgggcgagctgctgagacacttctggagctgcttccccgtgaacacccccttcctggaggagaaggtggtgaagatgaagagcaacctggagagattccaggtgaccaagctgtgccccttccaggagaagatcagaagacagtacctgagcaccaacctggtgagccacatcgaggagatgctgcagaccgcctacaacaagctgcacacctggcagagcagaagactgatgaagaagacctag

SEQ ID NO: 82888 - DNA, 1188 bp, Artificial Sequence
  Description of Artificial Sequence: Synthetic coding sequence
atggacgaggagcccgagagaaccaagagatgggagggcggctacgagagaacctgggagatcctgaaggaggacgagagcggcagcctgaaggccaccatcgaggacatcctgttcaaggccaagagaaagagagtgttcgagcaccacggccaggtgagactgggcatgatgagacacctgtacgtggtggtggacggcagcagaaccatggaggaccaggacctgaagcccaacagactgacctgcaccctgaagctgctggagtacttcgtggaggagtacttcgaccagaaccccatcagccagatcggcatcatcgtgaccaagagcaagagagccgagaagctgaccgagctgagcggcaaccccagaaagcacatcaccagcctgaagaaggccgtggacatgacctgccacggcgagcccagcctgtacaacagcctgagcatcgccatgcagaccctgaagcacatgcccggccacaccagcagagaggtgctgatcatcttcagcagcctgaccacctgcgaccccagcaacatctacgacctgatcaagaccctgaaggccgccaagatcagagtgagcgtgatcggcctgagcgccgaggtgagagtgtgcaccgtgctggccagagagaccggcggcacctaccacgtgatcctggacgagagccactacaaggagctgctgacccaccacgtgagccccccccccgccagcagcagcagcgagtgcagcctgatcagaatgggcttcccccagcacaccatcgccagcctgagcgaccaggacgccaagcccagcttcagcatggcccacctggacggcaacaccgagcccggcctgaccctgggcggctacttctgcccccagtgcagagccaagtactgcgagctgcccgtggagtgcaagatctgcggcctgaccctggtgagcgccccccacctggccagaagctaccaccacctgttccccctggacgccttccaggagatccccctggaggagtacaacggcgagagattctgctacggctgccagggcgagctgaaggaccagcacgtgtacgtgtgcgccgtgtgccagaacgtgttctgcgtggactgcgacgtgttcgtgcacgacagcctgcactgctgccccggctgcatccacaagatccccgcccccagcggcgtgtag

SEQ ID NO: 82889 - DNA, 1188 bp, Artificial Sequence; identical to SEQ ID NO: 82888
  Description of Artificial Sequence: Synthetic coding sequence

SEQ ID NO: 82890 - DNA, 1017 bp, Artificial Sequence
  Description of Artificial Sequence: Synthetic coding sequence
atgagacacctgtacgtggtggtggacggcagcagaaccatggaggaccaggacctgaagcccaacagactgacctgcaccctgaagctgctggagtacttcgtggaggagtacttcgaccagaaccccatcagccagatcggcatcatcgtgaccaagagcaagagagccgagaagctgaccgagctgagcggcaaccccagaaagcacatcaccagcctgaagaaggccgtggacatgacctgccacggcgagcccagcctgtacaacagcctgagcatcgccatgcagaccctgaagcacatgcccggccacaccagcagagaggtgctgatcatcttcagcagcctgaccacctgcgaccccagcaacatctacgacctgatcaagaccctgaaggccgccaagatcagagtgagcgtgatcggcctgagcgccgaggtgagagtgtgcaccgtgctggccagagagaccggcggcacctaccacgtgatcctggacgagagccactacaaggagctgctgacccaccacgtgagccccccccccgccagcagcagcagcgagtgcagcctgatcagaatgggcttcccccagcacaccatcgccagcctgagcgaccaggacgccaagcccagcttcagcatggcccacctggacggcaacaccgagcccggcctgaccctgggcggctacttctgcccccagtgcagagccaagtactgcgagctgcccgtggagtgcaagatctgcggcctgaccctggtgagcgccccccacctggccagaagctaccaccacctgttccccctggacgccttccaggagatccccctggaggagtacaacggcgagagattctgctacggctgccagggcgagctgaaggaccagcacgtgtacgtgtgcgccgtgtgccagaacgtgttctgcgtggactgcgacgtgttcgtgcacgacagcctgcactgctgccccggctgcatccacaagatccccgcccccagcggcgtgtag

SEQ ID NO: 82891 - DNA, 1188 bp, Artificial Sequence; identical to SEQ ID NO: 82888
  Description of Artificial Sequence: Synthetic coding sequence

SEQ ID NO: 82892 - DNA, 1389 bp, Artificial Sequence
  Description of Artificial Sequence: Synthetic coding sequence
atggagagcacccccagcagaggcctgaacagagtgcacctgcagtgcagaaacctgcaggagttcctgggcggcctgagccccggcgtgctggacagactgtacggccaccccgccacctgcctggccgtgttcagagagctgcccagcctggccaagaactgggtgatgagaatgctgttcctggagcagcccctgccccaggccgccgtggccctgtgggtgaagaaggagttcagcaaggcccaggaggagagcaccggcctgctgagcggcctgagaatctggcacacccagctgctgcccggcggcctgcagggcctgatcctgaaccccatcttcagacagaacctgagaatcgccctgctgggcggcggcaaggcctggagcgacgacaccagccagctgggccccgacaagcacgccagagacgtgcccagcctggacaagtacgccgaggagagatgggaggtggtgctgcacttcatggtgggcagccccagcgccgccgtgagccaggacctggcccagctgctgagccaggccggcctgatgaagagcaccgagcccggcgagcccccctgcatcaccagcgccggcttccagttcctgctgctggacacccccgcccagctgtggtacttcatgctgcagtacctgcagaccgcccagagcagaggcatggacctggtggagatcctgagcttcctgttccagctgagcttcagcaccctgggcaaggactacagcgtggagggcatgagcgacagcctgctgaacttcctgcagcacctgagagagttcggcctggtgttccagagaaagagaaagagcagaagatactaccccaccagactggccatcaacctgagcagcggcgtgagcggcgccggcggcaccgtgcaccagcccggcttcatcgtggtggagaccaactacagactgtacgcctacaccgagagcgagctgcagatcgccctgatcgccctgttcagcgagatgctgtacagattccccaacatggtggtggcccaggtgaccagagagagcgtgcagcaggccatcgccagcggcatcaccgcccagcagatcatccacttcctgagaaccagagcccaccccgtgatgctgaagcagacccccgtgctgccccccaccatcaccgaccagatcagactgtgggagctggagagagacagactgagattcaccgagggcgtgctgtacaaccagttcctgagccaggtggacttcgagctgctgctggcccacgccagagagctgggcgtgctggtgttcgagaacagcgccaagagactgatggtggtgacccccgccggccacagcgacgtgaagagattctggaagagacagaagcacagcagctag

SEQ ID NO: 82893 - DNA, 1389 bp, Artificial Sequence; identical to SEQ ID NO: 82892
  Description of Artificial Sequence: Synthetic coding sequence

SEQ ID NO: 82894 - DNA, 1389 bp, Artificial Sequence; identical to SEQ ID NO: 82892
  Description of Artificial Sequence: Synthetic coding sequence

SEQ ID NO: 82895 - DNA, 1389 bp, Artificial Sequence; identical to SEQ ID NO: 82892
  Description of Artificial Sequence: Synthetic coding sequence

SEQ ID NO: 82896 - DNA, 1389 bp, Artificial Sequence; identical to SEQ ID NO: 82892
  Description of Artificial Sequence: Synthetic coding sequence

SEQ ID NO: 82897 - DNA, 417 bp, Artificial Sequence
  Description of Artificial Sequence: Synthetic coding sequence
atggagagcacccccagcagaggcctgaacagagtgcacctgcagtgcagaaacctgcaggagttcctgggcggcctgagccccggcgtgctggacagactgtacggccaccccgccacctgcctggccgtgttcagagagctgcccagcctggccaagaactgggtgatgagaatgctgttcctggagcagcccctgccccaggccgccgtggccctgtgggtgaagaaggagttcagcaaggcccaggaggagagcaccggcctgctgagcggcctgagaatctggcacacccagctgctgcccggcggcctgcagggcctgatcctgaaccccatcttcagacagaacctgagaatcgccctgctgggcggcaccggcatcaccggcgtgagccactgcgcctggcccggctag

SEQ ID NO: 82898 - DNA, 1389 bp, Artificial Sequence; identical to SEQ ID NO: 82892
  Description of Artificial Sequence: Synthetic coding sequence

SEQ ID NO: 82899 - DNA, 417 bp, Artificial Sequence; identical to SEQ ID NO: 82897
  Description of Artificial Sequence: Synthetic coding sequence

SEQ ID NO: 82900 - DNA, 1389 bp, Artificial Sequence; identical to SEQ ID NO: 82892
  Description of Artificial Sequence: Synthetic coding sequence

SEQ ID NO: 82901 - DNA, 417 bp, Artificial Sequence; identical to SEQ ID NO: 82897
  Description of Artificial Sequence: Synthetic coding sequence

SEQ ID NO: 82902 - DNA, 1389 bp, Artificial Sequence; identical to SEQ ID NO: 82892
  Description of Artificial Sequence: Synthetic coding sequence

SEQ ID NO: 82903 - DNA, 1389 bp, Artificial Sequence; identical to SEQ ID NO: 82892
  Description of Artificial Sequence: Synthetic coding sequence

SEQ ID NO: 82904 - DNA, 1389 bp, Artificial Sequence; identical to SEQ ID NO: 82892
  Description of Artificial Sequence: Synthetic coding sequence

SEQ ID NO: 82905 - DNA, 1389 bp, Artificial Sequence; identical to SEQ ID NO: 82892
  Description of Artificial Sequence: Synthetic coding sequence

SEQ ID NO: 82906 - DNA, 417 bp, Artificial Sequence; identical to SEQ ID NO: 82897
  Description of Artificial Sequence: Synthetic coding sequence

SEQ ID NO: 82907 - DNA, 417 bp, Artificial Sequence; identical to SEQ ID NO: 82897
  Description of Artificial Sequence: Synthetic coding sequence

SEQ ID NO: 82908 - DNA, 417 bp, Artificial Sequence; identical to SEQ ID NO: 82897
  Description of Artificial Sequence: Synthetic coding sequence

SEQ ID NO: 82909 - DNA, 1389 bp, Artificial Sequence; identical to SEQ ID NO: 82892
  Description of Artificial Sequence: Synthetic coding sequence

SEQ ID NO: 82910 - DNA, 663 bp, Artificial Sequence
  Description of Artificial Sequence: Synthetic coding sequence
atgagaatgctgttcctggagcagcccctgccccaggccgccgtggccctgtgggtgaagaaggagttcagcaaggcccaggaggagagcaccggcctgctgagcggcctgagaatctggcacacccagctgctgcccggcggcctgcagggcctgatcctgaaccccatcttcagacagaacctgagaatcgccctgctgggcggcggcaaggcctggagcgacgacaccagccagctgggccccgacaagcacgccagagacgtgcccagcctggacaagtacgccgaggagagatgggaggtggtgctgcacttcatggtgggcagccccagcgccgccgtgagccaggacctggcccagctgctgagccaggccggcctgatgaagagcaccgagcccggcgagcccccctgcatcaccagcgccggcttccagttcctgctgctggacacccccgcccagctgtggtacttcatgctgcagtacctgcagaccgcccagagcagaggcatggacctggtggagatcctgagcttcctgttccagctgagcttcagcaccctgggcaaggactacagcgtggagggcatgagcgacagcctgctgaacttcctgcagcacctgagagagttcggcctggtgttccagagaaaggtgtag

SEQ ID NO: 82911 - DNA, 663 bp, Artificial Sequence; identical to SEQ ID NO: 82910
  Description of Artificial Sequence: Synthetic coding sequence

SEQ ID NO: 82912 - DNA, 663 bp, Artificial Sequence; identical to SEQ ID NO: 82910
  Description of Artificial Sequence: Synthetic coding sequence

SEQ ID NO: 82913 - DNA, 663 bp, Artificial Sequence; identical to SEQ ID NO: 82910
  Description of Artificial Sequence: Synthetic coding sequence

SEQ ID NO: 82914 - DNA, 663 bp, Artificial Sequence; identical to SEQ ID NO: 82910
  Description of Artificial Sequence: Synthetic coding sequence

SEQ ID NO: 82915 - DNA, 663 bp, Artificial Sequence; identical to SEQ ID NO: 82910
  Description of Artificial Sequence: Synthetic coding sequence

SEQ ID NO: 82916 - DNA, 216 bp, Artificial Sequence
  Description of Artificial Sequence: Synthetic coding sequence
atggtgaacgtgctgaagggcgtgctgatcgagtgcgaccccgccatgaagcagttcctgctgtacctggacgagagcaacgccctgggcaagaagttcatcatccaggacatcgacgacacccacgtgttcgtgatcgccgagctggtgaacgtgctgcaggagagagtgggcgagctgatggaccagaacgccttcagcctgacccagaagtag

SEQ ID NO: 82917 - DNA, 2997 bp, Artificial Sequence
  Description of Artificial Sequence: Synthetic coding sequence
atggcccaggtggccatgagcaccctgcccgtggaggacgaggagagcagcgagagcagaatggtggtgaccttcctgatgagcgccctggagagcatgtgcaaggagctggccaagagcaaggccgaggtggcctgcatcgccgtgtacgagaccgacgtgttcgtggtgggcaccgagagaggcagagccttcgtgaacaccagaaaggacttccagaaggacttcgtgaagtactgcgtggaggaggaggagaaggccgccgagatgcacaagatgaagagcaccacccaggccaacagaatgagcgtggacgccgtggagatcgagaccctgagaaagaccgtggaggactacttctgcttctgctacggcaaggccctgggcaagagcaccgtggtgcccgtgccctacgagaagatgctgagagaccagagcgccgtggtggtgcagggcctgcccgagggcgtggccttcaagcaccccgagaactacgacctggccaccctgaagtggatcctggagaacaaggccggcatcagcttcatcatcaagagacccttcctggagcccaagaagcacgtgggcggcagagtgatggtgaccgacgccgacagaagcatcctgagccccggcggcagctgcggccccatcaaggtgaagaccgagcccaccgaggacagcggcatcagcctggagatggccgccgtgaccgtgaaggaggagagcgaggaccccgactactaccagtacaacatccaggccggccccagcgagaccgacgacgtggacgagaagcagcccctgagcaagcccctgcagggcagccaccacagcagcgagggcaacgagggcaccgagatggaggtgcccgccgaggacagcacccagcacgtgcccagcgagaccagcgaggaccccgaggtggaggtgaccatcgaggacgacgactacagcccccccagcaagagacccaaggccaacgagctgccccagccccccgtgcccgagcccgccaacgccggcaagagaaaggtgagagagttcaacttcgagaagtggaacgccagaatcaccgacctgagaaagcaggtggaggagctgttcgagagaaagtacgcccaggccatcaaggccaagggccccgtgaccatcccctaccccctgttccagagccacgtggaggacctgtacgtggagggcctgcccgagggcatccccttcagaagacccagcacctacggcatccccagactggagagaatcctgctggccaaggagagaatcagattcgtgatcaagaagcacgagctgctgaacagcaccagagaggacctgcagctggacaagcccgccagcggcgtgaaggaggagtggtacgccagaatcaccaagctgagaaagatggtggaccagctgttctgcaagaagttcgccgaggccctgggcagcaccgaggccaaggccgtgccctaccagaagttcgaggcccaccccaacgacctgtacgtggagggcctgcccgagaacatccccttcagaagccccagctggtacggcatccccagactggagaagatcatccaggtgggcaacagaatcaagttcgtgatcaagagacccgagctgctgacccacagcaccaccgaggtgacccagcccagaaccaacacccccgtgaaggaggactggaacgtgagaatcaccaagctgagaaagcaggtggaggagatcttcaacctgaagttcgcccaggccctgggcctgaccgaggccgtgaaggtgccctaccccgtgttcgagagcaaccccgagttcctgtacgtggagggcctgcccgagggcatccccttcagaagccccacctggttcggcatccccagactggagagaatcgtgagaggcagcaacaagatcaagttcgtggtgaagaagcccgagctggtgatcagctacctgccccccggcatggccagcaagatcaacaccaaggccctgcagagccccaagagacccagaagccccggcagcaacagcaaggtgcccgagatcgaggtgaccgtggagggccccaacaacaacaacccccagaccagcgccgtgagaacccccacccagaccaacggcagcaacgtgcccttcaagcccagaggcagagagttcagcttcgaggcctggaacgccaagatcaccgacctgaagcagaaggtggagaacctgttcaacgagaagtgcggcgaggccctgggcctgaagcaggccgtgaaggtgcccttcgccctgttcgagagcttccccgaggacttctacgtggagggcctgcccgagggcgtgcccttcagaagacccagcaccttcggcatccccagactggagaagatcctgagaaacaaggccaagatcaagttcatcatcaagaagcccgagatgttcgagaccgccatcaaggagagcaccagcagcaagagcccccccagaaagatcaacagcagccccaacgtgaacaccaccgccagcggcgtggaggacctgaacatcatccaggtgaccatccccgacgacgacaacgagagactgagcaaggtggagaaggccagacagctgagagagcaggtgaacgacctgttcagcagaaagttcggcgaggccatcggcatgggcttccccgtgaaggtgccctacagaaagatcaccatcaaccccggctgcgtggtggtggacggcatgccccccggcgtgagcttcaaggcccccagctacctggagatcagcagcatgagaagaatcctggacagcgccgagttcatcaagttcaccgtgatcagacccttccccggcctggtgatcaacaaccagctggtggaccagagcgagagcgagggccccgtgatccaggagagcgccgagcccagccagctggaggtgcccgccaccgaggagatcaaggagaccgacggcagcagccagatcaagcaggagcccgaccccacctggtag

SEQ ID NO: 82918 - DNA, 2934 bp, Artificial Sequence
  Description of Artificial Sequence: Synthetic coding sequence
atggcccaggtggccatgagcaccctgcccgtggaggacgaggagagcagcgagagcagaatggtggtgaccttcctgatgagcgccctggagagcatgtgcaaggagctggccaagagcaaggccgaggtggcctgcatcgccgtgtacgagaccgacgtgttcgtggtgggcaccgagagaggcagagccttcgtgaacaccagaaaggacttccagaaggacttcgtgaagtactgcgtggaggaggaggagaaggccgccgagatgcacaagatgaagagcaccacccaggccaacagaatgagcgtggacgccgtggagatcgagaccctgagaaagaccgtggaggactacttctgcttctgctacggcaaggccctgggcaagagcaccgtggtgcccgtgccctacgagaagatgctgagagaccagagcgccgtggtggtgcagggcctgcccgagggcgtggccttcaagcaccccgagaactacgacctggccaccctgaagtggatcctggagaacaaggccggcatcagcttcatcatcaagagacccttcctggagcccaagaagcacgtgggcggcagagtgatggtgaccgacgccgacagaagcatcctgagccccggcggcagctgcggccccatcaaggtgaagaccgagcccaccgaggacagcggcatcagcctggagatggccgccgtgaccgtgaaggaggagagcgaggaccccgactactaccagtacaacatccaggccggccccagcgagaccgacgacgtggacgagaagcagcccctgagcaagcccctgcagggcagccaccacagcagcgagggcaacgagggcaccgagatggaggtgcccgccgaggacgacgactacagcccccccagcaagagacccaaggccaacgagctgccccagccccccgtgcccgagcccgccaacgccggcaagagaaaggtgagagagttcaacttcgagaagtggaacgccagaatcaccgacctgagaaagcaggtggaggagctgttcgagagaaagtacgcccaggccatcaaggccaagggccccgtgaccatcccctaccccctgttccagagccacgtggaggacctgtacgtggagggcctgcccgagggcatccccttcagaagacccagcacctacggcatccccagactggagagaatcctgctggccaaggagagaatcagattcgtgatcaagaagcacgagctgctgaacagcaccagagaggacctgcagctggacaagcccgccagcggcgtgaaggaggagtggtacgccagaatcaccaagctgagaaagatggtggaccagctgttctgcaagaagttcgccgaggccctgggcagcaccgaggccaaggccgtgccctaccagaagttcgaggcccaccccaacgacctgtacgtggagggcctgcccgagaacatccccttcagaagccccagctggtacggcatccccagactggagaagatcatccaggtgggcaacagaatcaagttcgtgatcaagagacccgagctgctgacccacagcaccaccgaggtgacccagcccagaaccaacacccccgtgaaggaggactggaacgtgagaatcaccaagctgagaaagcaggtggaggagatcttcaacctgaagttcgcccaggccctgggcctgaccgaggccgtgaaggtgccctaccccgtgttcgagagcaaccccgagttcctgtacgtggagggcctgcccgagggcatccccttcagaagccccacctggttcggcatccccagactggagagaatcgtgagaggcagcaacaagatcaagttcgtggtgaagaagcccgagctggtgatcagctacctgccccccggcatggccagcaagatcaacaccaaggccctgcagagccccaagagacccagaagccccggcagcaacagcaaggtgcccgagatcgaggtgaccgtggagggccccaacaacaacaacccccagaccagcgccgtgagaacccccacccagaccaacggcagcaacgtgcccttcaagcccagaggcagagagttcagcttcgaggcctggaacgccaagatcaccgacctgaagcagaaggtggagaacctgttcaacgagaagtgcggcgaggccctgggcctgaagcaggccgtgaaggtgcccttcgccctgttcgagagcttccccgaggacttctacgtggagggcctgcccgagggcgtgcccttcagaagacccagcaccttcggcatccccagactggagaagatcctgagaaacaaggccaagatcaagttcatcatcaagaagcccgagatgttcgagaccgccatcaaggagagcaccagcagcaagagcccccccagaaagatcaacagcagccccaacgtgaacaccaccgccagcggcgtggaggacctgaacatcatccaggtgaccatccccgacgacgacaacgagagactgagcaaggtggagaaggccagacagctgagagagcaggtgaacgacctgttcagcagaaagttcggcgaggccatcggcatgggcttccccgtgaaggtgccctacagaaagatcaccatcaaccccggctgcgtggtggtggacggcatgccccccggcgtgagcttcaaggcccccagctacctggagatcagcagcatgagaagaatcctggacagcgccgagttcatcaagttcaccgtgatcagacccttccccggcctggtgatcaacaaccagctggtggaccagagcgagagcgagggccccgtgatccaggagagcgccgagcccagccagctggaggtgcccgccaccgaggagatcaaggagaccgacggcagcagccagatcaagcaggagcccgaccccacctggtag

SEQ ID NO: 82919 - DNA, 2937 bp, Artificial Sequence
  Description of Artificial Sequence: Synthetic coding sequence
atggcccaggtggccatgagcaccctgcccgtggaggacgaggagagcagcgagagcagaatggtggtgaccttcctgatgagcgccctggagagcatgtgcaaggagctggccaagagcaaggccgaggtggcctgcatcgccgtgtacgagaccgacgtgttcgtggtgggcaccgagagaggcagagccttcgtgaacaccagaaaggacttccagaaggacttcgtgaagtactgcgtggaggaggaggagaaggccgccgagatgcacaagatgaagagcaccacccaggccaacagaatgagcgtggacgccgtggagatcgagaccctgagaaagaccgtggaggactacttctgcttctgctacggcaaggccctgggcaagagcaccgtggtgcccgtgccctacgagaagatgctgagagaccagagcgccgtggtggtgcagggcctgcccgagggcgtggccttcaagcaccccgagaactacgacctggccaccctgaagtggatcctggagaacaaggccggcatcagcttcatcatcaagagacccttcctggagcccaagaagcacgtgggcggcagagtgatggtgaccgacgccgacagaagcatcctgagccccggcggcagctgcggccccatcaaggtgaagaccgagcccaccgaggacagcggcatcagcctggagatggccgccgtgaccgtgaaggaggagagcgaggaccccgactactaccagtacaacatccagggcagccaccacagcagcgagggcaacgagggcaccgagatggaggtgcccgccgaggacagcacccagcacgtgcccagcgagaccagcgaggaccccgaggtggaggtgaccatcgaggacgacgactacagcccccccagcaagagacccaaggccaacgagctgccccagccccccgtgcccgagcccgccaacgccggcaagagaaaggtgagagagttcaacttcgagaagtggaacgccagaatcaccgacctgagaaagcaggtggaggagctgttcgagagaaagtacgcccaggccatcaaggccaagggccccgtgaccatcccctaccccctgttccagagccacgtggaggacctgtacgtggagggcctgcccgagggcatccccttcagaagacccagcacctacggcatccccagactggagagaatcctgctggccaaggagagaatcagattcgtgatcaagaagcacgagctgctgaacagcaccagagaggacctgcagctggacaagcccgccagcggcgtgaaggaggagtggtacgccagaatcaccaagctgagaaagatggtggaccagctgttctgcaagaagttcgccgaggccctgggcagcaccgaggccaaggccgtgccctaccagaagttcgaggcccaccccaacgacctgtacgtggagggcctgcccgagaacatccccttcagaagccccagctggtacggcatccccagactggagaagatcatccaggtgggcaacagaatcaagttcgtgatcaagagacccgagctgctgacccacagcaccaccgaggtgacccagcccagaaccaacacccccgtgaaggaggactggaacgtgagaatcaccaagctgagaaagcaggtggaggagatcttcaacctgaagttcgcccaggccctgggcctgaccgaggccgtgaaggtgccctaccccgtgttcgagagcaaccccgagttcctgtacgtggagggcctgcccgagggcatccccttcagaagccccacctggttcggcatccccagactggagagaatcgtgagaggcagcaacaagatcaagttcgtggtgaagaagcccgagctggtgatcagctacctgccccccggcatggccagcaagatcaacaccaaggccctgcagagccccaagagacccagaagccccggcagcaacagcaaggtgcccgagatcgaggtgaccgtggagggccccaacaacaacaacccccagaccagcgccgtgagaacccccacccagaccaacggcagcaacgtgcccttcaagcccagaggcagagagttcagcttcgaggcctggaacgccaagatcaccgacctgaagcagaaggtggagaacctgttcaacgagaagtgcggcgaggccctgggcctgaagcaggccgtgaaggtgcccttcgccctgttcgagagcttccccgaggacttctacgtggagggcctgcccgagggcgtgcccttcagaagacccagcaccttcggcatccccagactggagaagatcctgagaaacaaggccaagatcaagttcatcatcaagaagcccgagatgttcgagaccgccatcaaggagagcaccagcagcaagagcccccccagaaagatcaacagcagccccaacgtgaacaccaccgccagcggcgtggaggacctgaacatcatccaggtgaccatccccgacgacgacaacgagagactgagcaaggtggagaaggccagacagctgagagagcaggtgaacgacctgttcagcagaaagttcggcgaggccatcggcatgggcttccccgtgaaggtgccctacagaaagatcaccatcaaccccggctgcgtggtggtggacggcatgccccccggcgtgagcttcaaggcccccagctacctggagatcagcagcatgagaagaatcctggacagcgccgagttcatcaagttcaccgtgatcagacccttccccggcctggtgatcaacaaccagctggtggaccagagcgagagcgagggccccgtgatccaggagagcgccgagcccagccagctggaggtgcccgccaccgaggagatcaaggagaccgacggcagcagccagatcaagcaggagcccgaccccacctggtag

SEQ ID NO: 82920 - DNA, 2874 bp, Artificial Sequence
  Description of Artificial Sequence: Synthetic coding sequence
atggcccaggtggccatgagcaccctgcccgtggaggacgaggagagcagcgagagcagaatggtggtgaccttcctgatgagcgccctggagagcatgtgcaaggagctggccaagagcaaggccgaggtggcctgcatcgccgtgtacgagaccgacgtgttcgtggtgggcaccgagagaggcagagccttcgtgaacaccagaaaggacttccagaaggacttcgtgaagtactgcgtggaggaggaggagaaggccgccgagatgcacaagatgaagagcaccacccaggccaacagaatgagcgtggacgccgtggagatcgagaccctgagaaagaccgtggaggactacttctgcttctgctacggcaaggccctgggcaagagcaccgtggtgcccgtgccctacgagaagatgctgagagaccagagcgccgtggtggtgcagggcctgcccgagggcgtggccttcaagcaccccgagaactacgacctggccaccctgaagtggatcctggagaacaaggccggcatcagcttcatcatcaagagacccttcctggagcccaagaagcacgtgggcggcagagtgatggtgaccgacgccgacagaagcatcctgagccccggcggcagctgcggccccatcaaggtgaagaccgagcccaccgaggacagcggcatcagcctggagatggccgccgtgaccgtgaaggaggagagcgaggaccccgactactaccagtacaacatccagggcagccaccacagcagcgagggcaacgagggcaccgagatggaggtgcccgccgaggacgacgactacagcccccccagcaagagacccaaggccaacgagctgccccagccccccgtgcccgagcccgccaacgccggcaagagaaaggtgagagagttcaacttcgagaagtggaacgccagaatcaccgacctgagaaagcaggtggaggagctgttcgagagaaagtacgcccaggccatcaaggccaagggccccgtgaccatcccctaccccctgttccagagccacgtggaggacctgtacgtggagggcctgcccgagggcatccccttcagaagacccagcacctacggcatccccagactggagagaatcctgctggccaaggagagaatcagattcgtgatcaagaagcacgagctgctgaacagcaccagagaggacctgcagctggacaagcccgccagcggcgtgaaggaggagtggtacgccagaatcaccaagctgagaaagatggtggaccagctgttctgcaagaagttcgccgaggccctgggcagcaccgaggccaaggccgtgccctaccagaagttcgaggcccaccccaacgacctgtacgtggagggcctgcccgagaacatccccttcagaagccccagctggtacggcatccccagactggagaagatcatccaggtgggcaacagaatcaagttcgtgatcaagagacccgagctgctgacccacagcaccaccgaggtgacccagcccagaaccaacacccccgtgaaggaggactggaacgtgagaatcaccaagctgagaaagcaggtggaggagatcttcaacctgaagttcgcccaggccctgggcctgaccgaggccgtgaaggtgccctaccccgtgttcgagagcaaccccgagttcctgtacgtggagggcctgcccgagggcatccccttcagaagccccacctggttcggcatccccagactggagagaatcgtgagaggcagcaacaagatcaagttcgtggtgaagaagcccgagctggtgatcagctacctgccccccggcatggccagcaagatcaacaccaaggccctgcagagccccaagagacccagaagccccggcagcaacagcaaggtgcccgagatcgaggtgaccgtggagggccccaacaacaacaacccccagaccagcgccgtgagaacccccacccagaccaacggcagcaacgtgcccttcaagcccagaggcagagagttcagcttcgaggcctggaacgccaagatcaccgacctgaagcagaaggtggagaacctgttcaacgagaagtgcggcgaggccctgggcctgaagcaggccgtgaaggtgcccttcgccctgttcgagagcttccccgaggacttctacgtggagggcctgcccgagggcgtgcccttcagaagacccagcaccttcggcatccccagactggagaagatcctgagaaacaaggccaagatcaagttcatcatcaagaagcccgagatgttcgagaccgccatcaaggagagcaccagcagcaagagcccccccagaaagatcaacagcagccccaacgtgaacaccaccgccagcggcgtggaggacctgaacatcatccaggtgaccatccccgacgacgacaacgagagactgagcaaggtggagaaggccagacagctgagagagcaggtgaacgacctgttcagcagaaagttcggcgaggccatcggcatgggcttccccgtgaaggtgccctacagaaagatcaccatcaaccccggctgcgtggtggtggacggcatgccccccggcgtgagcttcaaggcccccagctacctggagatcagcagcatgagaagaatcctggacagcgccgagttcatcaagttcaccgtgatcagacccttccccggcctggtgatcaacaaccagctggtggaccagagcgagagcgagggccccgtgatccaggagagcgccgagcccagccagctggaggtgcccgccaccgaggagatcaaggagaccgacggcagcagccagatcaagcaggagcccgaccccacctggtag

SEQ ID NO: 82921 - DNA, 321 bp, Artificial Sequence
  Description of Artificial Sequence: Synthetic coding sequence
atggcccaggtggccatgagcaccctgcccgtggaggacgaggagagcagcgagagcagaatggtggtgaccttcctgatgagcgccctggagagcatgtgcaaggagctggccaagagcaaggccgaggtggcctgcatcgccgtgtacgagaccgacgtgttcgtggtgggcaccgagagaggcagagccttcgtgaacaccagaaaggacttccagaaggacttcgtgaagtactgcgtggaggaggaggagaaggccgccgagatgcacaagatgaagagcaccacccaggccaacagaatgagcgtggacgcctag

SEQ ID NO: 82922 - DNA, 825 bp, Artificial Sequence
  Description of Artificial Sequence: Synthetic coding sequence
atggcccaggtggccatgagcaccctgcccgtggaggacgaggagagcagcgagagcagaatggtggtgaccttcctgatgagcgccctggagagcatgtgcaaggagctggccaagagcaaggccgaggtggcctgcatcgccgtgtacgagaccgacgtgttcgtggtgggcaccgagagaggcagagccttcgtgaacaccagaaaggacttccagaaggacttcgtgaagtactgcgtggaggaggaggagaaggccgccgagatgcacaagatgaagagcaccacccaggccaacagaatgagcgtggacgccgtggagatcgagaccctgagaaagaccgtggaggactacttctgcttctgctacggcaaggccctgggcaagagcaccgtggtgcccgtgccctacgagaagatgctgagagaccagagcgccgtggtggtgcagggcctgcccgagggcgtggccttcaagcaccccgagaactacgacctggccaccctgaagtggatcctggagaacaaggccggcatcagcttcatcatcaagagacccttcctggagcccaagaagcacgtgggcggcagagtgatggtgaccgacgccgacagaagcatcctgagccccggcggcagctgcggccccatcaaggtgaagaccgagcccaccgaggacagcggcatcagcctggagatggccgccgtgaccgtgaaggaggagagcgaggaccccgactactaccagtacaacatccagggcagccaccacagcagcgagggcaacgagggcaccgagatggaggtgcccgccgagggctag

SEQ ID NO: 82923 - DNA, 2982 bp, Artificial Sequence
  Description of Artificial Sequence: Synthetic coding sequence
atgagcaccctgcccgtggaggacgaggagagcagcgagagcagaatggtggtgaccttcctgatgagcgccctggagagcatgtgcaaggagctggccaagagcaaggccgaggtggcctgcatcgccgtgtacgagaccgacgtgttcgtggtgggcaccgagagaggcagagccttcgtgaacaccagaaaggacttccagaaggacttcgtgaagtactgcgtggaggaggaggagaaggccgccgagatgcacaagatgaagagcaccacccaggccaacagaatgagcgtggacgccgtggagatcgagaccctgagaaagaccgtggaggactacttctgcttctgctacggcaaggccctgggcaagagcaccgtggtgcccgtgccctacgagaagatgctgagagaccagagcgccgtggtggtgcagggcctgcccgagggcgtggccttcaagcaccccgagaactacgacctggccaccctgaagtggatcctggagaacaaggccggcatcagcttcatcatcaagagacccttcctggagcccaagaagcacgtgggcggcagagtgatggtgaccgacgccgacagaagcatcctgagccccggcggcagctgcggccccatcaaggtgaagaccgagcccaccgaggacagcggcatcagcctggagatggccgccgtgaccgtgaaggaggagagcgaggaccccgactactaccagtacaacatccaggccggccccagcgagaccgacgacgtggacgagaagcagcccctgagcaagcccctgcagggcagccaccacagcagcgagggcaacgagggcaccgagatggaggtgcccgccgaggacagcacccagcacgtgcccagcgagaccagcgaggaccccgaggtggaggtgaccatcgaggacgacgactacagcccccccagcaagagacccaaggccaacgagctgccccagccccccgtgcccgagcccgccaacgccggcaagagaaaggtgagagagttcaacttcgagaagtggaacgccagaatcaccgacctgagaaagcaggtggaggagctgttcgagagaaagtacgcccaggccatcaaggccaagggccccgtgaccatcccctaccccctgttccagagccacgtggaggacctgtacgtggagggcctgcccgagggcatccccttcagaagacccagcacctacggcatccccagactggagagaatcctgctggccaaggagagaatcagattcgtgatcaagaagcacgagctgctgaacagcaccagagaggacctgcagctggacaagcccgccagcggcgtgaaggaggagtggtacgccagaatcaccaagctgagaaagatggtggaccagctgttctgcaagaagttcgccgaggccctgggcagcaccgaggccaaggccgtgccctaccagaagttcgaggcccaccccaacgacctgtacgtggagggcctgcccgagaacatccccttcagaagccccagctggtacggcatccccagactggagaagatcatccaggtgggcaacagaatcaagttcgtgatcaagagacccgagctgctgacccacagcaccaccgaggtgacccagcccagaaccaacacccccgtgaaggaggactggaacgtgagaatcaccaagctgagaaagcaggtggaggagatcttcaacctgaagttcgcccaggccctgggcctgaccgaggccgtgaaggtgccctaccccgtgttcgagagcaaccccgagttcctgtacgtggagggcctgcccgagggcatccccttcagaagccccacctggttcggcatccccagactggagagaatcgtgagaggcagcaacaagatcaagttcgtggtgaagaagcccgagctggtgatcagctacctgccccccggcatggccagcaagatcaacaccaaggccctgcagagccccaagagacccagaagccccggcagcaacagcaaggtgcccgagatcgaggtgaccgtggagggccccaacaacaacaacccccagaccagcgccgtgagaacccccacccagaccaacggcagcaacgtgcccttcaagcccagaggcagagagttcagcttcgaggcctggaacgccaagatcaccgacctgaagcagaaggtggagaacctgttcaacgagaagtgcggcgaggccctgggcctgaagcaggccgtgaaggtgcccttcgccctgttcgagagcttccccgaggacttctacgtggagggcctgcccgagggcgtgcccttcagaagacccagcaccttcggcatccccagactggagaagatcctgagaaacaaggccaagatcaagttcatcatcaagaagcccgagatgttcgagaccgccatcaaggagagcaccagcagcaagagcccccccagaaagatcaacagcagccccaacgtgaacaccaccgccagcggcgtggaggacctgaacatcatccaggtgaccatccccgacgacgacaacgagagactgagcaaggtggagaaggccagacagctgagagagcaggtgaacgacctgttcagcagaaagttcggcgaggccatcggcatgggcttccccgtgaaggtgccctacagaaagatcaccatcaaccccggctgcgtggtggtggacggcatgccccccggcgtgagcttcaaggcccccagctacctggagatcagcagcatgagaagaatcctggacagcgccgagttcatcaagttcaccgtgatcagacccttccccggcctggtgatcaacaaccagctggtggaccagagcgagagcgagggccccgtgatccaggagagcgccgagcccagccagctggaggtgcccgccaccgaggagatcaaggagaccgacggcagcagccagatcaagcaggagcccgaccccacctggtag

SEQ ID NO: 82924 - DNA, 642 bp, Artificial Sequence
  Description of Artificial Sequence: Synthetic coding sequence
atggccgccgccgccgacgagagaagccccgaggacggcgaggacgaggaggaggaggagcagctggtgctggtggagctgagcggcatcatcgacagcgacttcctgagcaagtgcgagaacaagtgcaaggtgctgggcatcgacaccgagagacccatcctgcaggtggacagctgcgtgttcgccggcgagtacgaggacaccctgggcacctgcgtgatcttcgaggagaacgtggagcacgccgacaccgagggcaacaacaagaccgtgctgaagtacaagtgccacaccatgaagaagctgagcatgaccagaaccctgctgaccgagaagaaggagggcgaggagaacatcggcggcgtggagtggctgcagatcaaggacaacgacttcagctacagacccaacatgatctgcaacttcctgcacgagaacgaggacgaggaggtggtggccagcgcccccgacaagagcctggagctggaggaggaggagatccagatgaacgacagcagcaacctgagctgcgagcaggagaagcccatgcacctggagatcgaggacagcggccccctgatcgacatccccagcgagaccgagggcagcgtgttcatggagacccagatgctgccctag

SEQ ID NO: 82925 - DNA, 2118 bp, Artificial Sequence
  Description of Artificial Sequence: Synthetic coding sequence
atggccaccgagggcatgatcctgaccaaccacgaccaccagatcagagtgggcgtgctgaccgtgagcgacagctgcttcagaaacctggccgaggacagaagcggcatcaacctgaaggacctggtgcaggaccccagcctgctgggcggcaccatcagcgcctacaagatcgtgcccgacgagatcgaggagatcaaggccaccaaggaggtgatcgagagagaggcccccggcatggccctggccatgctgatgggcagcctgaacgtgacccccctgggcatgctgagcagacccgtgtgcggcatcagaggcaagaccctgatcatcaacctgcccggcagcaagaagggcagccaggagtgcttccagttcatcctgcccgccctgccccacgccatcgacctgctgagagacgccatcgtgaaggtgaaggaggtgcacgacgagctggaggacctgcccagcccccccccccccctgagccccccccccaccaccagcccccacaagcagaccgaggacaagggcgtgcagtgcgaggaggaggaggaggagaagaaggacagcggcgtggccagcaccgaggacagcagcagcagccacatcaccgccgccgccatcgccgccaagatccccgacagcatcatcagcagaggcgtgcaggtgctgcccagagacaccgccagcctgagcaccacccccagcgagagccccagagcccaggccaccagcagactgagcaccgccagctgccccacccccaaggtgcagagcagatgcagcagcaaggagaacatcctgagagccagccacagcgccgtggacatcaccaaggtggccagaagacacagaatgagccccttccccctgaccagcatggacaaggccttcatcaccgtgctggagatgacccccgtgctgggcaccgagatcatcaactacagagacggcatgggcagagtgctggcccaggacgtgtacgccaaggacaacctgccccccttccccgccagcgtgaaggacggctacgccgtgagagccgccgacggccccggcgacagattcatcatcggcgagagccaggccggcgagcagcccacccagaccgtgatgcccggccaggtgatgagagtgaccaccggcgcccccatcccctgcggcgccgacgccgtggtgcaggtggaggacaccgagctgatcagagagagcgacgacggcaccgaggagctggaggtgagaatcctggtgcaggccagacccggccaggacatcagacccatcggccacgacatcaagagaggcgagtgcgtgctggccaagggcacccacatgggccccagcgagatcggcctgctggccaccgtgggcgtgaccgaggtggaggtgaacaagttccccgtggtggccgtgatgagcaccggcaacgagctgctgaaccccgaggacgacctgctgcccggcaagatcagagacagcaacagaagcaccctgctggccaccatccaggagcacggctaccccaccatcaacctgggcatcgtgggcgacaaccccgacgacctgctgaacgccctgaacgagggcatcagcagagccgacgtgatcatcaccagcggcggcgtgagcatgggcgagaaggactacctgaagcaggtgctggacatcgacctgcacgcccagatccacttcggcagagtgttcatgaagcccggcctgcccaccaccttcgccaccctggacatcgacggcgtgagaaagatcatcttcgccctgcccggcaaccccgtgagcgccgtggtgacctgcaacctgttcgtggtgcccgccctgagaaagatgcagggcatcctggaccccagacccaccatcatcaaggccagactgagctgcgacgtgaagctggaccccagacccgagtaccacagatgcatcctgacctggcaccaccaggagcccctgccctgggcccagagcaccggcaaccagatgagcagcagactgatgagcatgagaagcgccaacggcctgctgatgctgccccccaagaccgagcagtacgtggagctgcacaagggcgaggtggtggacgtgatggtgatcggcagactgtag

SEQ ID NO: 82926 - DNA, 2211 bp, Artificial Sequence
  Description of Artificial Sequence: Synthetic coding sequence
atggccaccgagggcatgatcctgaccaaccacgaccaccagatcagagtgggcgtgctgaccgtgagcgacagctgcttcagaaacctggccgaggacagaagcggcatcaacctgaaggacctggtgcaggaccccagcctgctgggcggcaccatcagcgcctacaagatcgtgcccgacgagatcgaggagatcaaggagaccctgatcgactggtgcgacgagaaggagctgaacctgatcctgaccaccggcggcaccggcttcgcccccagagacgtgacccccgaggccaccaaggaggtgatcgagagagaggcccccggcatggccctggccatgctgatgggcagcctgaacgtgacccccctgggcatgctgagcagacccgtgtgcggcatcagaggcaagaccctgatcatcaacctgcccggcagcaagaagggcagccaggagtgcttccagttcatcctgcccgccctgccccacgccatcgacctgctgagagacgccatcgtgaaggtgaaggaggtgcacgacgagctggaggacctgcccagcccccccccccccctgagccccccccccaccaccagcccccacaagcagaccgaggacaagggcgtgcagtgcgaggaggaggaggaggagaagaaggacagcggcgtggccagcaccgaggacagcagcagcagccacatcaccgccgccgccatcgccgccaagatccccgacagcatcatcagcagaggcgtgcaggtgctgcccagagacaccgccagcctgagcaccacccccagcgagagccccagagcccaggccaccagcagactgagcaccgccagctgccccacccccaaggtgcagagcagatgcagcagcaaggagaacatcctgagagccagccacagcgccgtggacatcaccaaggtggccagaagacacagaatgagccccttccccctgaccagcatggacaaggccttcatcaccgtgctggagatgacccccgtgctgggcaccgagatcatcaactacagagacggcatgggcagagtgctggcccaggacgtgtacgccaaggacaacctgccccccttccccgccagcgtgaaggacggctacgccgtgagagccgccgacggccccggcgacagattcatcatcggcgagagccaggccggcgagcagcccacccagaccgtgatgcccggccaggtgatgagagtgaccaccggcgcccccatcccctgcggcgccgacgccgtggtgcaggtggaggacaccgagctgatcagagagagcgacgacggcaccgaggagctggaggtgagaatcctggtgcaggccagacccggccaggacatcagacccatcggccacgacatcaagagaggcgagtgcgtgctggccaagggcacccacatgggccccagcgagatcggcctgctggccaccgtgggcgtgaccgaggtggaggtgaacaagttccccgtggtggccgtgatgagcaccggcaacgagctgctgaaccccgaggacgacctgctgcccggcaagatcagagacagcaacagaagcaccctgctggccaccatccaggagcacggctaccccaccatcaacctgggcatcgtgggcgacaaccccgacgacctgctgaacgccctgaacgagggcatcagcagagccgacgtgatcatcaccagcggcggcgtgagcatgggcgagaaggactacctgaagcaggtgctggacatcgacctgcacgcccagatccacttcggcagagtgttcatgaagcccggcctgcccaccaccttcgccaccctggacatcgacggcgtgagaaagatcatcttcgccctgcccggcaaccccgtgagcgccgtggtgacctgcaacctgttcgtggtgcccgccctgagaaagatgcagggcatcctggaccccagacccaccatcatcaaggccagactgagctgcgacgtgaagctggaccccagacccgagtaccacagatgcatcctgacctggcaccaccaggagcccctgccctgggcccagagcaccggcaaccagatgagcagcagactgatgagcatgagaagcgccaacggcctgctgatgctgccccccaagaccgagcagtacgtggagctgcacaagggcgaggtggtggacgtgatggtgatcggcagactgtag

SEQ ID NO: 82927 - DNA, 2310 bp, Artificial Sequence
  Description of Artificial Sequence: Synthetic coding sequence
atggccaccgagggcatgatcctgaccaaccacgaccaccagatcagagtgggcgtgctgaccgtgagcgacagctgcttcagaaacctggccgaggacagaagcggcatcaacctgaaggacctggtgcaggaccccagcctgctgggcggcaccatcagcgcctacaagatcgtgcccgacgagatcgaggagatcaaggagaccctgatcgactggtgcgacgagaaggagctgaacctgatcctgaccaccggcggcaccggcttcgcccccagagacgtgacccccgaggccaccaaggaggtgatcgagagagaggcccccggcatggccctggccatgctgatgggcagcctgaacgtgacccccctgggcatgctgagcagacccgtgtgcggcatcagaggcaagaccctgatcatcaacctgcccggcagcaagaagggcagccaggagtgcttccagttcatcctgcccgccctgccccacgccatcgacctgctgagagacgccatcgtgaaggtgaaggaggtgcacgacgagctggaggacctgcccagcccccccccccccctgagccccccccccaccaccagcccccacaagcagaccgaggacaagggcgtgcagtgcgaggaggaggaggaggagaagaaggacagcggcgtggccagcaccgaggacagcagcagcagccacatcaccgccgccgccatcgccgccaagaagcaccccttctacaccagccccgccgtggtgatggcccacggcgagcagcccatccccggcctgatcaactacagccaccacagcaccgacgagagaatccccgacagcatcatcagcagaggcgtgcaggtgctgcccagagacaccgccagcctgagcaccacccccagcgagagccccagagcccaggccaccagcagactgagcaccgccagctgccccacccccaaggtgcagagcagatgcagcagcaaggagaacatcctgagagccagccacagcgccgtggacatcaccaaggtggccagaagacacagaatgagccccttccccctgaccagcatggacaaggccttcatcaccgtgctggagatgacccccgtgctgggcaccgagatcatcaactacagagacggcatgggcagagtgctggcccaggacgtgtacgccaaggacaacctgccccccttccccgccagcgtgaaggacggctacgccgtgagagccgccgacggccccggcgacagattcatcatcggcgagagccaggccggcgagcagcccacccagaccgtgatgcccggccaggtgatgagagtgaccaccggcgcccccatcccctgcggcgccgacgccgtggtgcaggtggaggacaccgagctgatcagagagagcgacgacggcaccgaggagctggaggtgagaatcctggtgcaggccagacccggccaggacatcagacccatcggccacgacatcaagagaggcgagtgcgtgctggccaagggcacccacatgggccccagcgagatcggcctgctggccaccgtgggcgtgaccgaggtggaggtgaacaagttccccgtggtggccgtgatgagcaccggcaacgagctgctgaaccccgaggacgacctgctgcccggcaagatcagagacagcaacagaagcaccctgctggccaccatccaggagcacggctaccccaccatcaacctgggcatcgtgggcgacaaccccgacgacctgctgaacgccctgaacgagggcatcagcagagccgacgtgatcatcaccagcggcggcgtgagcatgggcgagaaggactacctgaagcaggtgctggacatcgacctgcacgcccagatccacttcggcagagtgttcatgaagcccggcctgcccaccaccttcgccaccctggacatcgacggcgtgagaaagatcatcttcgccctgcccggcaaccccgtgagcgccgtggtgacctgcaacctgttcgtggtgcccgccctgagaaagatgcagggcatcctggaccccagacccaccatcatcaaggccagactgagctgcgacgtgaagctggaccccagacccgagtaccacagatgcatcctgacctggcaccaccaggagcccctgccctgggcccagagcaccggcaaccagatgagcagcagactgatgagcatgagaagcgccaacggcctgctgatgctgccccccaagaccgagcagtacgtggagctgcacaagggcgaggtggtggacgtgatggtgatcggcagactgtag

SEQ ID NO: 82928 - DNA, 903 bp, Artificial Sequence
  Description of Artificial Sequence: Synthetic coding sequence
atggagaagacccaggagaccgtgcagagaatcctgctggagccctacaagtacctgctgcagctgcccggcaagcaggtgagaaccaagctgagccaggccttcaaccactggctgaaggtgcccgaggacaagctgcagatcatcatcgaggtgaccgagatgctgcacaacgccagcctgctgatcgacgacatcgaggacaacagcaagctgagaagaggcttccccgtggcccacagcatctacggcatccccagcgtgatcaacagcgccaactacgtgtacttcctgggcctggagaaggtgctgaccctggaccaccccgacgccgtgaagctgttcaccagacagctgctggagctgcaccagggccagggcctggacatctactggagagacaactacacctgccccaccgaggaggagtacaaggccatggtgctgcagaagaccggcggcctgttcggcctggccgtgggcctgatgcagctgttcagcgactacaaggaggacctgaagcccctgctgaacaccctgggcctgttcttccagatcagagacgactacgccaacctgcacagcaaggagtacagcgagaacaagagcttctgcgaggacctgaccgagggcaagttcagcttccccaccatccacgccatctggagcagacccgagagcacccaggtgcagaacatcctgagacagagaaccgagaacatcgacatcaagaagtactgcgtgcactacctggaggacgtgggcagcttcgagtacaccagaaacaccctgaaggagctggaggccaaggcctacaagcagatcgacgccagaggcggcaaccccgagctggtggccctggtgaagcacctgagcaagatgttcaaggaggagaacgagtag

SEQ ID NO: 82929 - DNA, 903 bp, Artificial Sequence; identical to SEQ ID NO: 82928
  Description of Artificial Sequence: Synthetic coding sequence

SEQ ID NO: 82930 - DNA, 729 bp, Artificial Sequence
  Description of Artificial Sequence: Synthetic coding sequence
atggagaagacccaggagaccgtgcagagaatcctgctggagccctacaagtacctgctgcagctgcccggcaagcaggtgagaaccaagctgagccaggccttcaaccactggctgaaggtgcccgaggacaagctgcagatcatcatcgaggtgaccgagatgctgcacaacgccagcctgctgatcgacgacatcgaggacaacagcaagctgagaagaggcttccccgtggcccacagcatctacggcatccccagcgtgatcaacagcgccaactacgtgtacttcctgggcctggagaaggtgctgaccctggaccaccccgacgccgtgaagctgttcaccagacagctgctggagctgcaccagggccagggcctggacatctactggagagacaactacacctgccccaccgaggaggagtacaaggccatggtgctgcagaagaccggcggcctgttcggcctggccgtgggcctgatgcagctgttcagcgactacaaggaggacctgaagcccctgctgaacaccctgggcctgttcttccagatcagagacgactacgccaacctgcacagcaaggagtacagcgagaacaagagcttctgcgaggacctgaccgagggcaagttcagcttccccaccatccacgccatctggagcagacccgagagcacccaggtgcagaacatcctgagacagagaaccgagaacatcgactag

SEQ ID NO: 82931 - DNA, 903 bp, Artificial Sequence; identical to SEQ ID NO: 82928
  Description of Artificial Sequence: Synthetic coding sequence

SEQ ID NO: 82932 - DNA, 903 bp, Artificial Sequence; identical to SEQ ID NO: 82928
  Description of Artificial Sequence: Synthetic coding sequence

SEQ ID NO: 82933 - DNA, 693 bp, Artificial Sequence
  Description of Artificial Sequence: Synthetic coding sequence
atggagaagacccaggagaccgtgcagagaatcctgctggagccctacaagtacctgctgcagctgcccggcaagcaggtgagaaccaagctgagccaggccttcaaccactggctgaaggtgcccgaggacaagctgcagatcatcatcgaggtgaccgagatgctgcacaacgccagcctgctgatcgacgacatcgaggacaacagcaagctgagaagaggcttccccgtggcccacagcatctacggcatccccagcgtgatcaacagcgccaactacgtgtacttcctgggcctggagaaggtgctgaccctggaccaccccgacgccgtgaagctgttcaccagacagctgctggagctgcaccagggccagggcctggacatctactggagagacaactacacctgccccaccgaggaggagtacaaggccatggtgctgcagaagaccggcggcctgttcggcctggccgtgggcctgatgcagctgttcagcgactacaaggaggacctgaagcccctgctgaacaccctgggcctgttcttccagatcagagacgactacgccaacctgcacagcaaggagtacagcgagaacaagagcttctgcgaggacctgaccgagggcaagttcagcttccccaccatccacgccatctggagcagacccgagagcacccaggtgtag

SEQ ID NO: 82934 - DNA, 537 bp, Artificial Sequence
  Description of Artificial Sequence: Synthetic coding sequence
atgggcaacagcctgctgagagagaacagaagacagcagaacacccaggagatgccctggaacgtgagaatgcagagccccaagcagagaaccagcagatgctgggaccaccacatcgccgagggctgcttctgcctgccctggaagaagatcctgatcttcgagaagagacaggacagccagaacgagaacgagagaatgagcagcacccccatccaggacaacgtggaccagacctacagcgaggagctgtgctacaccctgatcaaccacagagtgctgtgcaccagacccagcggcaacagcgccgaggagtactacgagaacgtgccctgcaaggccgagagacccagagagagcctgggcggcaccgagaccgagtacagcctgctgcacatgcccagcaccgaccccagacacgccagaagccccgaggacgagtacgagctgctgatgccccacagaatcagcagccacttcctgcagcagcccagacccctgatggcccccagcgagacccagttcagccacctgtag

SEQ ID NO: 82935 - DNA, 492 bp, Artificial Sequence
  Description of Artificial Sequence: Synthetic coding sequence
atgggcaacagcctgctgagagagaacagaagacagcagaacacccaggagatgccctggaacgtgagaatgcagagccccaagcagagaaccagcagaaagaagatcctgatcttcgagaagagacaggacagccagaacgagaacgagagaatgagcagcacccccatccaggacaacgtggaccagacctacagcgaggagctgtgctacaccctgatcaaccacagagtgctgtgcaccagacccagcggcaacagcgccgaggagtactacgagaacgtgccctgcaaggccgagagacccagagagagcctgggcggcaccgagaccgagtacagcctgctgcacatgcccagcaccgaccccagacacgccagaagccccgaggacgagtacgagctgctgatgccccacagaatcagcagccacttcctgcagcagcccagacccctgatggcccccagcgagacccagttcagccacctgtag

SEQ ID NO: 82936 - DNA, 543 bp, Artificial Sequence
  Description of Artificial Sequence: Synthetic coding sequence
atgggcaacagcctgctgagagagaacagcttcagaagacagcagaacacccaggagatgccctggaacgtgagaatgcagagccccaagcagagaaccagcagatgctgggaccaccacatcgccgagggctgcttctgcctgccctggaagaagatcctgatcttcgagaagagacaggacagccagaacgagaacgagagaatgagcagcacccccatccaggacaacgtggaccagacctacagcgaggagctgtgctacaccctgatcaaccacagagtgctgtgcaccagacccagcggcaacagcgccgaggagtactacgagaacgtgccctgcaaggccgagagacccagagagagcctgggcggcaccgagaccgagtacagcctgctgcacatgcccagcaccgaccccagacacgccagaagccccgaggacgagtacgagctgctgatgccccacagaatcagcagccacttcctgcagcagcccagacccctgatggcccccagcgagacccagttcagccacctgtag

SEQ ID NO: 82937 - DNA, 351 bp, Artificial Sequence
  Description of Artificial Sequence: Synthetic coding sequence
atgcccagccccggcaccgtgtgcagcctgctgctgctgggcatgctgtggctggacctggccatggccggcagcagcttcctgagccccgagcaccagagagtgcagagaaaggagagcaagaagccccccgccaagctgcagcccagagccctggccggctggctgagacccgaggacggcggccaggccgagggcgccgaggacgagctggaggtgagattcaacgcccccttcgacgtgggcatcaagctgagcggcgtgcagtaccagcagcacagccaggccctgggcaagttcctgcaggacatcctgtgggaggaggccaaggaggcccccgccgacaagtag

SEQ ID NO: 82938 - DNA, 354 bp, Artificial Sequence
  Description of Artificial Sequence: Synthetic coding sequence
atgcccagccccggcaccgtgtgcagcctgctgctgctgggcatgctgtggctggacctggccatggccggcagcagcttcctgagccccgagcaccagagagtgcagcagagaaaggagagcaagaagccccccgccaagctgcagcccagagccctggccggctggctgagacccgaggacggcggccaggccgagggcgccgaggacgagctggaggtgagattcaacgcccccttcgacgtgggcatcaagctgagcggcgtgcagtaccagcagcacagccaggccctgggcaagttcctgcaggacatcctgtgggaggaggccaaggaggcccccgccgacaagtag

SEQ ID NO: 82939 - DNA, 276 bp, Artificial Sequence
  Description of Artificial Sequence: Synthetic coding sequence
atgcccagccccggcaccgtgtgcagcctgctgctgctgggcatgctgtggctggacctggccatggccggcagcagcttcctgagccccgagcaccagagagtgcagcagagaaaggagagcaagaagccccccgccaagctgcagcccagagccctggccggctggctgagacccgaggacggcggccaggccgagggcgccgaggacgagctggaggtgagaagaccccagcccaccagcgacagaccccaggccctgctgaccagcctgtag

SEQ ID NO: 82940 - DNA, 102 bp, Artificial Sequence
  Description of Artificial Sequence: Synthetic coding sequence
atgcccagccccggcaccgtgtgcagcctgctgctgctgggcatgctgtggctggacctggccatggccggcagcagcttcctgagccccgagcaccagtag

SEQ ID NO: 82941 - DNA, 354 bp, Artificial Sequence; identical to SEQ ID NO: 82938
  Description of Artificial Sequence: Synthetic coding sequence

SEQ ID NO: 82942 - DNA, 351 bp, Artificial Sequence; identical to SEQ ID NO: 82937
  Description of Artificial Sequence: Synthetic coding sequence

SEQ ID NO: 82943 - DNA, 318 bp, Artificial Sequence
  Description of Artificial Sequence: Synthetic coding sequence
atgttcacctgctggtggagctacctgagaagcaccctggccgccgtgcccggcgaggccagcagagtgcagcagagaaaggagagcaagaagccccccgccaagctgcagcccagagccctggccggctggctgagacccgaggacggcggccaggccgagggcgccgaggacgagctggaggtgagattcaacgcccccttcgacgtgggcatcaagctgagcggcgtgcagtaccagcagcacagccaggccctgggcaagttcctgcaggacatcctgtgggaggaggccaaggaggcccccgccgacaagtag

SEQ ID NO: 82944 - DNA, 201 bp, Artificial Sequence
  Description of Artificial Sequence: Synthetic coding sequence
atgttcacctgctggtggagctacctgagaagcaccctggccgccgtgcccggcgaggccagcagagtgcagttcaacgcccccttcgacgtgggcatcaagctgagcggcgtgcagtaccagcagcacagccaggccctgggcaagttcctgcaggacatcctgtgggaggaggccaaggaggcccccgccgacaagtag

SEQ ID NO: 82945 - DNA, 315 bp, Artificial Sequence
  Description of Artificial Sequence: Synthetic coding sequence
atgttcacctgctggtggagctacctgagaagcaccctggccgccgtgcccggcgaggccagcagagtgcagagaaaggagagcaagaagccccccgccaagctgcagcccagagccctggccggctggctgagacccgaggacggcggccaggccgagggcgccgaggacgagctggaggtgagattcaacgcccccttcgacgtgggcatcaagctgagcggcgtgcagtaccagcagcacagccaggccctgggcaagttcctgcaggacatcctgtgggaggaggccaaggaggcccccgccgacaagtag

SEQ ID NO: 82946 - DNA, 351 bp, Artificial Sequence; identical to SEQ ID NO: 82937
  Description of Artificial Sequence: Synthetic coding sequence

SEQ ID NO: 82947 - DNA, 354 bp, Artificial Sequence; identical to SEQ ID NO: 82938
  Description of Artificial Sequence: Synthetic coding sequence

SEQ ID NO: 82948 - DNA, 354 bp, Artificial Sequence; identical to SEQ ID NO: 82938
  Description of Artificial Sequence: Synthetic coding sequence

SEQ ID NO: 82949 - DNA, 1794 bp, Artificial Sequence
  Description of Artificial Sequence: Synthetic coding sequence
atggccgagggcagcgccgtgagcgacccccagcacgccgccagactgctgagagccctgagcagcttcagagaggagagcagattctgcgacgcccacctggtgctggacggcgaggagatccccgtgcagaagaacatcctggccgccgccagcccctacatcagaaccaagctgaactacaacccccccaaggacgacggcagcacctacaagatcgagctggagggcatcagcgtgatggtgatgagagagatcctggactacatcttcagcggccagatcagactgaacgaggacaccatccaggacgtggtgcaggccgccgacctgctgctgctgaccgacctgaagaccctgtgctgcgagttcctggagggctgcatcgccgccgagaactgcatcggcatcagagacttcgccctgcactactgcctgcaccacgtgcactacctggccaccgagtacctggagacccacttcagagacgtgagcagcaccgaggagttcctggagctgagcccccagaagctgaaggaggtgatcagcctggagaagctgaacgtgggcaacgagagatacgtgttcgaggccgtgatcagatggatcgcccacgacaccgagatcagaaaggtgcacatgaaggacgtgatgagcgccctgtgggtgagcggcctggacagcagctacctgagagagcagatgctgaacgagcccctggtgagagagatcgtgaaggagtgcagcaacatccccctgagccagccccagcagggcgaggccatgctggccaacttcaagcccagaggctacagcgagtgcatcgtgaccgtgggcggcgaggagagagtgagcagaaagcccaccgccgccatgagatgcatgtgccccctgtacgaccccaacagacagctgtggatcgagctggcccccctgagcatgcccagaatcaaccacggcgtgctgagcgccgagggcttcctgttcgtgttcggcggccaggacgagaacaagcagaccctgagcagcggcgagaagtacgaccccgacgccaacacctggaccgccctgccccccatgaacgaggccagacacaacttcggcatcgtggagatcgacggcatgctgtacatcctgggcggcgaggacggcgagaaggagctgatcagcatggagtgctacgacatctacagcaagacctggaccaagcagcccgacctgaccatggtgagaaagatcggctgctacgccgccatgaagaagaagatctacgccatgggcggcggcagctacggcaagctgttcgagagcgtggagtgctacgaccccagaacccagcagtggaccgccatctgccccctgaaggagagaagattcggcgccgtggcctgcggcgtggccatggagctgtacgtgttcggcggcgtgagaagcagagaggacgcccagggcagcgagatggtgacctgcaagagcgagttctaccacgacgagttcaagagatggatctacctgaacgaccagaacctgtgcatccccgccagcagcagcttcgtgtacggcgccgtgcccatcggcgccagcatctacgtgatcggcgacctggacaccggcaccaactacgactacgtgagagagttcaagagaagcaccggcacctggcaccacaccaagcccctgctgcccagcgacctgagaagaaccggctgcgccgccctgagaatcgccaactgcaagctgttcagactgcagctgcagcagggcctgttcagaatcagagtgcacagcccctag

SEQ ID NO: 82950 - DNA, 591 bp, Artificial Sequence
  Description of Artificial Sequence: Synthetic coding sequence
atgttctgcgagaaggccatggagctgatcagagagctgcacagagcccccgagggccagctgcccgccttcaacgaggacggcctgagacaggtgctggaggagatgaaggccctgtacgagcagaaccagagcgacgtgaacgaggccaagagcggcggcagaagcgacctgatccccaccatcaagttcagacactgcagcctgctgagaaacagaagatgcaccgtggcctacctgtacgacagactgctgagaatcagagccctgagatgggagtacggcagcgtgctgcccaacgccctgagattccacatggccgccgaggagatggagtggttcaacaactacaagagaagcctggccacctacatgagaagcctgggcggcgacgagggcctggacatcacccaggacatgaagccccccaagagcctgtacatcgaggtgagatgcctgaaggactacggcgagttcgaggtggacgacggcaccagcgtgctgctgaagaagaacagccagcacttcctgcccagatggaagtgcgagcagctgatcagacagggcgtgctggagcacatcctgagctag

SEQ ID NO: 82951 - DNA, 498 bp, Artificial Sequence
  Description of Artificial Sequence: Synthetic coding sequence
atgttctgcgagaaggccatggagctgatcagagagctgcacagagcccccgagggccagctgcccgccttcaacgaggacggcctgagacaggtgctggaggagatgaaggccctgtacgagcagaaccagagcgacgtgaacgaggccaagagcggcggcagaagcgacctgatccccaccatcaagttcagacactgcagcctgctgagaaacagaagatgcaccgtggcctacctgtacgacagactgctgagaatcagagccctgagatgggagtacggcagcgtgctgcccaacgccctgagattccacatggccgccgaggagatggagagcagaagcgtggcccaggccggcgtgcagtggtgcatcctgtgcagcctgcagctgcccccccccggcttcaagcagttcagctgcctgagcctgcccagcagctgcgactacagatggagcggcctgatcatcatcaaggacctgctgctgctgatctag

SEQ ID NO: 82952 - DNA, 558 bp, Artificial Sequence
  Description of Artificial Sequence: Synthetic coding sequence
atggacgccgccgaggtggagttcctggccgagaaggagctggtgaccatcatccccaacttcagcctggacaagatctacctgatcggcggcgacctgggccccttcaaccccggcctgcccgtggaggtgcccctgtggctggccatcaacctgaagcagagacagaagtgcagactgctgccccccgagtggatggacgtggagaagctggagaagatgagagaccacgagagaaaggaggagaccttcacccccatgcccagcccctactacatggagctgaccaagctgctgctgaaccacgccagcgacaacatccccaaggccgacgagatcagaaccctggtgaaggacatgtgggacaccagaatcgccaagctgagagtgagcgccgacagcttcgtgagacagcaggaggcccacgccaagctggacaacctgaccctgatggagatcaacaccagcggcaccttcctgacccaggccctgaaccacatgtacaagctgagaaccaacctgcagcccctggagagcacccagagccaggacttctag

SEQ ID NO: 82953 - DNA, 651 bp, Artificial Sequence
  Description of Artificial Sequence: Synthetic coding sequence
atgagcgaggcctacttcagagtggagagcggcgccctgggccccgaggagaacttcctgagcctggacgacatcctgatgagccacgagaagctgcccgtgagaaccgagaccgccatgcccagactgggcgccttcttcctggagagaagcgccggcgccgagaccgacaacgccgtgccccagggcagcaagctggagctgcccctgtggctggccaagggcctgttcgacaacaagagaagaatcctgagcgtggagctgcccaagatctaccaggagggctggagaaccgtgttcagcgccgaccccaacgtggtggacctgcacaagatgggcccccacttctacggcttcggcagccagctgctgcacttcgacagccccgagaacgccgacatcagccagagcctgctgcagaccttcatcggcagattcagaagaatcatggacagcagccagaacgcctacaacgaggacaccagcgccctggtggccagactggacgagatggagagaggcctgttccagaccggccagaagggcctgaacgacttccagtgctgggagaagggccaggccagccagatcaccgccagcaacctggtgcagaactacaagaagagaaagttcaccgacatggaggactag

SEQ ID NO: 82954 - DNA, 417 bp, Artificial Sequence
  Description of Artificial Sequence: Synthetic coding sequence
atgagcgaggcctacttcagagtggagagcggcgccctgggccccgaggagaacttcctgagcctggacgacatcctgatgagccacgagaagctgcccgtgagaaccgagaccgccatgcccagactgggcgccttcttcctggagagaagcgccggcgccgagaccgacaacgccgtgccccagaccttcatcggcagattcagaagaatcatggacagcagccagaacgcctacaacgaggacaccagcgccctggtggccagactggacgagatggagagaggcctgttccagaccggccagaagggcctgaacgacttccagtgctgggagaagggccaggccagccagatcaccgccagcaacctggtgcagaactacaagaagagaaagttcaccgacatggaggactag

SEQ ID NO: 82955 - DNA, 768 bp, Artificial Sequence
  Description of Artificial Sequence: Synthetic coding sequence
atgagcgaggcctacttcagagtggagagcggcgccctgggccccgaggagaacttcctgagcctggacgacatcctgatgagccacgagaagctgcccgtgagaaccgagaccgccatgcccagactgggcgccttcttcctggagagaagcgccggcgccgagaccgacaacgccgtgccccagggcttcgccctgctgcccagactggagtgcagcggcgtgatctggctgaccgccgccctgaccagccaggcccccgagatcctgcccccccagccccccatgtggctggtgctgcagggcagcaagctggagctgcccctgtggctggccaagggcctgttcgacaacaagagaagaatcctgagcgtggagctgcccaagatctaccaggagggctggagaaccgtgttcagcgccgaccccaacgtggtggacctgcacaagatgggcccccacttctacggcttcggcagccagctgctgcacttcgacagccccgagaacgccgacatcagccagagcctgctgcagaccttcatcggcagattcagaagaatcatggacagcagccagaacgcctacaacgaggacaccagcgccctggtggccagactggacgagatggagagaggcctgttccagaccggccagaagggcctgaacgacttccagtgctgggagaagggccaggccagccagatcaccgccagcaacctggtgcagaactacaagaagagaaagttcaccgacatggaggactag

SEQ ID NO: 82956 - DNA, 672 bp, Artificial Sequence
  Description of Artificial Sequence: Synthetic coding sequence
atgaccgaggaggtggacttcctgggccaggacagcgacggcggcagcgaggaggtggtgctgacccccgccgagctgatcgagagactggagcaggcctggatgaacgagaagttcgcccccgagctgctggagagcaagcccgagatcgtggagtgcgtgatggagcagctggagcacatggaggagaacctgagaagagccaagagagaggacctgaaggtgagcatccaccagatggagatggagagaatcagatacgtgctgagcagctacctgagatgcagactgatgaagatcgagaagttcttcccccacgtgctggagaaggagaagaccagacccgagggcgagcccagcagcctgagccccgaggagctggccttcgccagagagttcatggccaacaccgagagctacctgaagaacgtggccctgaagcacatgccccccaacctgcagaaggtggacctgttcagagccgtgcccaagcccgacctggacagctacgtgttcctgagagtgagagagagacaggagaacatcctggtggagcccgacaccgacgagcagagagactacgtgatcgacctggagaagggcagccagcacctgatcagatacaagaccatcgcccccctggtggccagcggcgccgtgcagctgatctag

SEQ ID NO: 82957 - DNA, 672 bp, Artificial Sequence; identical to SEQ ID NO: 82956
  Description of Artificial Sequence: Synthetic coding sequence

SEQ ID NO: 82958 - DNA, 303 bp, Artificial Sequence
  Description of Artificial Sequence: Synthetic coding sequence
atgaccgaggaggtggacttcctgggccaggacagcgacggcggcagcgaggaggtggtgctgacccccgccgagctgatcgagagactggagcaggcctggatgaacgagaagttcgcccccgagctgctggagagcaagcccgagatcgtggagtgcgtgatggagcagctggagcacatggaggagaacctgagaagagccaagagagaggacctgaaggtgagcatccaccagatggagatggagagaatcagatacgtgctgagcagctacctgagatgcagactgatgaaggtgtag

SEQ ID NO: 82959 - DNA, 939 bp, Artificial Sequence
  Description of Artificial Sequence: Synthetic coding sequence
atggagggcgccgccgccagagaggccagaggcaccgagacccccagagccagcgcccccccccccgcccccagcgagccccccgccgcccccagagccagacccagactggtgttcagaacccagctggcccacggcagccccaccggcaagatcgagggcttcaccaacgtgagagagctgtacgccaagatcgccgaggccttcggcatcgcccccaccgagatcctgttctgcaccctgaacagccacaaggtggacatgcagaagctgctgggcggccagatcggcctggaggacttcatcttcgcccacgtgagaggcgagaccaaggaggtggaggtgaccaagaccgaggacgccctgggcctgaccatcaccgacaacggcgccggctacgccttcatcaagagaatcaaggagggcagcatcatcaacagaatcgaggccgtgtgcgtgggcgacagcatcgaggccatcaacgaccacagcatcgtgggctgcagacactacgaggtggccaagatgctgagagagctgcccaagagccagcccttcaccctgagactggtgcagcccaagagagccttcgacatgatcggccagagaagcagaagcagcaagtgccccgtggaggccaaggtgaccagcggcagagagaccctgagactgagaagcggcggcgccgccaccgtggaggaggcccccagcgagttcgaggaggaggccagcagaaaggtggacgacctgctggagagctacatgggcatcagagaccccgagctggccagcaccatggtggagaccagcaagaagaccgccagcgcccaggagttcgccagatgcctggacagcgtgctgggcgagttcgccttccccgacgagttcgtggtggaggtgtgggccgccatcggcgaggccagagaggcctgcggctag

SEQ ID NO: 82960 - DNA, 2097 bp, Artificial Sequence
  Description of Artificial Sequence: Synthetic coding sequence
atgcccagcgagggcagatgctgggagaccctgaaggccctgagaagcagcgacaagggcagactgtgctactacagagactggctgctgagaagagaggacgtgctggaggagtgcatgagcctgcccaagctgagcagctacagcggctgggtggtggagcacgtgctgccccacatgcaggagaaccagcccctgagcgagaccagccccagcagcaccagcgccagcgccctggaccagcccagcttcgtgcccaagagccccgacgccagcagcgccttcagccccgccagccccgccacccccaacggcaccaagggcaaggacgagagccagcacaccgagagcatggtgctgcagagcagcagaggcatcaaggtggagggctgcgtgagaatgtacgagctggtgcacagaatgaagggcaccgagggcctgagactgtggcaggaggagcaggagagaaaggtgcaggccctgagcgagatggccagcgagcagctgaagagattcgacgagtggaaggagctgaagcagcacaaggagttccaggacctgagagaggtgatggagaagagcagcagagaggccctgggccaccaggagaagctgaaggccgagcacagacacagagccaagatcctgaacctgaagctgagagaggccgagcagcagagagtgaagcaggccgagcaggagagactgagaaaggaggagggccagatcagactgagagccctgtacgccctgcaggaggagatgctgcagctgagccagcagctggacgccagcgagcagcacaaggccctgctgaaggtggacctggccgccttccagaccagaggcaaccagctgtgcagcctgatcagcggcatcatcagagccagcagcgagagcagctaccccaccgccgagagccaggccgaggccgagagagccctgagagagatgagagacctgctgatgaacctgggccaggagatcaccagagcctgcgaggacaagagaagacaggacgaggaggaggcccaggtgaagctgcaggaggcccagatgcagcagggccccgaggcccacaaggagccccccgcccccagccagggccccggcggcaagcagaacgaggacctgcaggtgaaggtgcaggacatcaccatgcagtggtaccagcagctgcaggacgccagcatgcagtgcgtgctgaccttcgagggcctgaccaacagcaaggacagccaggccaagaagatcaagatggacctgcagaaggccgccaccatccccgtgagccagatcagcaccatcgccggcagcaagctgaaggagatcttcgacaagatccacagcctgctgagcggcaagcccgtgcagagcggcggcagaagcgtgagcgtgaccctgaacccccagggcctggacttcgtgcagtacaagctggccgagaagttcgtgaagcagggcgaggaggaggtggccagccaccacgaggccgccttccccatcgccgtggtggccagcggcatctgggagctgcaccccagagtgggcgacctgatcctggcccacctgcacaagaagtgcccctacagcgtgcccttctaccccaccttcaaggagggcatggccctggaggactaccagagaatgctgggctaccaggtgaaggacagcaaggtggagcagcaggacaacttcctgaagagaatgagcggcatgatcagactgtacgccgccatcatccagctgagatggccctacggcaacagacaggagatccacccccacggcctgaaccacggctggagatggctggcccagatcctgaacatggagcccctgagcgacgtgaccgccaccctgctgttcgacttcctggaggtgtgcggcaacgccctgatgaagcagtaccaggtgcagttctggaagatgctgatcctgatcaaggaggactacttccccagaatcgaggccatcaccagcagcggccagatgggcagcttcatcagactgaagcagttcctggagaagtgcctgcagcacaaggacatccccgtgcccaagggcttcctgaccagcagcttctggagaagctag

SEQ ID NO: 82961 - DNA, 1980 bp, Artificial Sequence
  Description of Artificial Sequence: Synthetic coding sequence
atgcccagcgagggcagatgctgggagaccctgaaggccctgagaagcagcgacaagggcagactgtgctactacagagactggctgctgagaagagaggacgtgctggaggagtgcatgagcctgcccaagctgagcagctacagcggctgggtggtggagcacgtgctgccccacatgcaggagaaccagcccctgagcgagaccagccccagcagcaccagcgccagcgccctggaccagcccagcttcgtgcccaagagccccgacgccagcagcgccttcagccccgccagccccgccacccccaacggcaccaagggcaaggacgagagccagcacaccgagagcatggtgctgcagagcagcagaggcatcaaggtggagggctgcgtgagaatgtacgagctggtgcacagaatgaagggcaccgagggcctgagactgtggcaggaggagcaggagagaaaggtgcaggccctgagcgagatggccagcgagcagctgaagagattcgacgagtggaaggagctgaagcagcacaaggagttccaggacctgagagaggtgatggagaagagcagcagagaggccctgggccaccaggagaagctgaaggccgagcacagacacagagccaagatcctgaacctgaagctgagagaggccgagcagcagagagtgaagcaggccgagcaggagagactgagaaaggaggagggccagatcagactgagagccctgtacgccctgcaggaggagatgctgcagctgagccagcagctggacgccagcgagcagcacaaggccctgctgaaggtggacctggccgccttccagaccagaggcaaccagctgtgcagcctgatcagcggcatcatcagagccagcagcgagagcagctaccccaccgccgagagccaggccgaggccgagagagccctgagagagatgagagacctgctgatgaacctgggccaggagatcaccagagcctgcgaggacaagagaagacaggacgaggaggaggcccaggtgaagctgcaggaggcccagatgcagcagggccccgaggcccacaaggagccccccgcccccagccagggccccggcggcaagcagaacgaggacctgcaggtgaaggtgcaggacatcaccatgcagtggtaccagcagctgcaggacgccagcatgcagtgcgtgctgaccttcgagggcctgaccaacagcaaggacagccaggccaagaagatcaagatggacctgcagaaggccgccaccatccccgtgagccagatcagcaccatcgccggcagcaagctgaaggagatcttcgacaagatccacagcctgctgagcggcaagcccgtgcagagcggcggcagaagcgtgagcgtgaccctgaacccccagggcctggacttcgtgcagtacaagctggccgagaagttcgtgaagcagggcgaggaggaggtggccagccaccacgaggccgccttccccatcgccgtggtggccagcggcatctgggagctgcaccccagagtgggcgacctgatcctggcccacctgcacaagaagtgcccctacagcgtgcccttctaccccaccttcaaggagggcatggccctggaggactaccagagaatgctgggctaccaggtgaaggacagcaaggtggagcagcaggacaacttcctgaagagaatgagcggcatgatcagactgtacgccgccatcatccagctgagatggccctacggcaacagacaggagatccacccccacggcctgaaccacggctggagatggctggcccagatcctgaacatggagcccctgagcgacgtgaccgccaccctgctgttcgacttcctggaggtgtgcggcaacgccctgatgaagcagtaccaggtgcagttctggaagatgctgatcctgatcaaggaggactacttccccagataccaggcctgctag

SEQ ID NO: 82962 - DNA, 1335 bp, Artificial Sequence
  Description of Artificial Sequence: Synthetic coding sequence
atgctgcagctgagccagcagctggacgccagcgagcagcacaaggccctgctgaaggtggacctggccgccttccagaccagaggcaaccagctgtgcagcctgatcagcggcatcatcagagccagcagcgagagcagctaccccaccgccgagagccaggccgaggccgagagagccctgagagagatgagagacctgctgatgaacctgggccaggagatcaccagagcctgcgaggacaagagaagacaggacgaggaggaggcccaggtgaagctgcaggaggcccagatgcagcagggccccgaggcccacaaggagccccccgcccccagccagggccccggcggcaagcagaacgaggacctgcaggtgaaggtgcaggacatcaccatgcagtggtaccagcagctgcaggacgccagcatgcagtgcgtgctgaccttcgagggcctgaccaacagcaaggacagccaggccaagaagatcaagatggacctgcagaaggccgccaccatccccgtgagccagatcagcaccatcgccggcagcaagctgaaggagatcttcgacaagatccacagcctgctgagcggcaagcccgtgcagagcggcggcagaagcgtgagcgtgaccctgaacccccagggcctggacttcgtgcagtacaagctggccgagaagttcgtgaagcagggcgaggaggaggtggccagccaccacgaggccgccttccccatcgccgtggtggccagcggcatctgggagctgcaccccagagtgggcgacctgatcctggcccacctgcacaagaagtgcccctacagcgtgcccttctaccccaccttcaaggagggcatggccctggaggactaccagagaatgctgggctaccaggtgaaggacagcaaggtggagcagcaggacaacttcctgaagagaatgagcggcatgatcagactgtacgccgccatcatccagctgagatggccctacggcaacagacaggagatccacccccacggcctgaaccacggctggagatggctggcccagatcctgaacatggagcccctgagcgacgtgaccgccaccctgctgttcgacttcctggaggtgtgcggcaacgccctgatgaagcagtaccaggtgcagttctggaagatgctgatcctgatcaaggaggactacttccccagaatcgaggccatcaccagcagcggccagatgggcagcttcatcagactgaagcagttcctggagaagtgcctgcagcacaaggacatccccgtgcccaagggcttcctgaccagcagcttctggagaagctag

SEQ ID NO: 82963 - DNA, 2490 bp, Artificial Sequence
  Description of Artificial Sequence: Synthetic coding sequence
atggccctgaccagcatcaacgccacccccacccagctgagcagcagcagcaactgcctgagcgacaccaaccagaacaagcagagcagcgagagcgccgtgagcagcaccgtgaaccccgtggccatccacaagagaagcaaggtgaagaccgagcccgagggcctgagacccgccagccccctggccctgacccagggccaggtgagcggccacggcagctgcggctgcgccctgcccctgagccaggagcagctggccgacctgaaggaggacctggacagagacgactgcaagcaggaggccgaggtggtgatctacgagaccaactgccactgggaggactgcaccaaggagtacgacacccaggagcagctggtgcaccacatcaacaacgagcacatccacggcgagaagaaggagttcgtgtgcagatggcaggcctgcaccagagagcagaagcccttcaaggcccagtacatgctggtggtgcacatgagaagacacaccggcgagaagccccacaagtgcaccttcgagggctgcagcaaggcctacagcagactggagaacctgaagacccacctgagaagccacaccggcgagaagccctacgtgtgcgagcacgagggctgcaacaaggccttcagcaacgccagcgacagagccaagcaccagaacagaacccacagcaacgagaagccctacatctgcaagatccccggctgcaccaagagatacaccgaccccagcagcctgagaaagcacgtgaagaccgtgcacggccccgacgcccacgtgaccaagaagcagagaaacgacgtgcacctgagaacccccctgctgaaggagaacggcgacagcgaggccggcaccgagcccggcggccccgagagcaccgaggccagcagcaccagccaggccgtggaggactgcctgcacgtgagagccatcaagaccgagagcagcggcctgtgccagagcagccccggcgcccagagcagctgcagcagcgagcccagccccctgggcagcgcccccaacaacgacagcggcgtggagatgcccggcaccggccccggcagcctgggcgacctgaccgccctggacgacaccccccccggcgccgacaccagcgccctggccgcccccagcgccggcggcctgcagctgagaaagcacatgaccaccatgcacagattcgagcagctgaagaaggagaagctgaagagcctgaaggacagctgcagctgggccggccccaccccccacaccagaaacaccaagctgccccccctgcccggcagcggcagcatcctggagaacttcagcggcagcggcggcggcggccccgccggcctgctgcccaaccccagactgagcgagctgagcgccagcgaggtgaccatgctgagccagctgcaggagagaagagacagcagcaccagcaccgtgagcagcgcctacaccgtgagcagaagaagcagcggcatcagcccctacttcagcagcagaagaagcagcgaggccagccccctgggcgccggcagaccccacaacgccagcagcgccgacagctacgaccccatcagcaccgacgccagcagaagaagcagcgaggccagccagtgcagcggcggcagcggcctgctgaacctgacccccgcccagcagtacagcctgagagccaagtacgccgccgccaccggcggccccccccccacccccctgcccggcctggagagaatgagcctgagaaccagactggccctgctggacgcccccgagagaaccctgcccgccggctgccccagacccctgggccccagaagaggcagcgacggccccacctacggccacggccacgccggcgccgcccccgccttcccccacgaggcccccggcggcggcgccagaagagccagcgaccccgtgagaagacccgacgccctgagcctgcccagagtgcagagattccacagcacccacaacgtgaaccccggccccctgcccccctgcgccgacagaagaggcctgagactgcagagccaccccagcaccgacggcggcctggccagaggcgcctacagccccagaccccccagcatcagcgagaacgtggccatggaggccgtggccgccggcgtggacggcgccggccccgaggccgacctgggcctgcccgaggacgacctggtgctgcccgacgacgtggtgcagtacatcaaggcccacgccagcggcgccctggacgagggcaccggccaggtgtaccccaccgagagcaccggcttcagcgacaaccccagactgcccagccccggcctgcacggccagagaagaatggtggccgccgacagcaacgtgggccccagcgcccccatgctgggcggctgccagctgggcttcggcgcccccagcagcctgaacaagaacaacatgcccgtgcagtggaacgaggccagcgccacctggctgagcggcacctag

SEQ ID NO: 82964 - DNA, 4761 bp, Artificial Sequence
  Description of Artificial Sequence: Synthetic coding sequence
atggagaccagcgccagcgccaccgccagcgagaagcaggaggccaagagcggcatcctggaggccgccggcttccccgaccccggcaagaaggccagccccctggtggtggccgccgccgccgccgccgccgtggccgcccagggcgtgccccagcacctgctgccccccttccacgcccccctgcccatcgacatgagacaccaggagggcagataccactacgagccccacagcgtgcacggcgtgcacggcccccccgccctgagcggcagccccgtgatcagcgacatcagcctgatcagactgagcccccaccccgccggccccggcgagagccccttcaacgccccccacccctacgtgaacccccacatggagcactacctgagaagcgtgcacagcagccccaccctgagcatgatcagcgccgccagaggcctgagccccgccgacgtggcccaggagcacctgaaggagagaggcctgttcggcctgcccgcccccggcaccacccccagcgactactaccaccagatgaccctggtggccggccaccccgccccctacggcgacctgctgatgcagagcggcggcgccgccagcgccccccacctgcacgactacctgaaccccgtggacgtgagcagattcagcagccccagagtgacccccagactgagcagaaagagagccctgagcatcagccccctgagcgacgccagcctggacctgcagagaatgatcagaaccagccccaacagcctggtggcctacatcaacaacagcagaagcagcagcgccgccagcggcagctacggccacctgagcgccggcgccctgagccccgccttcaccttcccccaccccatcaaccccgtggcctaccagcagatcctgagccagcagagaggcctgggcagcgccttcggccacaccccccccctgatccagcccagccccaccttcctggcccagcagcccatggccctgaccagcatcaacgccacccccacccagctgagcagcagcagcaactgcctgagcgacaccaaccagaacaagcagagcagcgagagcgccgtgagcagcaccgtgaaccccgtggccatccacaagagaagcaaggtgaagaccgagcccgagggcctgagacccgccagccccctggccctgacccagggccaggtgagcggccacggcagctgcggctgcgccctgcccctgagccaggagcagctggccgacctgaaggaggacctggacagagacgactgcaagcaggaggccgaggtggtgatctacgagaccaactgccactgggaggactgcaccaaggagtacgacacccaggagcagctggtgcaccacatcaacaacgagcacatccacggcgagaagaaggagttcgtgtgcagatggcaggcctgcaccagagagcagaagcccttcaaggcccagtacatgctggtggtgcacatgagaagacacaccggcgagaagccccacaagtgcaccttcgagggctgcagcaaggcctacagcagactggagaacctgaagacccacctgagaagccacaccggcgagaagccctacgtgtgcgagcacgagggctgcaacaaggccttcagcaacgccagcgacagagccaagcaccagaacagaacccacagcaacgagaagccctacatctgcaagatccccggctgcaccaagagatacaccgaccccagcagcctgagaaagcacgtgaagaccgtgcacggccccgacgcccacgtgaccaagaagcagagaaacgacgtgcacctgagaacccccctgctgaaggagaacggcgacagcgaggccggcaccgagcccggcggccccgagagcaccgaggccagcagcaccagccaggccgtggaggactgcctgcacgtgagagccatcaagaccgagagcagcggcctgtgccagagcagccccggcgcccagagcagctgcagcagcgagcccagccccctgggcagcgcccccaacaacgacagcggcgtggagatgcccggcaccggccccggcagcctgggcgacctgaccgccctggacgacaccccccccggcgccgacaccagcgccctggccgcccccagcgccggcggcctgcagctgagaaagcacatgaccaccatgcacagattcgagcagctgaagaaggagaagctgaagagcctgaaggacagctgcagctgggccggccccaccccccacaccagaaacaccaagctgccccccctgcccggcagcggcagcatcctggagaacttcagcggcagcggcggcggcggccccgccggcctgctgcccaaccccagactgagcgagctgagcgccagcgaggtgaccatgctgagccagctgcaggagagaagagacagcagcaccagcaccgtgagcagcgcctacaccgtgagcagaagaagcagcggcatcagcccctacttcagcagcagaagaagcagcgaggccagccccctgggcgccggcagaccccacaacgccagcagcgccgacagctacgaccccatcagcaccgacgccagcagaagaagcagcgaggccagccagtgcagcggcggcagcggcctgctgaacctgacccccgcccagcagtacagcctgagagccaagtacgccgccgccaccggcggccccccccccacccccctgcccggcctggagagaatgagcctgagaaccagactggccctgctggacgcccccgagagaaccctgcccgccggctgccccagacccctgggccccagaagaggcagcgacggccccacctacggccacggccacgccggcgccgcccccgccttcccccacgaggcccccggcggcggcgccagaagagccagcgaccccgtgagaagacccgacgccctgagcctgcccagagtgcagagattccacagcacccacaacgtgaaccccggccccctgcccccctgcgccgacagaagaggcctgagactgcagagccaccccagcaccgacggcggcctggccagaggcgcctacagccccagaccccccagcatcagcgagaacgtggccatggaggccgtggccgccggcgtggacggcgccggccccgaggccgacctgggcctgcccgaggacgacctggtgctgcccgacgacgtggtgcagtacatcaaggcccacgccagcggcgccctggacgagggcaccggccaggtgtaccccaccgagagcaccggcttcagcgacaaccccagactgcccagccccggcctgcacggccagagaagaatggtggccgccgacagcaacgtgggccccagcgcccccatgctgggcggctgccagctgggcttcggcgcccccagcagcctgaacaagaacaacatgcccgtgcagtggaacgaggtgagcagcggcaccgtggacgccctggccagccaggtgaagcccccccccttcccccagggcaacctggccgtggtgcagcagaagcccgccttcggccagtaccccggctacagcccccagggcctgcaggccagccccggcggcctggacagcacccagccccacctgcagcccagaagcggcgcccccagccagggcatccccagagtgaactacatgcagcagctgagacagcccgtggccggcagccagtgccccggcatgaccaccaccatgagcccccacgcctgctacggccaggtgcacccccagctgagccccagcaccatcagcggcgccctgaaccagttcccccagagctgcagcaacatgcccgccaagcccggccacctgggccacccccagcagaccgaggtggcccccgaccccaccaccatgggcaacagacacagagagctgggcgtgcccgacagcgccctggccggcgtgccccccccccaccccgtgcagagctacccccagcagagccaccacctggccgccagcatgagccaggagggctaccaccaggtgcccagcctgctgcccgccagacagcccggcttcatggagccccagaccggccccatgggcgtggccaccgccggcttcggcctggtgcagcccagaccccccctggagcccagccccaccggcagacacagaggcgtgagagccgtgcagcagcagctggcctacgccagagccaccggccacgccatggccgccatgcccagcagccaggagaccgccgaggccgtgcccaagggcgccatgggcaacatgggcagcgtgcccccccagccccccccccaggacgccggcggcgcccccgaccacagcatgctgtactactacggccagatccacatgtacgagcaggacggcggcctggagaacctgggcagctgccaggtgatgagaagccagcccccccagccccaggcctgccaggacagcatccagccccagcccctgcccagccccggcgtgaaccaggtgagcagcaccgtggacagccagctgctggaggccccccagatcgacttcgacgccatcatggacgacggcgaccacagcagcctgttcagcggcgccctgagccccagcctgctgcacagcctgagccagaacagcagcagactgaccacccccagaaacagcctgaccctgcccagcatccccgccggcatcagcaacatggccgtgggcgacatgagcagcatgctgaccagcctggccgaggagagcaagttcctgaacatgatgacctag

SEQ ID NO: 82965 - DNA, 249 bp, Artificial Sequence
  Description of Artificial Sequence: Synthetic coding sequence
atggagaccagcgccagcgccaccgccagcgagaagcaggaggccaagagcggcatcctggaggccgccggcttccccgaccccggcaagaaggccagccccctggtggtggccgccgccgccgccgccgccgtggccgcccagggcgtgccccagcacctgctgccccccttccacgcccccctgcccatcgacatgagacaccaggagggcagataccactacgagccccacagcgtgcacggctag

SEQ ID NO: 82966 - DNA, 660 bp, Artificial Sequence
  Description of Artificial Sequence: Synthetic coding sequence
atggagaccagcgccagcgccaccgccagcgagaagcaggaggccaagagcggcatcctggaggccgccggcttccccgaccccggcaagaaggccagccccctggtggtggccgccgccgccgccgccgccgtggccgcccagggcgtgccccagcacctgctgccccccttccacgcccccctgcccatcgacatgagacaccaggagggcagataccactacgagccccacagcgtgcacggcgtgcacggcgtgcccttcctgcagcccgccggcgacgccccccccgagccccaggccggcgccgtgcacctgcccaccctgagaagacagcccggccccgccgccgacgacccccacctgacccagctggccagcggcctgcaccagcagctgcccaagcagctgggcggccagagattcctgagagccagcgtgagcggctgcccccagcccagcctgcacctgccccccccccaccagcccagaggcctgcccgccgacagcgagcccgccgagggcagcggcgtgagcctgtggacccacaccacccccgaccccgccctgacccacctgcccggccccgccgcccacggcccccacctgcaccagtgccacgcccaccccgcccagcagcagcagcagctgagcgagtag

SEQ ID NO: 82967 - DNA, 4761 bp, Artificial Sequence; identical to SEQ ID NO: 82964
  Description of Artificial Sequence: Synthetic coding sequence

SEQ ID NO: 82968 - DNA, 4743 bp, Artificial Sequence
  Description of Artificial Sequence: Synthetic coding sequence
atggaggcccagagccacagcagcaccaccaccgagaagaagaaggtggagaacagcatcgtgaagtgcagcaccagaaccgacgtgagcgagaaggccgtggccagcagcaccaccagcaacgaggacgagagccccggccagacctaccacagagagagaagaaacgccatcaccatgcagccccagaacgtgcagggcctgagcaaggtgagcgaggagcccagcaccagcagcgacgagagagccagcctgatcaagaaggagatccacggcagcctgccccacgtggccgagcccagcgtgccctacagaggcaccgtgttcgccatggaccccagaaacggctacatggagccccactaccaccccccccacctgttccccgccttccacccccccgtgcccatcgacgccagacaccacgagggcagataccactacgaccccagccccatcccccccctgcacatgaccagcgccctgagcagcagccccacctaccccgacctgcccttcatcagaatcagcccccacagaaaccccaccgccgccagcgagagccccttcagccccccccacccctacatcaacccctacatggactacatcagaagcctgcacagcagccccagcctgagcatgatcagcgccaccagaggcctgagccccaccgacgccccccacgccggcgtgagccccgccgagtactaccaccagatggccctgctgaccggccagagaagcccctacgccgacatcatccccagcgccgccaccgccggcaccggcgccatccacatggagtacctgcacgccatggacagcaccagattcagcagccccagactgagcgccagacccagcagaaagagaaccctgagcatcagccccctgagcgaccacagcttcgacctgcagaccatgatcagaaccagccccaacagcctggtgaccatcctgaacaacagcagaagcagcagcagcgccagcggcagctacggccacctgagcgccagcgccatcagccccgccctgagcttcacctacagcagcgcccccgtgagcctgcacatgcaccagcagatcctgagcagacagcagagcctgggcagcgccttcggccacagcccccccctgatccaccccgcccccaccttccccacccagagacccatccccggcatccccaccgtgctgaaccccgtgcaggtgagcagcggccccagcgagagcagccagaacaagcccaccagcgagagcgccgtgagcagcaccggcgaccccatgcacaacaagagaagcaagatcaagcccgacgaggacctgcccagccccggcgccagaggccagcaggagcagcccgagggcaccaccctggtgaaggaggagggcgacaaggacgagagcaagcaggagcccgaggtgatctacgagaccaactgccactgggagggctgcgccagagagttcgacacccaggagcagctggtgcaccacatcaacaacgaccacatccacggcgagaagaaggagttcgtgtgcagatggctggactgcagcagagagcagaagcccttcaaggcccagtacatgctggtggtgcacatgagaagacacaccggcgagaagccccacaagtgcaccttcgagggctgcaccaaggcctacagcagactggagaacctgaagacccacctgagaagccacaccggcgagaagccctacgtgtgcgagcacgagggctgcaacaaggccttcagcaacgccagcgacagagccaagcaccagaacagaacccacagcaacgagaagccctacgtgtgcaagatccccggctgcaccaagagatacaccgaccccagcagcctgagaaagcacgtgaagaccgtgcacggccccgaggcccacgtgaccaagaagcagagaggcgacatccaccccagaccccccccccccagagacagcggcagccacagccagagcagaagccccggcagacccacccagggcgccctgggcgagcagcaggacctgagcaacaccaccagcaagagagaggagtgcctgcaggtgaagaccgtgaaggccgagaagcccatgaccagccagcccagccccggcggccagagcagctgcagcagccagcagagccccatcagcaactacagcaacagcggcctggagctgcccctgaccgacggcggcagcatcggcgacctgagcgccatcgacgagacccccatcatggacagcaccatcagcaccgccaccaccgccctggccctgcaggccagaagaaaccccgccggcaccaagtggatggagcacgtgaagctggagagactgaagcaggtgaacggcatgttccccagactgaaccccatcctgccccccaaggcccccgccgtgagccccctgatcggcaacggcacccagagcaacaacacctgcagcctgggcggccccatgaccctgctgcccggcagaagcgacctgagcggcgtggacgtgaccatgctgaacatgctgaacagaagagacagcagcgccagcaccatcagcagcgcctacctgagcagcagaagaagcagcggcatcagcccctgcttcagcagcagaagaagcagcgaggccagccaggccgagggcagaccccagaacgtgagcgtggccgacagctacgaccccatcagcaccgacgccagcagaagaagcagcgaggccagccagagcgacggcctgcccagcctgctgagcctgacccccgcccagcagtacagactgaaggccaagtacgccgccgccaccggcggccccccccccacccccctgcccaacatggagagaatgagcctgaagaccagactggccctgctgggcgacgccctggagcccggcgtggccctgccccccgtgcacgcccccagaagatgcagcgacggcggcgcccacggctacggcagaagacacctgcagccccacgacgcccccggccacggcgtgagaagagccagcgaccccgtgagaaccggcagcgagggcctggccctgcccagagtgcccagattcagcagcctgagcagctgcaacccccccgccatggccaccagcgccgagaagagaagcctggtgctgcagaactacaccagacccgagggcggccagagcagaaacttccacagcagcccctgcccccccagcatcaccgagaacgtgaccctggagagcctgaccatggacgccgacgccaacctgaacgacgaggacttcctgcccgacgacgtggtgcagtacctgaacagccagaaccaggccggctacgagcagcacttccccagcgccctgcccgacgacagcaaggtgccccacggccccggcgacttcgacgcccccggcctgcccgacagccacgccggccagcagttccacgccctggagcagccctgccccgagggcagcaagaccgacctgcccatccagtggaacgaggtgagcagcggcagcgccgacctgagcagcagcaagctgaagtgcggccccagacccgccgtgccccagaccagagccttcggcttctgcaacggcatggtggtgcacccccagaaccccctgagaagcggccccgccggcggctaccagaccctgggcgagaacagcaacccctacggcggccccgagcacctgatgctgcacaacagccccggcagcggcaccagcggcaacgccttccacgagcagccctgcaaggccccccagtacggcaactgcctgaacagacagcccgtggcccccggcgccctggacggcgcctgcggcgccggcatccaggccagcaagctgaagagcacccccatgcagggcagcggcggccagctgaacttcggcctgcccgtggcccccaacgagagcgccggcagcatggtgaacggcatgcagaaccaggaccccgtgggccagggctacctggcccaccagctgctgggcgacagcatgcagcaccccggcgccggcagacccggccagcagatgctgggccagatcagcgccaccagccacatcaacatctaccagggccccgagagctgcctgcccggcgcccacggcatgggcagccagcccagcagcctggccgtggtgagaggctaccagccctgcgccagcttcggcggcagcagaagacaggccatgcccagagacagcctggccctgcagagcggccagctgagcgacaccagccagacctgcagagtgaacggcatcaagatggagatgaagggccagccccaccccctgtgcagcaacctgcagaactacagcggccagttctacgaccagaccgtgggcttcagccagcaggacaccaaggccggcagcttcagcatcagcgacgccagctgcctgctgcagggcaccagcgccaagaacagcgagctgctgagccccggcgccaaccaggtgaccagcaccgtggacagcctggacagccacgacctggagggcgtgcagatcgacttcgacgccatcatcgacgacggcgaccacagcagcctgatgagcggcgccctgagccccagcatcatccagaacctgagccacagcagcagcagactgaccacccccagagccagcctgcccttccccgccctgagcatgagcaccaccaacatggccatcggcgacatgagcagcctgctgaccagcctggccgaggagagcaagttcctggccgtgatgcagtag

SEQ ID NO: 82969 - DNA, 543 bp, Artificial Sequence
  Description of Artificial Sequence: Synthetic coding sequence
atggaggcccagagccacagcagcaccaccaccgagaagaagaaggtggagaacagcatcgtgaagtgcagcaccagaaccgacgtgagcgagaaggccgtggccagcagcaccaccagcaacgaggacgagagccccggccagacctaccacagagagagaagaaacgccatcaccatgcagccccagaacgtgcagggcctgagcaaggtgagcgaggagcccagcaccagcagcgacgagagagccagcctgatcaagaaggagatccacggcagcctgccccacgtggccgagcccagcgtgccctacagaggcaccgtgttcgccatggaccccagaaacggctacatggagccccactaccaccccccccacctgttccccgccttccacccccccgtgcccatcgacgccagacaccacgagggcagataccactacgaccccagccccatcccccccctgcacatgaccagcgccctgagcagcagccccacctaccccgacctgcccttcatcagaatcagcccccacagatag

SEQ ID NO: 82970 - DNA, 1131 bp, Artificial Sequence
  Description of Artificial Sequence: Synthetic coding sequence
atggccgccctgggcgacatccaggagagccccagcgtgcccagccccgtgagcctgagcagccccggcacccccggcacccagcaccacgagccccagctgcacctgcacggccaccagcacggcagccccggcagcagccccaaggtgctgagccagcccagcgacctggacctgcaggacgtggaggaggtggagatcggcagagacaccttctggcccgacagcgagcccaagcccgagcaggcccccagaagccccggcagccaggcccccgacgagggcgccggcggcgccctgagaagcctgctgagaagcctgcccagaagagccagatgcagcgccggcttcggccccgagagcagcgccgagagacccgccggccagccccccggcgccgtgccctgcgcccagcccagaggcgcctggagagtgaccctggtgcagcaggccgccgccggccccgagggcgcccccgagagagccgccgagctgggcgtgaacttcggcagaagcagacagggcagcgccagaggcgccaagccccacagatgcgaggcctgcggcaagagcttcaagtacaacagcctgctgctgaagcaccagagaatccacaccggcgagaagccctacgcctgccacgagtgcggcaagagattcagaggctggagcggcttcatccagcaccacagaatccacaccggcgagaagccctacgagtgcggccagtgcggcagagccttcagccacagcagccacttcacccagcacctgagaatccacaacggcgagaagccctacaagtgcggcgagtgcggccaggccttcagccagagcagcaacctggtgagacaccagagactgcacaccggcgagaagccctacgcctgcagccagtgcggcaaggccttcatctggagcagcgtgctgatcgagcaccagagaatccacaccggcgagaagccctacgagtgcagcgactgcggcaaggccttcagaggcagaagccacttcttcagacacctgagaacccacaccggcgagaagcccttcgcctgcggcgcctgcggcaaggccttcggccagagcagccagctgatccagcaccagagagtgcactacagagagtag

SEQ ID NO: 82971 - DNA, 1131 bp, Artificial Sequence; identical to SEQ ID NO: 82970
  Description of Artificial Sequence: Synthetic coding sequence

SEQ ID NO: 82972 - DNA, 801 bp, Artificial Sequence
  Description of Artificial Sequence: Synthetic coding sequence
atgagagtgaccctggccaccatcgcctggatggtgagcttcgtgagcaactacagccacaccgccaacatcctgcccgacatcgagaacgaggacttcatcaaggactgcgtgagaatccacaacaagttcagaagcgaggtgaagcccaccgccagcgacatgctgtacatgacctgggaccccgccctggcccagatcgccaaggcctgggccagcaactgccagttcagccacaacaccagactgaagcccccccacaagctgcaccccaacttcaccagcctgggcgagaacatctggaccggcagcgtgcccatcttcagcgtgagcagcgccatcaccaactggtacgacgagatccaggactacgacttcaagaccagaatctgcaagaaggtgtgcggccactacacccaggtggtgtgggccgacagctacaaggtgggctgcgccgtgcagttctgccccaaggtgagcggcttcgacgccctgagcaacggcgcccacttcatctgcaactacggccccggcggcaactaccccacctggccctacaagagaggcgccacctgcagcgcctgccccaacaacgacaagtgcctggacaacctgtgcgtgaacagacagagagaccaggtgaagagatactacagcgtggtgtaccccggctggcccatctaccccagaaacagatacaccagcctgttcctgatcgtgaacagcgtgatcctgatcctgagcgtgatcatcaccatcctggtgcagcacaagtaccccaacctggtgctgctggactag

SEQ ID NO: 82973 - DNA, 429 bp, Artificial Sequence
  Description of Artificial Sequence: Synthetic coding sequence
atgagcgacagcctggtggtgtgcgaggtggaccccgagctgaccgagaagctgagaaagttcagattcagaaaggagaccgacaacgccgccatcatcatgaaggtggacaaggacagacagatggtggtgctggaggaggagttccagaacatcagccccgaggagctgaagatggagctgcccgagagacagcccagattcgtggtgtacagctacaagtacgtgcacgacgacggcagagtgagctaccccctgtgcttcatcttcagcagccccgtgggctgcaagcccgagcagcagatgatgtacgccggcagcaagaacagactggtgcagaccgccgagctgaccaaggtgttcgagatcagaaccaccgacgacctgaccgaggcctggctgcaggagaagctgagcttcttcagatag

SEQ ID NO: 82974 - DNA, 429 bp, Artificial Sequence; identical to SEQ ID NO: 82973
  Description of Artificial Sequence: Synthetic coding sequence

SEQ ID NO: 82975 - DNA, 1299 bp, Artificial Sequence
  Description of Artificial Sequence: Synthetic coding sequence
atggagagaagaagaatcaccagcgccgccagaagaagctacgtgagcagcggcgagatgatggtgggcggcctggcccccggcagaagactgggccccggcaccagactgagcctggccagaatgcccccccccctgcccaccagagtggacttcagcctggccggcgccctgaacgccggcttcaaggagaccagagccagcgagagagccgagatgatggagctgaacgacagattcgccagctacatcgagaaggtgagattcctggagcagcagaacaaggccctggccgccgagctgaaccagctgagagccaaggagcccaccaagctggccgacgtgtaccaggccgagctgagagagctgagactgagactggaccagctgaccgccaacagcgccagactggaggtggagagagacaacctggcccaggacctggccaccgtgagacagaagctgcaggacgagaccaacctgagactggaggccgagaacaacctggccgcctacagacaggaggccgacgaggccaccctggccagactggacctggagagaaagatcgagagcctggaggaggagatcagattcctgagaaagatccacgaggaggaggtgagagagctgcaggagcagctggccagacagcaggtgcacgtggagctggacgtggccaagcccgacctgaccgccgccctgaaggagatcagaacccagtacgaggccatggccagcagcaacatgcacgaggccgaggagtggtacagaagcaagttcgccgacctgaccgacgccgccgccagaaacgccgagctgctgagacaggccaagcacgaggccaacgactacagaagacagctgcagagcctgacctgcgacctggagagcctgagaggcaccaacgagagcctggagagacagatgagagagcaggaggagagacacgtgagagaggccgccagctaccaggaggccctggccagactggaggaggagggccagagcctgaaggacgagatggccagacacctgcaggagtaccaggacctgctgaacgtgaagctggccctggacatcgagatcgccacctacagaaagctgctggagggcgaggagaacagaatcaccatccccgtgcagaccttcagcaacctgcagatcagagagaccagcctggacaccaagagcgtgagcgagggccacctgaagagaaacatcgtggtgaagaccgtggagatgagagacggcgaggtgatcaaggagagcaagcaggagcacaaggacgtgatgtag

SEQ ID NO: 82976 - DNA, 540 bp, Artificial Sequence
  Description of Artificial Sequence: Synthetic coding sequence
atggagagaagaagaatcaccagcgccgccagaagaagctacgtgagcagcggcgagatgatggtgggcggcctggcccccggcagaagactgggccccggcaccagactgagcctggccagaatgcccccccccctgcccaccagagtggacttcagcctggccggcgccctgaacgccggcttcaaggagaccagagccagcgagagagccgagatgatggagctgaacgacagattcgccagctacatcgagaaggtgagattcctggagcagcagaacaaggccctggccgccgagctgaaccagctgagagccaaggagcccaccaagctggccgacgtgtaccaggccgagctgagagagctgagactgagactggaccagctgaccgccaacagcgccagactggaggtggagagagacaacctggcccaggacctggccaccgtgagacagaagaagcagatgaagcccccctggcccgtgtggatctggagaggcagactgagcagatggagaagaagaagcggcagctag

SEQ ID NO: 82977 - DNA, 1224 bp, Artificial Sequence
  Description of Artificial Sequence: Synthetic coding sequence
atggagagaagaagaatcaccagcgccaccagactgagcctggccagaatgcccccccccctgcccaccagagtggacttcagcctggccggcgccctgaacgccggcttcaaggagaccagagccagcgagagagccgagatgatggagctgaacgacagattcgccagctacatcgagaaggtgagattcctggagcagcagaacaaggccctggccgccgagctgaaccagctgagagccaaggagcccaccaagctggccgacgtgtaccaggccgagctgagagagctgagactgagactggaccagctgaccgccaacagcgccagactggaggtggagagagacaacctggcccaggacctggccaccgtgagacagaagctgcaggacgagaccaacctgagactggaggccgagaacaacctggccgcctacagacaggaggccgacgaggccaccctggccagactggacctggagagaaagatcgagagcctggaggaggagatcagattcctgagaaagatccacgaggaggaggtgagagagctgcaggagcagctggccagacagcaggtgcacgtggagctggacgtggccaagcccgacctgaccgccgccctgaaggagatcagaacccagtacgaggccatggccagcagcaacatgcacgaggccgaggagtggtacagaagcaagttcgccgacctgaccgacgccgccgccagaaacgccgagctgctgagacaggccaagcacgaggccaacgactacagaagacagctgcagagcctgacctgcgacctggagagcctgagaggcaccaacgagagcctggagagacagatgagagagcaggaggagagacacgtgagagaggccgccagctaccaggaggccctggccagactggaggaggagggccagagcctgaaggacgagatggccagacacctgcaggagtaccaggacctgctgaacgtgaagctggccctggacatcgagatcgccacctacagaaagctgctggagggcgaggagaacagaatcaccatccccgtgcagaccttcagcaacctgcagatcagagagaccagcctggacaccaagagcgtgagcgagggccacctgaagagaaacatcgtggtgaagaccgtggagatgagagacggcgaggtgatcaaggagagcaagcaggagcacaaggacgtgatgtag

SEQ ID NO: 82978 - DNA, 1296 bp, Artificial Sequence
  Description of Artificial Sequence: Synthetic coding sequence
atggagagaagaagaatcaccagcgccgccagaagaagctacgtgagcagcggcgagatgatggtgggcggcctggcccccggcagaagactgggccccggcaccagactgagcctggccagaatgcccccccccctgcccaccagagtggacttcagcctggccggcgccctgaacgccggcttcaaggagaccagagccagcgagagagccgagatgatggagctgaacgacagattcgccagctacatcgagaaggtgagattcctggagcagcagaacaaggccctggccgccgagctgaaccagctgagagccaaggagcccaccaagctggccgacgtgtaccaggccgagctgagagagctgagactgagactggaccagctgaccgccaacagcgccagactggaggtggagagagacaacctggcccaggacctggccaccgtgagacagaagctgcaggacgagaccaacctgagactggaggccgagaacaacctggccgcctacagacaggaggccgacgaggccaccctggccagactggacctggagagaaagatcgagagcctggaggaggagatcagattcctgagaaagatccacgaggaggaggtgagagagctgcaggagcagctggccagacagcaggtgcacgtggagctggacgtggccaagcccgacctgaccgccgccctgaaggagatcagaacccagtacgaggccatggccagcagcaacatgcacgaggccgaggagtggtacagaagcaagttcgccgacctgaccgacgccgccgccagaaacgccgagctgctgagacaggccaagcacgaggccaacgactacagaagacagctgcagagcctgacctgcgacctggagagcctgagaggcaccaacgagagcctggagagacagatgagagagcaggaggagagacacgtgagagaggccgccagctaccaggaggccctggccagactggaggaggagggccagagcctgaaggacgagatggccagacacctgcaggagtaccaggacctgctgaacgtgaagctggccctggacatcgagatcgccacctacagaaagctgctggagggcgaggagaacagaatcaccatccccgtgcagaccttcagcaacctgcagatcagaggcggcaagagcaccaaggacggcgagaaccacaaggtgaccagatacctgaagagcctgaccatcagagtgatccccatccaggcccaccagatcgtgaacggcaccccccccgccagaggctag

SEQ ID NO: 82979 - DNA, 1317 bp, Artificial Sequence
  Description of Artificial Sequence: Synthetic coding sequence
atggagagaagaagaatcaccagcgccgccagaagaagctacgtgagcagcggcgagatgatggtgggcggcctggcccccggcagaagactgggccccggcaccagactgagcctggccagaatgcccccccccctgcccaccagagtggacttcagcctggccggcgccctgaacgccggcttcaaggagaccagagccagcgagagagccgagatgatggagctgaacgacagattcgccagctacatcgagaaggtgagattcctggagcagcagaacaaggccctggccgccgagctgaaccagctgagagccaaggagcccaccaagctggccgacgtgtaccaggccgagctgagagagctgagactgagactggaccagctgaccgccaacagcgccagactggaggtggagagagacaacctggcccaggacctggccaccgtgagacagaagctgcaggacgagaccaacctgagactggaggccgagaacaacctggccgcctacagacaggaggccgacgaggccaccctggccagactggacctggagagaaagatcgagagcctggaggaggagatcagattcctgagaaagatccacgaggaggaggtgagagagctgcaggagcagctggccagacagcaggtgcacgtggagctggacgtggccaagcccgacctgaccgccgccctgaaggagatcagaacccagtacgaggccatggccagcagcaacatgcacgaggccgaggagtggtacagaagcaagttcgccgacctgaccgacgccgccgccagaaacgccgagctgctgagacaggccaagcacgaggccaacgactacagaagacagctgcagagcctgacctgcgacctggagagcctgagaggcaccaacgagagcctggagagacagatgagagagcaggaggagagacacgtgagagaggccgccagctaccaggaggccctggccagactggaggaggagggccagagcctgaaggacgagatggccagacacctgcaggagtaccaggacctgctgaacgtgaagctggccctggacatcgagatcgccacctacagaaagctgctggagggcgaggagaacagaatcaccatccccgtgcagaccttcagcaacctgcagatcagaggccagtacagcagagccagctgggagggccactggagccccgcccccagcagcagagcctgcagactgctgcagaccggcaccgaggaccagggcaagggcatccagctgagcctgggcgccttcgtgaccctgcagagaagctag

SEQ ID NO: 82980 - DNA, 861 bp, Artificial Sequence
  Description of Artificial Sequence: Synthetic coding sequence
atggccgccagagtgctgagagccagaggcgccgcctgggccggcggcctgctgcagagagccgccccctgcagcctgctgcccagactgagaacctggaccagcagcagcaacagaagcagagaggacagctggctgaagagcctgttcgtgagaaaggtggaccccagaaaggacgcccacagcaacctgctggccaagaaggagaccagcaacctgtacaagctgcagttccacaacgtgaagcccgagtgcctggaggcctacaacaagatctgccaggaggtgctgcccaagatccacgaggacaagcactacccctgcaccctggtgggcacctggaacacctggtacggcgagcaggaccaggccgtgcacctgtggagatacgagggcggctaccccgccctgaccgaggtgatgaacaagctgagagagaacaaggagttcctggagttcagaaaggccagaagcgacatgctgctgagcagaaagaaccagctgctgctggagttcagcttctggaacgagcccgtgcccagaagcggccccaacatctacgagctgagaagctaccagctgagacccggcaccatgatcgagtggggcaactactgggccagagccatcagattcagacaggacggcaacgaggccgtgggcggcttcttcagccagatcggccagctgtacatggtgcaccacctgtgggcctacagagacctgcagaccagagaggacatcagaaacgccgcctggcacaagcacggctgggaggagctggtgtactacaccgtgcccctgatccaggagatggagagcagaatcatgatccccctgaagaccagccccctgcagtag

SEQ ID NO: 82981 - DNA, 744 bp, Artificial Sequence
  Description of Artificial Sequence: Synthetic coding sequence
atggccgccagagtgctgagagccagaggcgccgcctgggccggcggcctgctgcagagagccgccccctgcagcctgctgcccagactgagaacctggaccagcagcagcaacagaagcagagaggacagctggctgaagagcctgttcgtgagaaaggtggaccccagaaaggacgcccacagcaacctgctggccaagaaggagaccagcaacctgtacaagctgcagttcaagagatgctgccagagattcaccaagatcaacaccaccctggtgctgtggtggggcctgggcaccagaggcatggccagcagaaccaagctggagttcctggagttcagaaaggccagaagcgacatgctgctgagcagaaagaaccagctgctgctggagttcagcttctggaacgagcccgtgcccagaagcggccccaacatctacgagctgagaagctaccagctgagacccggcaccatgatcgagtggggcaactactgggccagagccatcagattcagacaggacggcaacgaggccgtgggcggcttcttcagccagatcggccagctgtacatggtgcaccacctgtgggcctacagagacctgcagaccagagaggacatcagaaacgccgcctggcacaagcacggctgggaggagctggtgtactacaccgtgcccctgatccaggagatggagagcagaatcatgatccccctgaagaccagccccctgcagtag

SEQ ID NO: 82982 - DNA, 4683 bp, Artificial Sequence
  Description of Artificial Sequence: Synthetic coding sequence
atggacgacgaggacggcagatgcctgctggacgtgatctgcgacccccaggccctgaacgacttcctgcacggcagcgagaagctggacagcgacgacctgctggacaaccccggcgaggcccagagcgccttctacgagggccccggcctgcacgtgcaggaggccagcggcaaccacctgaaccccgagcccaaccagcccgcccccagcgtggacctggacttcctggaggacgacatcctgggcagccccgccaccggcggcggcggcggcggcagcggcggcgccgaccagccctgcgacatcctgcagcagagcctgcaggaggccaacatcaccgagcagaccctggaggccgaggccgagctggacctgggccccttccagctgcccaccctgcagcccgccgacggcggcgccggccccaccggcgccggcggcgccgccgccgtggccgccggcccccaggccctgttccccggcagcaccgacctgctgggcctgcagggcccccccaccgtgctgacccaccaggccctggtgcccccccaggacgtggtgaacaaggccctgagcgtgcagcccttcctgcagcccgtgggcctgggcaacgtgaccctgcagcccatccccggcctgcagggcctgcccaacggcagccccggcggcgccaccgccgccaccctgggcctggcccccatccaggtggtgggccagcccgtgatggccctgaacacccccaccagccagctgctggccaagcaggtgcccgtgagcggctacctggccagcgccgccggccccagcgagcccgtgaccctggccagcgccggcgtgagcccccagggcgccggcctggtgatccagaagaacctgagcgccgccgtggccaccaccctgaacggcaacagcgtgttcggcggcgccggcgccgccagcgcccccaccggcacccccagcggccagcccctggccgtggcccccggcctgggcagcagccccctggtgcccgcccccaacgtgatcctgcacagaacccccacccccatccagcccaagcccgccggcgtgctgccccccaagctgtaccagctgacccccaagcccttcgcccccgccggcgccaccctgaccatccagggcgagcccggcgccctgccccagcagcccaaggccccccagaacctgaccttcatggccgccggcaaggccggccagaacgtggtgctgagcggcttccccgcccccgccctgcaggccaacgtgttcaagcagccccccgccaccaccaccggcgccgcccccccccagccccccggcgccctgagcaagcccatgagcgtgcacctgctgaaccagggcagcagcatcgtgatccccgcccagcacatgctgcccggccagaaccagttcctgctgcccggcgcccccgccgtgcagctgccccagcagctgagcgccctgcccgccaacgtgggcggccagatcctggccgccgccgccccccacaccggcggccagctgatcgccaaccccatcctgaccaaccagaacctggccggccccctgagcctgggccccgtgctggccccccacagcggcgcccacagcgcccacatcctgagcgccgcccccatccaggtgggccagcccgccctgttccagatgcccgtgagcctggccgccggcagcctgcccacccagagccagcccgcccccgccggccccgccgccaccaccgtgctgcagggcgtgaccctgccccccagcgccgtggccatgctgaacacccccgacggcctggtgcagcccgccacccccgccgccgccaccggcgaggccgcccccgtgctgaccgtgcagcccgccccccaggccccccccgccgtgagcacccccctgcccctgggcctgcagcagccccaggcccagcagcccccccaggcccccaccccccaggccgccgcccccccccaggccaccaccccccagcccagccccggcctggccagcagccccgagaagatcgtgctgggccagccccccagcgccacccccaccgccatcctgacccaggacagcctgcagatgttcctgccccaggagagaagccagcagcccctgagcgccgagggcccccacctgagcgtgcccgccagcgtgatcgtgagcgcccccccccccgcccaggaccccgcccccgccacccccgtggccaagggcgccggcctgggcccccaggcccccgacagccaggccagccccgcccccgccccccagatccccgccgccgcccccctgaagggccccggccccagcagcagccccagcctgccccaccaggcccccctgggcgacagcccccacctgcccagcccccaccccaccagaccccccagcagaccccccagcagaccccagagcgtgagcagaccccccagcgagccccccctgcacccctgcccccccccccaggccccccccaccctgcccggcatcttcgtgatccagaaccagctgggcgtgcccccccccgccagcaaccccgcccccaccgcccccggccccccccagccccccctgagaccccagagccagccccccgagggccccctgccccccgccccccacctgccccccagcagcaccagcagcgccgtggccagcagcagcgagaccagcagcagactgcccgcccccacccccagcgacttccagctgcagttcccccccagccagggcccccacaagagccccacccccccccccaccctgcacctggtgcccgagcccgccgccccccccccccccccccccagaaccttccagatggtgaccacccccttccccgccctgccccagcccaaggccctgctggagagattccaccaggtgcccagcggcatcatcctgcagaacaaggccggcggcgcccccgccgccccccagaccagcaccagcctgggccccctgaccagccccgccgccagcgtgctggtgagcggccaggcccccagcggcacccccaccgcccccagccacgcccccgcccccgcccccatggccgccaccggcctgccccccctgctgcccgccgagaacaaggccttcgccagcaacctgcccaccctgaacgtggccaaggccgccagcagcggccccggcaagcccagcggcctgcagtacgagagcaagctgagcggcctgaagaagccccccaccctgcagcccagcaaggaggcctgcttcctggagcacctgcacaagcaccagggcagcgtgctgcaccccgactacaagaccgccttccccagcttcgaggacgccctgcacagactgctgccctaccacgtgtaccagggcgccctgcccagccccagcgactaccacaaggtggacgaggagttcgagaccgtgagcacccagctgctgaagagaacccaggccatgctgaacaagtacagactgctgctgctggaggagagcagaagagtgagccccagcgccgagatggtgatgatcgacagaatgttcatccaggaggagaagaccaccctggccctggacaagcagctggccaaggagaagcccgacgagtacgtgagcagcagcagaagcctgggcctgcccatcgccgccagcagcgagggccacagactgcccggccacggccccctgagcagcagcgcccccggcgccagcacccagccccccccccacctgcccaccaagctggtgatcagacacggcggcgccggcggcagccccagcgtgacctgggccagagccagcagcagcctgagcagcagcagcagcagcagcagcgccgccagcagcctggacgccgacgaggacggccccatgcccagcagaaacagaccccccatcaagacctacgaggccagaagcagaatcggcctgaagctgaagatcaagcaggaggccggcctgagcaaggtggtgcacaacaccgccctggaccccgtgcaccagcccccccccccccccgccaccctgaaggtggccgagcccccccccagacccccccccccccccccccccaccggccagatgaacggcaccgtggaccaccccccccccgccgcccccgagagaaagcccctgggcaccgccccccactgccccagactgcccctgagaaagacctacagagagaacgtgggcggccccggcgcccccgagggcacccccgccggcagagccagaggcggcagccccgcccccctgcccgccaaggtggacgaggccaccagcggcctgatcagagagctggccgccgtggaggacgagctgtaccagagaatgctgaagggccccccccccgagcccgccgccagcgccgcccagggcaccggcgaccccgactgggaggcccccggcctgccccccgccaagagaagaaagagcgagagccccgacgtggaccaggccagcttcagcagcgacagcccccaggacgacaccctgaccgagcacctgcagagcgccatcgacagcatcctgaacctgcagcaggcccccggcagaacccccgcccccagctacccccacgccgccagcgccggcacccccgccagccccccccccctgcacagacccgaggcctacccccccagcagccacaacggcggcctgggcgccagaaccctgaccagatag

SEQ ID NO: 82983 - DNA, 1437 bp, Artificial Sequence
  Description of Artificial Sequence: Synthetic coding sequence
atggccgccggcggcagcggcgtgggcggcaagagaagcagcaagagcgacgccgacagcggcttcctgggcctgagacccaccagcgtggaccccgccctgagaagaagaagaagaggccccagaaacaagaagagaggctggagaagactggcccaggagcccctgggcctggaggtggaccagttcctggaggacgtgagactgcaggagagaaccagcggcggcctgctgagcgaggcccccaacgagaagctgttcttcgtggacaccggcagcaaggagaagggcctgaccaagaagagaaccaaggtgcagaagaagagcctgctgctgaagaagcccctgagagtggacctgatcctggagaacaccagcaaggtgcccgcccccaaggacgtgctggcccaccaggtgcccaacgccaagaagctgagaagaaaggagcagctgtgggagaagctggccaagcagggcgagctgcccagagaggtgagaagagcccaggccagactgctgaaccccagcgccaccagagccaagcccggcccccaggacaccgtggagagacccttctacgacctgtgggccagcgacaaccccctggacagacccctggtgggccaggacgagttcttcctggagcagaccaagaagaagggcgtgaagagacccgccagactgcacaccaagcccagccaggcccccgccgtggaggtggcccccgccggcgccagctacaaccccagcttcgaggaccaccagaccctgctgagcgccgcccacgaggtggagctgcagagacagaaggaggccgagaagctggagagacagctggccctgcccgccaccgagcaggccgccacccaggagagcaccttccaggagctgtgcgagggcctgctggaggagagcgacggcgagggcgagcccggccagggcgagggccccgaggccggcgacgccgaggtgtgccccacccccgccagactggccaccaccgagaagaagaccgagcagcagagaagaagagagaaggccgtgcacagactgagagtgcagcaggccgccctgagagccgccagactgagacaccaggagctgttcagactgagaggcatcaaggcccaggtggccctgagactggccgagctggccagaagacagagaagaagacaggccagaagagaggccgaggccgacaagcccagaagactgggcagactgaagtaccaggcccccgacatcgacgtgcagctgagcagcgagctgaccgacagcctgagaaccctgaagcccgagggcaacatcctgagagacagattcaagagcttccagagaagaaacatgatcgagcccagagagagagccaagttcaagagaaagtacaaggtgaagctggtggagaagagagccttcagagagatccagctgtag

SEQ ID NO: 82984 - DNA, 1419 bp, Artificial Sequence
  Description of Artificial Sequence: Synthetic coding sequence
atggccgccggcggcagcggcgtgggcggcaagagaagcagcaagagcgacgccgacagcggcttcctgggcctgagacccaccagcgtggaccccgccctgagaagaagaagaagaggccccagaaacaagaagagaggctggagaagactggcccaggagcccctgggcctggaggtggaccagttcctggaggacgtgagactgcaggagagaaccagcggcggcctgctgagcgaggcccccaacgagaagctgttcttcgtggacaccggcagcaaggagaagggcctgaccaagaagagaaccaaggtgcagaagaagagcctgctgctgaagaagcccctgagagtggacctgatcctggagaacaccagcaaggtgcccgcccccaaggacgtgctggcccaccaggtgcccaacgccaagaagctgagaagaaaggagcagctgtgggagaagctggccaagcagggcgagctgcccagagaggtgagaagagcccaggccagactgctgaaccccagcgccaccagagccaagcccggcccccaggacaccgtggagagacccttctacgacctgtgggccagcgacaaccccctggacagacccctggtgggccaggacgagttcttcctggagcagaccaagaagaagggcgtgaagagacccgccagactgcacaccaagcccagccaggcccccgccgtggaggtggcccccgccggcgccagctacaaccccagcttcgaggaccaccagaccctgctgagcgccgcccacgaggtggagctgcagagacagaaggaggccgagaagctggagagacagctggccctgcccgccaccgagcaggccgccacccaggagagcaccttccaggagctgtgcgagggcctgctggaggagagcgacggcgagggcgagcccggccagggcgagggccccgaggccggcgacgccgaggtgtgccccacccccgccagacaccacagagaggaggacggcgccgccgccgccagaagactgtgcaccggctgcggctacagcagacccagatgcggcccccccggcagcggcaccagaagctgcagcggctgcgccggcagccccggcggccccgaggccggcggcgccagaagacagagaagaagacaggccagaagagaggccgaggccgacaagcccagaagactgggcagactgaagtaccaggcccccgacatcgacgtgcagctgagcagcgagctgaccgacagcctgagaaccctgaagcccgagggcaacatcctgagagacagattcaagagcttccagagaagaaacatgatcgagcccagagagagagccaagttcaagagaaagtacaaggtgaagctggtggagaagagagccttcagagagatccagctgtag

SEQ ID NO: 82985 - DNA, 792 bp, Artificial Sequence
  Description of Artificial Sequence: Synthetic coding sequence
atggccgccggcggcagcggcgtgggcggcaagagaagcagcaagagcgacgccgacagcggcttcctgggcctgagacccaccagcgtggaccccgccctgagaagaagaagaagaggccccagaaacaagaagagaggctggagaagactggcccaggagcccctgggcctggaggtggaccagttcctggaggacgtgagactgcaggagagaaccagcggcggcctgctgagcgaggcccccaacgagaagctgttcttcgtggacaccggcagcaaggagaagggcctgaccaagaagagaaccaaggtgcagaagaagagcctgctgctgaagaagcccctgagagtggacctgatcctggagaacaccagcaaggtgcccgcccccaaggacgtgctggcccaccaggtgcccaacgccaagaagctgagaagaaaggagcagctgtgggccagcgacaaccccctggacagacccctggtgggccaggacgagttcttcctggagcagaccaagaagaagggcgtgaagagaagagaggccgaggccgacaagcccagaagactgggcagactgaagtaccaggcccccgacatcgacgtgcagctgagcagcgagctgaccgacagcctgagaaccctgaagcccgagggcaacatcctgagagacagattcaagagcttccagagaagaaacatgatcgagcccagagagagagccaagttcaagagaaagtacaaggtgaagctggtggagaagagagccttcagagagatccagctgtag

SEQ ID NO: 82986 - DNA, 1656 bp, Artificial Sequence
  Description of Artificial Sequence: Synthetic coding sequence
atggccagaggcgccgagggcggcagaggcgacgccggctggggcctgagaggcgccctggccgccgtggccctgctgagcgccctgaacgccgccggcaccgtgttcgccctgtgccagtggagaggcctgagcagcgccctgagagccctggaggcccagagaggcagagagcagagagaggacagcgccctgagaagcttcctggccgagctgagcagagcccccagaggcgccagcgcccccccccaggaccccgccagcagcgccagaaacaagagaagccacagcggcgagcccgccccccacatcagagccgagagccacgacatgctgatgatgatgacctacagcatggtgcccatcagagtgatggtggacctgtgcaacagcaccaagggcatctgcctgaccggccccagcggcccccccggcccccccggcgccggcggcctgcccggccacaacggcctggacggccagcccggcccccagggccccaagggcgagaagggcgccaacggcaagagaggcaagatgggcatccccggcgccgccggcaaccccggcgagagaggcgagaagggcgaccacggcgagctgggcctgcagggcaacgagggcccccccggccagaagggcgagaagggcgacaagggcgacgtgagcaacgacgtgctgctggccggcgccaagggcgaccagggcccccccggcccccccggcccccccggcccccccggcccccccggcccccccggcagcagaagagccaagggccccagacagcccagcatgttcaacggccagtgccccggcgagacctgcgccatccccaacgacgacaccctggtgggcaaggccgacgagaaggccagcgagcaccacagcccccaggccgagagcatgatcaccagcatcggcaaccccgtgcaggtgctgaaggtgaccgagaccttcggcacctggatcagagagagcgccaacaagagcgacgacagaatctgggtgaccgagcacttcagcggcatcatggtgaaggagttcaaggaccagcccagcctgctgaacggcagctacaccttcatccacctgccctactacttccacggctgcggccacgtggtgtacaacaacagcctgtactaccacaagggcggcagcaacaccctggtgagattcgagttcggccaggagaccagccagaccctgaagctggagaacgccctgtacttcgacagaaagtacctgttcgccaacagcaagacctacttcaacctggccgtggacgagaagggcctgtggatcatctacgccagcagcgtggacggcagcagcatcctggtggcccagctggacgagagaaccttcagcgtggtgcagcacgtgaacaccacctaccccaagagcaaggccggcaacgccttcatcgccagaggcatcctgtacgtgaccgacaccaaggacatgagagtgaccttcgccttcgacctgctgggcggcaagcagatcaacgccaacttcgacctgagaaccagccagagcgtgctggccatgctggcctacaacatgagagaccagcacctgtacagctgggaggacggccacctgatgctgtaccccgtgcagttcctgagcaccaccctgaaccagtag

SEQ ID NO: 82987 - DNA, 1284 bp, Artificial Sequence
  Description of Artificial Sequence: Synthetic coding sequence
atggtggacctgtgcaacagcaccaagggcatctgcctgaccggccccagcggcccccccggcccccccggcgccggcggcctgcccggccacaacggcctggacggccagcccggcccccagggccccaagggcgagaagggcgccaacggcaagagaggcaagatgggcatccccggcgccgccggcaaccccggcgagagaggcgagaagggcgaccacggcgagctgggcctgcagggcaacgagggcccccccggccagaagggcgagaagggcgacaagggcgacgtgagcaacgacgtgctgctggccggcgccaagggcgaccagggcccccccggcccccccggcccccccggcccccccggcccccccggcccccccggcagcagaagagccaagggccccagacagcccagcatgttcaacggccagtgccccggcgagacctgcgccatccccaacgacgacaccctggtgggcaaggccgacgagaaggccagcgagcaccacagcccccaggccgagagcatgatcaccagcatcggcaaccccgtgcaggtgctgaaggtgaccgagaccttcggcacctggatcagagagagcgccaacaagagcgacgacagaatctgggtgaccgagcacttcagcggcatcatggtgaaggagttcaaggaccagcccagcctgctgaacggcagctacaccttcatccacctgccctactacttccacggctgcggccacgtggtgtacaacaacagcctgtactaccacaagggcggcagcaacaccctggtgagattcgagttcggccaggagaccagccagaccctgaagctggagaacgccctgtacttcgacagaaagtacctgttcgccaacagcaagacctacttcaacctggccgtggacgagaagggcctgtggatcatctacgccagcagcgtggacggcagcagcatcctggtggcccagctggacgagagaaccttcagcgtggtgcagcacgtgaacaccacctaccccaagagcaaggccggcaacgccttcatcgccagaggcatcctgtacgtgaccgacaccaaggacatgagagtgaccttcgccttcgacctgctgggcggcaagcagatcaacgccaacttcgacctgagaaccagccagagcgtgctggccatgctggcctacaacatgagagaccagcacctgtacagctgggaggacggccacctgatgctgtaccccgtgcagttcctgagcaccaccctgaaccagtag

SEQ ID NO: 82988 - DNA, 1284 bp, Artificial Sequence; identical to SEQ ID NO: 82987
  Description of Artificial Sequence: Synthetic coding sequence

SEQ ID NO: 82989 - DNA, 1575 bp, Artificial Sequence
  Description of Artificial Sequence: Synthetic coding sequence
atgcacagcctggacgagcccctggacctgaagctgagcatcaccaagctgagagccgccagagagaagagagagagaaccctgggcgtggtgagacccagagccctgcacagagagctgggcctggtggacgacagccccacccccggcagccccggcagcccccccagcggcttcctgctgaacagcaagttccccgagaaggtggagggcagattcagcgccgcccccctggtggacctgagcctgagcccccccagcggcctggacagccccaacggcagcagcagcctgagccccgagagacagggcaacggcgacctgccccccgtgcccagcgccagcgacttccagcccctgagatacctggacggcgtgcccagcagcttccagttcttcctgcccctgggcagcggcggcgccctgcacctgcccgccagcagcttcctgaccccccccaaggacaagtgcctgagccccgacctgcccctgcccaagcagctggtgtgcagatgggccaagtgcaaccagctgttcgagctgctgcaggacctggtggaccacgtgaacgactaccacgtgaagcccgagaaggacgccggctactgctgccactgggagggctgcgccagacacggcagaggcttcaacgccagatacaagatgctgatccacatcagaacccacaccaacgagaagccccacagatgccccacctgcagcaagagcttcagcagactggagaacctgaagatccacaacagaagccacaccggcgagaagccctacgtgtgcccctacgagggctgcaacaagagatacagcaacagcagcgacagattcaagcacaccagaacccactacgtggacaagccctactactgcaagatgcccggctgccacaagagatacaccgaccccagcagcctgagaaagcacatcaaggcccacggccacttcgtgagccacgagcagcaggagctgctgcagctgagacccccccccaagccccccctgcccgcccccgacggcggcccctacgtgagcggcgcccagatcatcatccccaaccccgccgccctgttcggcggccccggcctgcccggcctgcccctgcccctggcccccggccccctggacctgagcgccctggcctgcggcaacggcggcggcagcggcggcggcggcggcatgggccccggcctgcccggccccgtgctgcccctgaacctggccaagaaccccctgctgcccagccccttcggcgccggcggcctgggcctgcccgtggtgagcctgctggccggcgccgccggcggcaaggccgagggcgagaagggcagaggcagcgtgcccaccagagccctgggcatggagggccacaagacccccctggagagaaccgagagcagctgcagcagacccagccccgacggcctgcccctgctgcccggcaccgtgctggacctgagcaccggcgtgaacagcgccgccagcagccccgaggccctggcccccggctgggtggtgatcccccccggcagcgtgctgctgaagcccgccgtggtgaactag

SEQ ID NO: 82990 - DNA, 1575 bp, Artificial Sequence; identical to SEQ ID NO: 82989
  Description of Artificial Sequence: Synthetic coding sequence

SEQ ID NO: 82991 - DNA, 2328 bp, Artificial Sequence
  Description of Artificial Sequence: Synthetic coding sequence
atgatggtgcagagactgggcctgatcagcccccccgccagccaggtgagcaccgcctgcaaccagatcagccccagcctgcagagagccatgaacgccgccaacctgaacatcccccccagcgacaccagaagcctgatcagcagagagagcctggccagcaccaccctgagcctgaccgagagccagagcgccagcagcatgaagcaggagtggagccagggctacagagccctgcccagcctgagcaaccacggcagccagaacggcctggacctgggcgacctgctgagcctgccccccggcaccagcatgagcagcaacagcgtgagcaacagcctgcccagctacctgttcggcaccgagagcagccacagcccctaccccagccccagacacagcagcaccagaagccacagcgccagaagcaagaagagagccctgagcctgagccccctgagcgacggcatcggcatcgacttcaacaccatcatcagaaccagccccaccagcctggtggcctacatcaacggcagcagagccagccccgccaacctgagcccccagcccgaggtgtacggccacttcctgggcgtgagaggcagctgcatcccccagcccagacccgtgcccggcagccagaagggcgtgctggtggcccccggcggcctggccctgcccgcctacggcgaggacggcgccctggagcacgagagaatgcagcagctggagcacggcggcctgcagcccggcctggtgaaccacatggtggtgcagcacggcctgcccggccccgacagccagagcgccggcctgttcaagaccgagagactggaggagttccccggcagcaccgtggacctgccccccgccccccccctgccccccctgccccccccccccggccccccccccccctaccacgcccacgcccacctgcaccaccccgagctgggcccccacgcccagcagctggccctgccccaggccaccctggacgacgacggcgagatggacggcatcggcggcaagcactgctgcagatggatcgactgcagcgccctgtacgaccagcaggaggagctggtgagacacatcgagaaggtgcacatcgaccagagaaagggcgaggacttcacctgcttctgggccggctgccccagaagatacaagcccttcaacgccagatacaagctgctgatccacatgagagtgcacagcggcgagaagcccaacaagtgcaccttcgagggctgcgagaaggccttcagcagactggagaacctgaagatccacctgagaagccacaccggcgagaagccctacctgtgccagcaccccggctgccagaaggccttcagcaacagcagcgacagagccaagcaccagagaacccacctggacaccaagccctacgcctgccagatccccggctgcaccaagagatacaccgaccccagcagcctgagaaagcacgtgaaggcccacagcagcaaggagcagcaggccagaaagaagctgagaagcagcaccgagctgcaccccgacctgctgaccgactgcctgaccgtgcagagcctgcagcccgccaccagccccagagacgccgccgccgagggcaccgtgggcagaagccccggccccggccccgacctgtacagcgcccccatcttcagcagcaactacagcagcagaagcggcaccgccgccggcgccgtgccccccccccaccccgtgagccaccccagccccggccacaacgtgcagggcagcccccacaaccccagcagccagctgccccccctgaccgccgtggacgccggcgccgagagattcgcccccagcgcccccagcccccaccacatcagccccagaagagtgcccgcccccagcagcatcctgcagagaacccagcccccctacacccagcagcccagcggcagccacctgaagagctaccagcccgagaccaacagcagcttccagcccaacggcatccacgtgcacggcttctacggccagctgcagaagttctgccccccccactaccccgacagccagagaatcgtgccccccgtgagcagctgcagcgtggtgcccagcttcgaggactgcctggtgcccaccagcatgggccaggccagcttcgacgtgttccacagagccttcagcacccacagcggcatcaccgtgtacgacctgcccagcagcagcagcagcctgttcggcgagagcctgagaagcggcgccgaggacgccaccttcctgcagatcagcaccgtggacagatgccccagccagctgagcagcgtgtacaccgagggctag

SEQ ID NO: 82992 - DNA, 2793 bp, Artificial Sequence
  Description of Artificial Sequence: Synthetic coding sequence
atgaacggcagaagctgcagcatgagcctgcacagaaccagcggcaccccccagggccccagaatggtgagcggccaccacatccccgccatcagagcccacagcggcacccccggccccagcccctgcggcagcaccagcagccccaccatggccagcctggccaacaacctgcacctgaagatgcccagcggcggcggcatggccccccagaacaacgtggccgagagcagaatccacctgcccgccctgagccccagaagacagatgctgaccaacggcaagcccagattccaggtgacccaggccggcggcatgagcggcagccacaccctgaagcccaagcagcaggagttcggcagccccttcccccccaaccccggcaagggcgccctgggcttcggcccccagtgcaagagcatcggcaagggcagctgcaacaacctggtggtgaccagcagccccatgatggtgcagagactgggcctgatcagcccccccgccagccaggtgagcaccgcctgcaaccagatcagccccagcctgcagagagccatgaacgccgccaacctgaacatcccccccagcgacaccagaagcctgatcagcagagagagcctggccagcaccaccctgagcctgaccgagagccagagcgccagcagcatgaagcaggagtggagccagggctacagagccctgcccagcctgagcaaccacggcagccagaacggcctggacctgggcgacctgctgagcctgccccccggcaccagcatgagcagcaacagcgtgagcaacagcctgcccagctacctgttcggcaccgagagcagccacagcccctaccccagccccagacacagcagcaccagaagccacagcgccagaagcaagaagagagccctgagcctgagccccctgagcgacggcatcggcatcgacttcaacaccatcatcagaaccagccccaccagcctggtggcctacatcaacggcagcagagccagccccgccaacctgagcccccagcccgaggtgtacggccacttcctgggcgtgagaggcagctgcatcccccagcccagacccgtgcccggcagccagaagggcgtgctggtggcccccggcggcctggccctgcccgcctacggcgaggacggcgccctggagcacgagagaatgcagcagctggagcacggcggcctgcagcccggcctggtgaaccacatggtggtgcagcacggcctgcccggccccgacagccagagcgccggcctgttcaagaccgagagactggaggagttccccggcagcaccgtggacctgccccccgccccccccctgccccccctgccccccccccccggccccccccccccctaccacgcccacgcccacctgcaccaccccgagctgggcccccacgcccagcagctggccctgccccaggccaccctggacgacgacggcgagatggacggcatcggcggcaagcactgctgcagatggatcgactgcagcgccctgtacgaccagcaggaggagctggtgagacacatcgagaaggtgcacatcgaccagagaaagggcgaggacttcacctgcttctgggccggctgccccagaagatacaagcccttcaacgccagatacaagctgctgatccacatgagagtgcacagcggcgagaagcccaacaagtgcaccttcgagggctgcgagaaggccttcagcagactggagaacctgaagatccacctgagaagccacaccggcgagaagccctacctgtgccagcaccccggctgccagaaggccttcagcaacagcagcgacagagccaagcaccagagaacccacctggacaccaagccctacgcctgccagatccccggctgcaccaagagatacaccgaccccagcagcctgagaaagcacgtgaaggcccacagcagcaaggagcagcaggccagaaagaagctgagaagcagcaccgagctgcaccccgacctgctgaccgactgcctgaccgtgcagagcctgcagcccgccaccagccccagagacgccgccgccgagggcaccgtgggcagaagccccggccccggccccgacctgtacagcgcccccatcttcagcagcaactacagcagcagaagcggcaccgccgccggcgccgtgccccccccccaccccgtgagccaccccagccccggccacaacgtgcagggcagcccccacaaccccagcagccagctgccccccctgaccgccgtggacgccggcgccgagagattcgcccccagcgcccccagcccccaccacatcagccccagaagagtgcccgcccccagcagcatcctgcagagaacccagcccccctacacccagcagcccagcggcagccacctgaagagctaccagcccgagaccaacagcagcttccagcccaacggcatccacgtgcacggcttctacggccagctgcagaagttctgccccccccactaccccgacagccagagaatcgtgccccccgtgagcagctgcagcgtggtgcccagcttcgaggactgcctggtgcccaccagcatgggccaggccagcttcgacgtgttccacagagccttcagcacccacagcggcatcaccgtgtacgacctgcccagcagcagcagcagcctgttcggcgagagcctgagaagcggcgccgaggacgccaccttcctgcagatcagcaccgtggacagatgccccagccagctgagcagcgtgtacaccgagggctag

SEQ ID NO: 82993 - DNA, 270 bp, Artificial Sequence
  Description of Artificial Sequence: Synthetic coding sequence
atgatggtgcagagactgggcctgatcagcccccccgccagccaggtgagcaccgcctgcaaccagatcagccccagcctgcagagagccatgaacgccgccaacctgaacatcccccccagcgacaccagaagcctgatcagcagagagagcctggccagcaccaccctgagcctgaccgagagccagagcgccagcagcatgaagcaggagtggagccagggctacagagccctgcccagcctgagcaaccacggcagccagaactag

SEQ ID NO: 82994 - DNA, 735 bp, Artificial Sequence
  Description of Artificial Sequence: Synthetic coding sequence
atgaacggcagaagctgcagcatgagcctgcacagaaccagcggcaccccccagggccccagaatggtgagcggccaccacatccccgccatcagagcccacagcggcacccccggccccagcccctgcggcagcaccagcagccccaccatggccagcctggccaacaacctgcacctgaagatgcccagcggcggcggcatggccccccagaacaacgtggccgagagcagaatccacctgcccgccctgagccccagaagacagatgctgaccaacggcaagcccagattccaggtgacccaggccggcggcatgagcggcagccacaccctgaagcccaagcagcaggagttcggcagccccttcccccccaaccccggcaagggcgccctgggcttcggcccccagtgcaagagcatcggcaagggcagctgcaacaacctggtggtgaccagcagccccatgatggtgcagagactgggcctgatcagcccccccgccagccaggtgagcaccgcctgcaaccagatcagccccagcctgcagagagccatgaacgccgccaacctgaacatcccccccagcgacaccagaagcctgatcagcagagagagcctggccagcaccaccctgagcctgaccgagagccagagcgccagcagcatgaagcaggagtggagccagggctacagagccctgcccagcctgagcaaccacggcagccagaactag

SEQ ID NO: 82995 - DNA, 270 bp, Artificial Sequence; identical to SEQ ID NO: 82993
  Description of Artificial Sequence: Synthetic coding sequence

SEQ ID NO: 82996 - DNA, 270 bp, Artificial Sequence; identical to SEQ ID NO: 82993
  Description of Artificial Sequence: Synthetic coding sequence

SEQ ID NO: 82997 - DNA, 735 bp, Artificial Sequence; identical to SEQ ID NO: 82994
  Description of Artificial Sequence: Synthetic coding sequence

SEQ ID NO: 82998 - DNA, 219 bp, Artificial Sequence
  Description of Artificial Sequence: Synthetic coding sequence
atgcacagaagaagactggccctgggcctgggcttctgcctgctggccggcaccagcctgagcgtgctgtgggtgtacctggagaactggctgcccgtgagctacgtgccctactacctgccctgccccgagatcctgctggagtacagaggcgtgatcagcgcccactgcaacctgcacctgcccggcagcagcaactgccacgccagcgccacctag

SEQ ID NO: 82999 - DNA, 483 bp, Artificial Sequence
  Description of Artificial Sequence: Synthetic coding sequence
atgcacagaagaagactggccctgggcctgggcttctgcctgctggccggcaccagcctgagcgtgctgtgggtgtacctggagaactggctgcccgtgagctacgtgccctactacctgccctgccccgagatcctgcccatgatgatggccctgagctgcctgtgccaccagcagcacgaggccgccctgcaggagggcgaggccacccccgccagaggcatggtgaccgtgcccagcgcccaggccgccggcgcccaggcccacaccgccgccgacacccacaccctggtgggcgcccacagactgagaggcaacctgcagcccagagccagcgccgcccacctgcccgccaccgagcccgaccactggggccacggcgtgtgcagaggcgaggtgcacagcttccaccccgtgctgcccggcgtgagcagaggcgtgctgcacgcctgggtgcccggcgccctgctgcacctgcactag

SEQ ID NO: 83000 - DNA, 1044 bp, Artificial Sequence
  Description of Artificial Sequence: Synthetic coding sequence
atgcacagaagaagactggccctgggcctgggcttctgcctgctggccggcaccagcctgagcgtgctgtgggtgtacctggagaactggctgcccgtgagctacgtgccctactacctgccctgccccgagatcttcaacatgaagctgcactacaagagagagaagcccctgcagcccgtggtgtggagccagtacccccagcccaagctgctggagcacagacccacccagctgctgaccctgaccccctggctggcccccatcgtgagcgagggcaccttcaaccccgagctgctgcagcacatctaccagcccctgaacctgaccatcggcgtgaccgtgttcgccgtgggcaagtacacccacttcatccagagcttcctggagagcgccgaggagttcttcatgagaggctacagagtgcactactacatcttcaccgacaaccccgccgccgtgcccggcgtgcccctgggcccccacagactgctgagcagcatccccatccagggccacagccactgggaggagaccagcatgagaagaatggagaccatcagccagcacatcgccaagagagcccacagagaggtggactacctgttctgcctggacgtggacatggtgttcagaaacccctggggccccgagaccctgggcgacctggtggccgccatccaccccagctactacgccgtgcccagacagcagttcccctacgagagaagaagagtgagcaccgccttcgtggccgacagcgagggcgacttctactacggcggcgccgtgttcggcggccaggtggccagagtgtacgagttcaccagaggctgccacatggccatcctggccgacaaggccaacggcatcatggccgcctggagagaggagagccacctgaacagacacttcatcagcaacaagcccagcaaggtgctgagccccgagtacctgtgggacgacagaaagccccagccccccagcctgaagctgatcagattcagcaccctggacaaggacatcagctgcctgagaagctag

SEQ ID NO: 83001 - DNA, 885 bp, Artificial Sequence
  Description of Artificial Sequence: Synthetic coding sequence
atgcacagaagaagactggccctgggcctgggcttctgcctgctggccggcaccagcctgagcgtgctgtgggtgtacctggagaactggctgcccgtgagctacgtgccctactacctgccctgccccgagatcttcaacatgaagctgcactacaagagagagaagcccctgcagcccgtggtgtggagccagtacccccagcccaagctgctggagcacagacccacccagctgctgaccctgaccccctggctggcccccatcgtgagcgagggcaccttcaaccccgagctgctgcagcacatctaccagcccctgaacctgaccatcggcgtgaccgtgttcgccgtgggcaaccccagctggagccagcccagaagcagcagctgcgtgggcaccggctgcaccaccaccagcagcctgaccaccctgcagcccttccccggcagcagatgggtgcccaccggcttcagcgcccccagccccagcagagtgacccccaccggcagaagacacccctgcgccggctggagacccagcgccagcaccctgctgagaggcctgaccggcagatggaccaccagcagcgccctgatgtggacctggtgcttcggcaccagaggcgccctgagaccctgggagacctggtggctgcccttcacccaggccaccacccccttccccgccagcagcagccccatgagcgccggcgtgttccccctgcccctgtggcagaccgccaagggcaccagcatcatggtgggccagagcagcggcggcagatggcccggctacatgagcctgctgggcgccgccacctggcccagctggagaaccagacccatggccagctggctgcccggcggcagaaaggccacctag

SEQ ID NO: 83002 - DNA, 993 bp, Artificial Sequence
  Description of Artificial Sequence: Synthetic coding sequence
atgcacagaagaagactggccctgggcctgggcttctgcctgctggccggcaccagcctgagcgtgctgtgggtgtacctggagaactggctgcccgtgagctacgtgccctactacctgccctgccccgagatcctgagccagtacccccagcccaagctgctggagcacagacccacccagctgctgaccctgaccccctggctggcccccatcgtgagcgagggcaccttcaaccccgagctgctgcagcacatctaccagcccctgaacctgaccatcggcgtgaccgtgttcgccgtgggcaagtacacccacttcatccagagcttcctggagagcgccgaggagttcttcatgagaggctacagagtgcactactacatcttcaccgacaaccccgccgccgtgcccggcgtgcccctgggcccccacagactgctgagcagcatccccatccagggccacagccactgggaggagaccagcatgagaagaatggagaccatcagccagcacatcgccaagagagcccacagagaggtggactacctgttctgcctggacgtggacatggtgttcagaaacccctggggccccgagaccctgggcgacctggtggccgccatccaccccagctactacgccgtgcccagacagcagttcccctacgagagaagaagagtgagcaccgccttcgtggccgacagcgagggcgacttctactacggcggcgccgtgttcggcggccaggtggccagagtgtacgagttcaccagaggctgccacatggccatcctggccgacaaggccaacggcatcatggccgcctggagagaggagagccacctgaacagacacttcatcagcaacaagcccagcaaggtgctgagccccgagtacctgtgggacgacagaaagccccagccccccagcctgaagctgatcagattcagcaccctggacaaggacatcagctgcctgagaagctag

SEQ ID NO: 83003 - DNA, 1434 bp, Artificial Sequence
  Description of Artificial Sequence: Synthetic coding sequence
atgcccccctgccagccccagagacccctgctgctgctgctgctgctgctggcctgccagccccaggtgcccagcgcccaggtgatggacttcctgttcgagaagtggaagctgtacggcgaccagtgccaccacaacctgagcctgctgcccccccccaccgagctggtgtgcaacagaaccttcgacaagtacagctgctggcccgacacccccgccaacaccaccgccaacatcagctgcccctggtacctgccctggcaccacaaggtgcagcacagattcgtgttcaagagatgcggccccgacggccagtgggtgagaggccccagaggccagccctggagagacgccagccagtgccagatggacggcgaggagatcgaggtgcagaaggaggtggccaagatgtacagcagcttccaggtgatgtacaccgtgggctacagcctgagcctgggcgccctgctgctggccctggccatcctgggcggcctgagcaagctgcactgcaccagaaacgccatccacgccaacctgttcgccagcttcgtgctgaaggccagcagcgtgctggtgatcgacggcctgctgagaaccagatacagccagaagatcggcgacgacctgagcgtgagcacctggctgagcgacggcgccgtggccggctgcagagtggccgccgtgttcatgcagtacggcatcgtggccaactactgctggctgctggtggagggcctgtacctgcacaacctgctgggcctggccaccctgcccgagagaagcttcttcagcctgtacctgggcatcggctggggcgcccccatgctgttcgtggtgccctgggccgtggtgaagtgcctgttcgagaacgtgcagtgctggaccagcaacgacaacatgggcttctggtggatcctgagattccccgtgttcctggccatcctgatcaacttcttcatcttcgtgagaatcgtgcagctgctggtggccaagctgagagccagacagatgcaccacaccgactacaagttcagactggccaagagcaccctgaccctgatccccctgctgggcgtgcacgaggtggtgttcgccttcgtgaccgacgagcacgcccagggcaccctgagaagcgccaagctgttcttcgacctgttcctgagcagcttccagggcctgctggtggccgtgctgtactgcttcctgaacaaggaggtgcagagcgagctgagaagaagatggcacagatggagactgggcaaggtgctgtgggaggagagaaacaccagcaaccacagagccagcagcagccccggccacggcccccccagcaaggagctgcagttcggcagaggcggcggcagccaggacagcagcgccgagacccccctggccggcggcctgcccagactggccgagagccccttctag

SEQ ID NO: 83004 - DNA, 1392 bp, Artificial Sequence
  Description of Artificial Sequence: Synthetic coding sequence
atggccggcgcccccggccccctgagactggccctgctgctgctgggcatggtgggcagagccggccccagaccccagggcgccaccgtgagcctgtgggagaccgtgcagaagtggagagagtacagaagacagtgccagagaagcctgaccgaggaccccccccccgccaccgacctgttctgcaacagaaccttcgacgagtacgcctgctggcccgacggcgagcccggcagcttcgtgaacgtgagctgcccctggtacctgccctgggccagcagcgtgccccagggccacgtgtacagattctgcaccgccgagggcctgtggctgcagaaggacaacagcagcctgccctggagagacctgagcgagtgcgaggagagcaagagaggcgagagaagcagccccgaggagcagctgctgttcctgtacatcatctacaccgtgggctacgccctgagcttcagcgccctggtgatcgccagcgccatcctgctgggcttcagacacctgcactgcaccagaaactacatccacctgaacctgttcgccagcttcatcctgagagccctgagcgtgttcatcaaggacgccgccctgaagtggatgtacagcaccgccgcccagcagcaccagtgggacggcctgctgagctaccaggacagcctgagctgcagactggtgttcctgctgatgcagtactgcgtggccgccaactactactggctgctggtggagggcgtgtacctgtacaccctgctggccttcagcgtgctgagcgagcagtggatcttcagactgtacgtgagcatcggctggggcgtgcccctgctgttcgtggtgccctggggcatcgtgaagtacctgtacgaggacgagggctgctggaccagaaacagcaacatgaactactggctgatcatcagactgcccatcctgttcgccatcggcgtgaacttcctgatcttcgtgagagtgatctgcatcgtggtgagcaagctgaaggccaacctgatgtgcaagaccgacatcaagtgcagactggccaagagcaccctgaccctgatccccctgctgggcacccacgaggtgatcttcgccttcgtgatggacgagcacgccagaggcaccctgagattcatcaagctgttcaccgagctgagcttcaccagcttccagggcctgatggtggccatcctgtactgcttcgtgaacaacgaggtgcagctggagttcagaaagagctgggagagatggagactggagcacctgcacatccagagagacagcagcatgaagcccctgaagtgccccaccagcagcctgagcagcggcgccaccgccggcagcagcatgtacaccgccacctgccaggccagctgcagctag

SEQ ID NO: 83005 - DNA, 1662 bp, Artificial Sequence
  Description of Artificial Sequence: Synthetic coding sequence
atgaagctgggcagcagcagagccggccccggcagaggcagcgccggcctgctgcccggcgtgcacgagctgcccatgggcatccccgccccctggggcaccagccccctgagcttccacagaaagtgcagcctgtgggcccccggcagacccttcctgaccctggtgctgctggtgagcatcaagcaggtgaccggcagcctgctggaggagaccaccagaaagtgggcccagtacaagcaggcctgcctgagagacctgctgaaggagcccagcggcatcttctgcaacggcaccttcgaccagtacgtgtgctggccccacagcagccccggcaacgtgagcgtgccctgccccagctacctgccctggtggagcgaggagagcagcggcagagcctacagacactgcctggcccagggcacctggcagaccatcgagaacgccaccgacatctggcaggacgacagcgagtgcagcgagaaccacagcttcaagcagaacgtggacagatacgccctgctgagcaccctgcagctgatgtacaccgtgggctacagcttcagcctgatcagcctgttcctggccctgaccctgctgctgttcctgagaaagctgcactgcaccagaaactacatccacatgaacctgttcgccagcttcatcctgagaaccctggccgtgctggtgaaggacgtggtgttctacaacagctacagcaagagacccgacaacgagaacggctggatgagctacctgagcgagatgagcaccagctgcagaagcgtgcaggtgctgctgcactacttcgtgggcgccaactacctgtggctgctggtggagggcctgtacctgcacaccctgctggagcccaccgtgctgcccgagagaagactgtggcccagatacctgctgctgggctgggccttccccgtgctgttcgtggtgccctggggcttcgccagagcccacctggagaacaccggctgctggaccaccaacggcaacaagaagatctggtggatcatcagaggccccatgatgctgtgcgtgaccgtgaacttcttcatcttcctgaagatcctgaagctgctgatcagcaagctgaaggcccaccagatgtgcttcagagactacaagtacagactggccaagagcaccctggtgctgatccccctgctgggcgtgcacgagatcctgttcagcttcatcaccgacgaccaggtggagggcttcgccaagctgatcagactgttcatccagctgaccctgagcagcttccacggcttcctggtggccctgcagtacggcttcgccaacggcgaggtgaaggccgagctgagaaagtactgggtgagattcctgctggccagacacagcggctgcagagcctgcgtgctgggcaaggacttcagattcctgggcaagtgccccaagaagctgagcgagggcgacggcgccgagaagctgagaaagctgcagcccagcctgaacagcggcagactgctgcacctggccatgagaggcctgggcgagctgggcgcccagccccagcaggaccacgccagatggcccagaggcagcagcctgagcgagtgcagcgagggcgacgtgaccatggccaacaccatggaggagatcctggaggagagcgagatctag

SEQ ID NO: 83006 - DNA, 1053 bp, Artificial Sequence
  Description of Artificial Sequence: Synthetic coding sequence
atgggcatccccgccccctggggcaccagccccctgagcttccacagaaagtgcagcctgtgggcccccggcagacccttcctgaccctggtgctgctggtgagcatcaagcaggtgaccggcagcctgctggaggagaccaccagaaagtgggcccagtacaagcaggcctgcctgagagacctgctgaaggagcccagcggcatcttctgcaacggcaccttcgaccagtacgtgtgctggccccacagcagccccggcaacgtgagcgtgccctgccccagctacctgccctggtggagcgaggagagcagcggcagagcctacagacactgcctggcccagggcacctggcagaccatcgagaacgccaccgacatctggcaggacgacagcgagtgcagcgagaaccacagcttcaagcagaacgtggacagatacgccctgctgagcaccctgcagctgatgtacaccgtgggctacagcttcagcctgatcagcctgttcctggccctgaccctgctgctgttcctgagaaagctgcactgcaccagaaactacatccacatgaacctgttcgccagcttcatcctgagaaccctggccgtgctggtgaaggacgtggtgttctacaacagctacagcaagagacccgacaacgagaacggctggatgagctacctgagcgagatgagcaccagctgcagaagcgtgcaggtgctgctgcactacttcgtgggcgccaactacctgtggctgctggtggagggcctgtacctgcacaccctgctggagcccaccgtgctgcccgagagaagactgtggcccagatacctgctgctgggctgggccttccccgtgctgttcgtggtgccctggggcttcgccagagcccacctggagaacaccggctgctggaccaccaacggcaacaagaagatctggtggatcatcagaggccccatgatgctgtgcgtgaccgccctgggcctggaggagaccggcctgaagagaaacggcagcatccccttcggccacaaggaggacatctag

SEQ ID NO: 83007 - DNA, 1665 bp, Artificial Sequence
  Description of Artificial Sequence: Synthetic coding sequence
atgaagctgggcagcagcagagccggccccggcagaggcagcgccggcctgctgcccggcgtgcacgagctgcccatgggcatccccgccccctggggcaccagccccctgagcttccacagaaagtgcagcctgtgggcccccggcagacccttcctgaccctggtgctgctggtgagcatcaagcaggtgaccggcagcctgctggaggagaccaccagaaagtgggcccagtacaagcaggcctgcctgagagacctgctgaaggagcccagcggcatcttctgcaacggcaccttcgaccagtacgtgtgctggccccacagcagccccggcaacgtgagcgtgccctgccccagctacctgccctggtggagcgaggagagcagcggcagagcctacagacactgcctggcccagggcacctggcagaccatcgagaacgccaccgacatctggcaggacgacagcgagtgcagcgagaaccacagcttcaagcagaacgtggacagatacgccctgctgagcaccctgcagctgatgtacaccgtgggctacagcttcagcctgatcagcctgttcctggccctgaccctgctgctgttcctgagaaagctgcactgcaccagaaactacatccacatgaacctgttcgccagcttcatcctgagaaccctggccgtgctggtgaaggacgtggtgttctacaacagctacagcaagagacccgacaacgagaacggctggatgagctacctgagcgagatgagcaccagctgcagaagcgtgcaggtgctgctgcactacttcgtgggcgccaactacctgtggctgctggtggagggcctgtacctgcacaccctgctggagcccaccgtgctgcccgagagaagactgtggcccagatacctgctgctgggctgggccttccccgtgctgttcgtggtgccctggggcttcgccagagcccacctggagaacaccggctgctggaccaccaacggcaacaagaagatctggtggatcatcagaggccccatgatgctgtgcgtgaccgtgaacttcttcatcttcctgaagatcctgaagctgctgatcagcaagctgaaggcccaccagatgtgcttcagagactacaagtacagactggccaagagcaccctggtgctgatccccctgctgggcgtgcacgagatcctgttcagcttcatcaccgacgaccaggtggagggcttcgccaagctgatcagactgttcatccagctgaccctgagcagcttccacggcttcctggtggccctgcagtacggcttcgccaacggcgaggtgaaggccgagctgagaaagtactgggtgagattcctgctggccagacacagcggctgcagagcctgcgtgctgggcaaggacttcagattcctgggcaagtgccccaagaagctgagcgagggcgacggcgccgagaagctgagaaagctgcagcccagcctgaacagcggcagactgctgcacctggccatgagaggcctgggcgagctgggcgcccagccccagcaggaccacgccagatggcccagaggcagcagcctgagcgagtgcagcgagggcgacgtgaccatggccaacaccatggaggagatcctggaggagaagagaagccagtag

SEQ ID NO: 83008 - DNA, 687 bp, Artificial Sequence
  Description of Artificial Sequence: Synthetic coding sequence
tgagccaccgacatctggcaggacgacagcgagtgcagcgagaaccacagcttcaagcagaacgtggacagatacgccctgctgagcaccctgcagctgatgtacaccgtgggctacagcttcagcctgatcagcctgttcctggccctgaccctgctgctgttcctgagaaagctgcactgcaccagaaactacatccacatgaacctgttcgccagcttcatcctgagaaccctggccgtgctggtgaaggacgtggtgttctacaacagctacagcaagagacccgacaacgagaacggctggatgagctacctgagcgagatgagcaccagctgcagaagcgtgcaggtgctgctgcactacttcgtgggcgccaactacctgtggctgctggtggagggcctgtacctgcacaccctgctggagcccaccgtgctgcccgagagaagactgtggcccagatacctgctgctgggctgggccttccccgtgctgttcgtggtgccctggggcttcgccagagcccacctggagaacaccggctgctggaccaccaacggcaacaagaagatctggtggatcatcagaggccccatgatgctgtgcgtgaccgccctgggcctggaggagaccggcctgaagagaaacggcagcatccccttcggccacaaggaggacatctag

SEQ ID NO: 83009 - DNA, 1725 bp, Artificial Sequence
  Description of Artificial Sequence: Synthetic coding sequence
atggagcccaccgagaacccctgccagggccccctgggccagaaggccggcgagaagcccctggccgccggccccggcgaggaggagctgctgagaggcagcgccccccacgcccaggacacccagagcgaggagctgccccccagctgcaccatcagcggcgagaagaagccccccgccgtgagcggcgaggccaccggcgccgacgccggcagactgtgccccccccccagaagcagagccccccacaaggacagaaccctggccagaagcagaccccagacccagggcgaggactgcagcctgcccgtgggcgaggtgaagatcggcaagagaagctacagccccgcccccggcaagcagaagaagcccaacgccatgggcctggcccccaccagcagccccggcgcccccaacagcgccagagccacccacaaccccgtgccctgcggcagcggcagaggcccctgccacctggccaacctgctgagcaccctggcccagagcaaccagaacagagaccacaagcagggcccccccgaggtgacctgccagatcagaaagaagaccagaaccctgtacagaagcgaccagctggaggagctggagaagatcttccaggaggaccactaccccgacagcgacaagagaagagagatcgcccagaccgtgggcgtgaccccccagagaatcatggtgtggttccagaacagaagagccaagtggagaaagatggagaagctgaacggcaaggagagcaaggacaaccccgccgcccccggccccgccagcagccagtgcagcagcgccgccgagatcctgcccgccgtgcccatggagcccaagcccgaccccttcccccaggagagccccctggacaccttccccgagccccccatgctgctgaccagcgaccagaccctggcccccacccagcccagcgagggcgcccagagagtggtgaccccccccctgttcagccccccccccgtgagaagagccgacctgcccttccccctgggccccgtgcacaccccccagctgatgcccctgctgatggacgtggccggcagcgacagcagccacaaggacggcccctgcggcagctggggcaccagcatcaccctgccccccccctgcagctacctggaggagctggagccccaggactaccagcagagcaaccagcccggccccttccagttcagccaggccccccagccccccctgttccagagcccccagcccaagctgccctacctgcccaccttccccttcagcatgcccagcagcctgaccctgcccccccccgaggacagcctgttcatgttcccctgcggccccagcggcggcaccagccagggctactgccccggcgccagcagcggccagatcctgatgcagccccccgccggcaacatcggcaccgccagctggagcgacccctgcctgcccgagctgcccttccccggccccttctgcccccaggccctgggccacccccccggcggcgacggctacttccccgacctgttccccaccccctgcccccaggccctgggcagacagcccagcagcgccctgagctggatgcccgagggcgccagacccggcaccggccccctgctgagcaaggccaaggaggagccccccgccgccagcctggaccagcccagcgccctggaggaggccagaggcgacgacaagaacagccacgtgccctag

SEQ ID NO: 83010 - DNA, 1722 bp, Artificial Sequence
  Description of Artificial Sequence: Synthetic coding sequence
atggccaacgccgaggtgagcgtgcccgtgggcgacgtggtggtggtgcccaccgagggcaacgagggcgagaaccccgaggacaccaagacccaggtgatcctgcagctgcagcccgtgcagcagggcctgttcatcgacggccacttctacaacagaatctacgaggccggcagcgagaacaacaccgccgtggtggccgtggagacccacaccatccacaagatcgaggagggcatcgacaccggcaccatcgaggccaacgaggacatggagatcgcctaccccatcacctgcggcgagagcaaggccatcctgctgtggaagaagttcgtgtgccccggcatcaacgtgaagtgcgtgaagttcaacgaccagctgatcagccccaagcacttcgtgcacctggccggcaagagcaccctgaaggactggaagagagccatcagactgggcggcatcatgctgagaaagatgatggacagcggccagatcgacttctaccagcacgacaaggtgtgcagcaacacctgcagaagcaccaagttcgacctgctgatcagcagcgccagagcccccgtgcccggccagcagaccagcgtggtgcagacccccaccagcgccgacggcagcatcacccagatcgccatcagcgaggagagcatggaggaggccggcctggagtggaacagcgccctgaccgccgccgtgaccatggccaccgaggagggcgtgaagaaggacagcgaggagatcagcgaggacaccctgatgttctggaagggcatcgccgacgtgggcctgatggaggaggtggtgtgcaacatccagaaggagatcgaggagctgctgagaggcgtgcagcagagactgatccaggcccccttccaggtgaccgacgccgccgtgctgaacaacgtggcccacaccttcggcctgatggacaccgtgaagaaggtgctggacaacagaagaaaccaggtggagcagggcgaggagcagttcctgtacaccctgaccgacctggagagacagctggaggagcagaagaagcagggccaggaccacagactgaagagccagaccgtgcagaacgtggtgctgatgcccgtgagcacccccaagccccccaagagacccagactgcagagacccgccagcaccaccgtgctgagccccagcccccccgtgcagcagccccagttcaccgtgatcagccccatcaccatcacccccgtgggccagagcttcagcatgggcaacatccccgtggccaccctgagccagggcagcagccccgtgaccgtgcacaccctgcccagcggcccccagctgttcagatacgccaccgtggtgagcagcgccaagagcagcagccccgacaccgtgaccatccaccccagcagcagcctggccctgctgagcagcaccgccatgcaggacggcagcaccctgggcaacatgaccaccatggtgagccccgtggagctggtggccatggagagcggcctgaccagcgccatccaggccgtggagagcaccagcgaggacggccagaccatcatcgagatcgaccccgcccccgaccccgaggccgaggacaccgagggcaaggccgtgatcctggagaccgagctgagaaccgaggagaaggtggtggccgagatggaggagcaccagcaccaggtgcacaacgtggagatcgtggtgctggaggactag

SEQ ID NO: 83011 - DNA, 1692 bp, Artificial Sequence
  Description of Artificial Sequence: Synthetic coding sequence
atggccaacgccgaggtgagcgtgcccgtgggcgacgtggtggtggtgcccaccgagggcaacgagggcgagaaccccgaggacaccaagacccaggtgatcctgcagctgcagcccgtgcagcagggcatctacgaggccggcagcgagaacaacaccgccgtggtggccgtggagacccacaccatccacaagatcgaggagggcatcgacaccggcaccatcgaggccaacgaggacatggagatcgcctaccccatcacctgcggcgagagcaaggccatcctgctgtggaagaagttcgtgtgccccggcatcaacgtgaagtgcgtgaagttcaacgaccagctgatcagccccaagcacttcgtgcacctggccggcaagagcaccctgaaggactggaagagagccatcagactgggcggcatcatgctgagaaagatgatggacagcggccagatcgacttctaccagcacgacaaggtgtgcagcaacacctgcagaagcaccaagttcgacctgctgatcagcagcgccagagcccccgtgcccggccagcagaccagcgtggtgcagacccccaccagcgccgacggcagcatcacccagatcgccatcagcgaggagagcatggaggaggccggcctggagtggaacagcgccctgaccgccgccgtgaccatggccaccgaggagggcgtgaagaaggacagcgaggagatcagcgaggacaccctgatgttctggaagggcatcgccgacgtgggcctgatggaggaggtggtgtgcaacatccagaaggagatcgaggagctgctgagaggcgtgcagcagagactgatccaggcccccttccaggtgaccgacgccgccgtgctgaacaacgtggcccacaccttcggcctgatggacaccgtgaagaaggtgctggacaacagaagaaaccaggtggagcagggcgaggagcagttcctgtacaccctgaccgacctggagagacagctggaggagcagaagaagcagggccaggaccacagactgaagagccagaccgtgcagaacgtggtgctgatgcccgtgagcacccccaagccccccaagagacccagactgcagagacccgccagcaccaccgtgctgagccccagcccccccgtgcagcagccccagttcaccgtgatcagccccatcaccatcacccccgtgggccagagcttcagcatgggcaacatccccgtggccaccctgagccagggcagcagccccgtgaccgtgcacaccctgcccagcggcccccagctgttcagatacgccaccgtggtgagcagcgccaagagcagcagccccgacaccgtgaccatccaccccagcagcagcctggccctgctgagcagcaccgccatgcaggacggcagcaccctgggcaacatgaccaccatggtgagccccgtggagctggtggccatggagagcggcctgaccagcgccatccaggccgtggagagcaccagcgaggacggccagaccatcatcgagatcgaccccgcccccgaccccgaggccgaggacaccgagggcaaggccgtgatcctggagaccgagctgagaaccgaggagaaggtggtggccgagatggaggagcaccagcaccaggtgcacaacgtggagatcgtggtgctggaggactag

SEQ ID NO: 83012 - DNA, 1692 bp, Artificial Sequence; identical to SEQ ID NO: 83011
  Description of Artificial Sequence: Synthetic coding sequence

SEQ ID NO: 83013 - DNA, 1083 bp, Artificial Sequence
  Description of Artificial Sequence: Synthetic coding sequence
atgctgagaagactgcccgccctggccgccagaagaccccccgccagaagaagaagaatctacgaggccggcagcgagaacaacaccgccgtggtggccgtggagacccacaccatccacaagatcgaggagggcatcgacaccggcaccatcgaggccaacgaggacatggagatcgcctaccccatcacctgcggcgagagcaaggccatcctgctgtggaagaagttcgtgtgccccggcatcaacgtgaagtgcgtgaagttcaacgaccagctgatcagccccaagcacttcgtgcacctggccggcaagagcaccctgaaggactggaagagagccatcagactgggcggcatcatgctgagaaagatgatggacagcggccagatcgacttctaccagcacgacaaggtgtgcagcaacacctgcagaagcaccaagttcgacctgctgatcagcagcgccagagcccccgtgcccggccagcagaccagcgtggtgcagacccccaccagcgccgacggcagcatcacccagatcgccatcagcgaggagagcatggaggaggccggcctggagtggaacagcgccctgaccgccgccgtgaccatggccaccgaggagggcgtgaagaaggacagcgaggagatcagcgaggacaccctgatgttctggaagggcatcgccgacgtgggcctgatggaggaggtggtgtgcaacatccagaaggagatcgaggagctgctgagaggcgtgcagcagagactgatccaggcccccttccaggtgaccgacgccgccgtgctgaacaacgtggcccacaccttcggcctgatggacaccgtgaagaaggtgctggacaacagaagaaaccaggtggagcagggcgaggagcagttcctgtacaccctgaccgacctggagagacagctggaggagcagaagaagcagggccaggaccacagactgaagagccagaccgtgcagaacgtggtgctgatgcccgtgagcacccccaagccccccaagagacccagactgcagagacccgccagcaccaccgtgctgagccccagctag

SEQ ID NO: 83014 - DNA, 1593 bp, Artificial Sequence
  Description of Artificial Sequence: Synthetic coding sequence
atggccacccccgacgtgagcgtgcacatggaggaggtggtggtggtgaccacccccgacaccgccgtggacggcagcggcgtggagggcgtgaagaccgtgctggtgaccaccaacctggccccccacggcggcgacctgaccgaggacaacatggagaccgagaacgccgccgccgccgccgccgccgccttcaccgccagcagccagctgaaggaggccgtgctggtgaagatggccgaggagggcgagaacctggaggccgagatcgtgtaccccatcacctgcggcgacagcagagccaacctgatctggagaaagttcgtgtgccccggcatcaacgtgaagtgcgtgcagtacgacgagcacgtgatcagccccaaggagttcgtgcacctggccggcaagagcaccctgaaggactggaagagagccatcagaatgaacggcatcatgctgagaaagatcatggacagcggcgagctggacttctaccagcacgacaaggtgtgcagcaacacctgcagaagcaccaagatcgacctgagcggcgccagagtgagcctgagcagccccaccagcgccgagtacatccccctgacccccgccgccgccgacgtgaacggcagccccgccaccatcaccatcgagacctgcgaggaccccggcgactggaccgccgccatcggcgacgacaccttcaccttctggagaggcctgaaggacgccggcctgctggacgaggtgatccaggagttccaccaggagctggtggagaccatgagaggcctgcagcagagagtgcaggacccccccctgcagctgagagacgccgtgctgctgaacaacatcgtgcagaacttcggcatgctggacctggtgaagaaggtgctggccagccacaagtgccagatggacagaagcagagagcagtacgccagagacctggccgccctggagcagcagtgcgacgagcacagaagaagagccaaggagctgaagcacaagagccagcacctgagcaacgtgctgatgaccctgacccccgtgagcctgcccccccccgtgaagagacccagactggccagagccaccagcggccccgccgccatggccagccaggtgctgacccagagcgcccagctggccctgggccccggcgtgcccgtgccccagctgaccagcgtgcccctgggcaaggtggtgagcaccctgcccagcaccgtgctgggcaagggcagcctgcaggccccccccgccagcagccccgccagccccctgctgggcggctacaccgtgctggccagcagcggcagcacctaccccagcaccgtggagatccaccccgacgccagcagcctgaccgtgctgagcaccgccgccgtgcaggacggcagcaccgtgttcaaggtggtgagccccctgcagctgctgaccctgcccggcctgggccccaccctgcagaacgtggcccaggccagccccggcagcagcaccatcgtgaccgtgcccgccggcgccgcccccggccccgaggagcacaccgccaccatcgaggtggccgccatggccgaggaccacgagagaaagtag

SEQ ID NO: 83015 - DNA, 1440 bp, Artificial Sequence
  Description of Artificial Sequence: Synthetic coding sequence
atggagaccgagaacgccgccgccgccgccgccgccgccttcaccgccagcagccagctgaaggaggccgtgctggtgaagatggccgaggagggcgagaacctggaggccgagatcgtgtaccccatcacctgcggcgacagcagagccaacctgatctggagaaagttcgtgtgccccggcatcaacgtgaagtgcgtgcagtacgacgagcacgtgatcagccccaaggagttcgtgcacctggccggcaagagcaccctgaaggactggaagagagccatcagaatgaacggcatcatgctgagaaagatcatggacagcggcgagctggacttctaccagcacgacaaggtgtgcagcaacacctgcagaagcaccaagatcgacctgagcggcgccagagtgagcctgagcagccccaccagcgccgagtacatccccctgacccccgccgccgccgacgtgaacggcagccccgccaccatcaccatcgagacctgcgaggaccccggcgactggaccgccgccatcggcgacgacaccttcaccttctggagaggcctgaaggacgccggcctgctggacgaggtgatccaggagttccaccaggagctggtggagaccatgagaggcctgcagcagagagtgcaggacccccccctgcagctgagagacgccgtgctgctgaacaacatcgtgcagaacttcggcatgctggacctggtgaagaaggtgctggccagccacaagtgccagatggacagaagcagagagcagtacgccagagacctggccgccctggagcagcagtgcgacgagcacagaagaagagccaaggagctgaagcacaagagccagcacctgagcaacgtgctgatgaccctgacccccgtgagcctgcccccccccgtgaagagacccagactggccagagccaccagcggccccgccgccatggccagccaggtgctgacccagagcgcccagctggccctgggccccggcgtgcccgtgccccagctgaccagcgtgcccctgggcaaggtggtgagcaccctgcccagcaccgtgctgggcaagggcagcctgcaggccccccccgccagcagccccgccagccccctgctgggcggctacaccgtgctggccagcagcggcagcacctaccccagcaccgtggagatccaccccgacgccagcagcctgaccgtgctgagcaccgccgccgtgcaggacggcagcaccgtgttcaaggtggtgagccccctgcagctgctgaccctgcccggcctgggccccaccctgcagaacgtggcccaggccagccccggcagcagcaccatcgtgaccgtgcccgccggcgccgcccccggccccgaggagcacaccgccaccatcgaggtggccgccatggccgaggaccacgagagaaagtag

SEQ ID NO: 83016 - DNA, 1593 bp, Artificial Sequence; identical to SEQ ID NO: 83014
  Description of Artificial Sequence: Synthetic coding sequence

SEQ ID NO: 83017 - DNA, 1401 bp, Artificial Sequence
  Description of Artificial Sequence: Synthetic coding sequence
atggccatggacgtgaccagaagccaggcccagaccgccctgaccctggtggagcagatcctggccgagttccagctgcaggaggaggacctgaagaaggtgatgagaagaatgcagaaggagatggacagaggcctgagactggagacccacgaggaggccagcgtgaagatgctgcccacctacgtgagaagcacccccgagggcagcgaggtgggcgacttcctgagcctggacctgggcggcaccaacttcagagtgatgctggtgaaggtgggcgagggcgaggagggccagtggagcgtgaagaccaagcaccagatgtacagcatccccgaggacgccatgaccggcaccgccgagatgctgttcgactacatcagcgagtgcatcagcgacttcctggacaagcaccagatgaagcacaagaagctgcccctgggcttcaccttcagcttccccgtgagacacgaggacatcgacaagggcatcctgctgaactggaccaagggcttcaaggccagcggcgccgagggcaacaacgtggtgggcctgctgagagacgccatcaagagaagaggcgacttcgagatggacgtggtggccatggtgaacgacaccgtggccaccatgatcagctgctactacgaggaccaccagtgcgaggtgggcatgatcgtgggcaccggctgcaacgcctgctacatggaggagatgcagaacgtggagctggtggagggcgacgagggcagaatgtgcgtgaacaccgagtggggcgccttcggcgacagcggcgagctggacgagttcctgctggagtacgacagactggtggacgagagcagcgccaaccccggccagcagctgtacgagaagctgatcggcggcaagtacatgggcgagctggtgagactggtgctgctgagactggtggacgagaacctgctgttccacggcgaggccagcgagcagctgagaaccagaggcgccttcgagaccagattcgtgagccaggtggagagcgacaccggcgacagaaagcagatctacaacatcctgagcaccctgggcctgagacccagcaccaccgactgcgacatcgtgagaagagcctgcgagagcgtgagcaccagagccgcccacatgtgcagcgccggcctggccggcgtgatcaacagaatgagagagagcagaagcgaggacgtgatgagaatcaccgtgggcgtggacggcagcgtgtacaagctgcaccccagcttcaaggagagattccacgccagcgtgagaagactgacccccagctgcgagatcaccttcatcgagagcgaggagggcagcggcagaggcgccgccctggtgagcgccgtggcctgcaagaaggcctgcatgctgggccagtag

SEQ ID NO: 83018 - DNA, 1395 bp, Artificial Sequence
  Description of Artificial Sequence: Synthetic coding sequence
atgcccagacccagaagccagctgccccagcccaacagccaggtggagcagatcctggccgagttccagctgcaggaggaggacctgaagaaggtgatgagaagaatgcagaaggagatggacagaggcctgagactggagacccacgaggaggccagcgtgaagatgctgcccacctacgtgagaagcacccccgagggcagcgaggtgggcgacttcctgagcctggacctgggcggcaccaacttcagagtgatgctggtgaaggtgggcgagggcgaggagggccagtggagcgtgaagaccaagcaccagatgtacagcatccccgaggacgccatgaccggcaccgccgagatgctgttcgactacatcagcgagtgcatcagcgacttcctggacaagcaccagatgaagcacaagaagctgcccctgggcttcaccttcagcttccccgtgagacacgaggacatcgacaagggcatcctgctgaactggaccaagggcttcaaggccagcggcgccgagggcaacaacgtggtgggcctgctgagagacgccatcaagagaagaggcgacttcgagatggacgtggtggccatggtgaacgacaccgtggccaccatgatcagctgctactacgaggaccaccagtgcgaggtgggcatgatcgtgggcaccggctgcaacgcctgctacatggaggagatgcagaacgtggagctggtggagggcgacgagggcagaatgtgcgtgaacaccgagtggggcgccttcggcgacagcggcgagctggacgagttcctgctggagtacgacagactggtggacgagagcagcgccaaccccggccagcagctgtacgagaagctgatcggcggcaagtacatgggcgagctggtgagactggtgctgctgagactggtggacgagaacctgctgttccacggcgaggccagcgagcagctgagaaccagaggcgccttcgagaccagattcgtgagccaggtggagagcgacaccggcgacagaaagcagatctacaacatcctgagcaccctgggcctgagacccagcaccaccgactgcgacatcgtgagaagagcctgcgagagcgtgagcaccagagccgcccacatgtgcagcgccggcctggccggcgtgatcaacagaatgagagagagcagaagcgaggacgtgatgagaatcaccgtgggcgtggacggcagcgtgtacaagctgcaccccagcttcaaggagagattccacgccagcgtgagaagactgacccccagctgcgagatcaccttcatcgagagcgaggagggcagcggcagaggcgccgccctggtgagcgccgtggcctgcaagaaggcctgcatgctgggccagtag

SEQ ID NO: 83019 - DNA, 1398 bp, Artificial Sequence
  Description of Artificial Sequence: Synthetic coding sequence
atgctggacgacagagccagaatggaggccgccaagaaggagaaggtggagcagatcctggccgagttccagctgcaggaggaggacctgaagaaggtgatgagaagaatgcagaaggagatggacagaggcctgagactggagacccacgaggaggccagcgtgaagatgctgcccacctacgtgagaagcacccccgagggcagcgaggtgggcgacttcctgagcctggacctgggcggcaccaacttcagagtgatgctggtgaaggtgggcgagggcgaggagggccagtggagcgtgaagaccaagcaccagatgtacagcatccccgaggacgccatgaccggcaccgccgagatgctgttcgactacatcagcgagtgcatcagcgacttcctggacaagcaccagatgaagcacaagaagctgcccctgggcttcaccttcagcttccccgtgagacacgaggacatcgacaagggcatcctgctgaactggaccaagggcttcaaggccagcggcgccgagggcaacaacgtggtgggcctgctgagagacgccatcaagagaagaggcgacttcgagatggacgtggtggccatggtgaacgacaccgtggccaccatgatcagctgctactacgaggaccaccagtgcgaggtgggcatgatcgtgggcaccggctgcaacgcctgctacatggaggagatgcagaacgtggagctggtggagggcgacgagggcagaatgtgcgtgaacaccgagtggggcgccttcggcgacagcggcgagctggacgagttcctgctggagtacgacagactggtggacgagagcagcgccaaccccggccagcagctgtacgagaagctgatcggcggcaagtacatgggcgagctggtgagactggtgctgctgagactggtggacgagaacctgctgttccacggcgaggccagcgagcagctgagaaccagaggcgccttcgagaccagattcgtgagccaggtggagagcgacaccggcgacagaaagcagatctacaacatcctgagcaccctgggcctgagacccagcaccaccgactgcgacatcgtgagaagagcctgcgagagcgtgagcaccagagccgcccacatgtgcagcgccggcctggccggcgtgatcaacagaatgagagagagcagaagcgaggacgtgatgagaatcaccgtgggcgtggacggcagcgtgtacaagctgcaccccagcttcaaggagagattccacgccagcgtgagaagactgacccccagctgcgagatcaccttcatcgagagcgaggagggcagcggcagaggcgccgccctggtgagcgccgtggcctgcaagaaggcctgcatgctgggccagtag

SEQ ID NO: 83020 - DNA, 1878 bp, Artificial Sequence
  Description of Artificial Sequence: Synthetic coding sequence
atgcccggcaccaagagattccagcacgtgatcgagacccccgagcccggcaagtgggagctgagcggctacgaggccgccgtgcccatcaccgagaagagcaaccccctgacccaggacctggacaaggccgacgccgagaacatcgtgagactgctgggccagtgcgacgccgagatcttccaggaggagggccaggccctgagcacctaccagagactgtacagcgagagcatcctgaccaccatggtgcaggtggccggcaaggtgcaggaggtgctgaaggagcccgacggcggcctggtggtgctgagcggcggcggcaccagcggcagaatggccttcctgatgagcgtgagcttcaaccagctgatgaagggcctgggccagaagcccctgtacacctacctgatcgccggcggcgacagaagcgtggtggccagcagagagggcaccgaggacagcgccctgcacggcatcgaggagctgaagaaggtggccgccggcaagaagagagtgatcgtgatcggcatcagcgtgggcctgagcgcccccttcgtggccggccagatggactgctgcatgaacaacaccgccgtgttcctgcccgtgctggtgggcttcaaccccgtgagcatggccagaaacgaccccatcgaggactggagcagcaccttcagacaggtggccgagagaatgcagaagatgcaggagaagcagaaggccttcgtgctgaaccccgccatcggccccgagggcctgagcggcagcagcagaatgaagggcggcagcgccaccaagatcctgctggagaccctgctgctggccgcccacaagaccgtggaccagggcatcgccgccagccagagatgcctgctggagatcctgagaaccttcgagagagcccaccaggtgacctacagccagagccccaagatcgccaccctgatgaagagcgtgagcaccagcctggagaagaagggccacgtgtacctggtgggctggcagaccctgggcatcatcgccatcatggacggcgtggagtgcatccacaccttcggcgccgacttcagagacgtgagaggcttcctgatcggcgaccacagcgacatgttcaaccagaaggccgagctgaccaaccagggcccccagttcaccttcagccaggaggacttcctgaccagcatcctgcccagcctgaccgagatcgacaccgtggtgttcatcttcaccctggacgacaacctgaccgaggtgcagaccatcgtggagcaggtgaaggagaagaccaaccacatccaggccctggcccacagcaccgtgggccagaccctgctgatccccctgaagaagctgttccccagcatcatcagcatcacctggcccctgctgttcttcgagtacgagggcaacttcatccagaagttccagagagagctgagcaccaagtgggtgctgaacaccgtgagcaccggcgcccacgtgctgctgggcaagatcctgcagaaccacatgctggacctgagaatcagcaacagcaagctgttctggagagccctggccatgctgcagagattcagcggccagagcaaggccagatgcatcgagagcctgctgagagccatccacttcccccagcccctgagcgacgacatcagagccgcccccatcagctgccacgtgcaggtggcccacgagaaggagcaggtgatccccatcgccctgctgagcctgctgttcagatgcagcatcaccgaggcccaggcccacctggccgccgcccccagcgtgtgcgaggccgtgagaagcgccctggccggccccggccagaagagaaccgccgaccccctggagatcctggagcccgacgtgcagtag

SEQ ID NO: 83021 - DNA, 1308 bp, Artificial Sequence
  Description of Artificial Sequence: Synthetic coding sequence
atggactgctgcatgaacaacaccgccgtgttcctgcccgtgctggtgggcttcaaccccgtgagcatggccagaaacgaccccatcgaggactggagcagcaccttcagacaggtggccgagagaatgcagaagatgcaggagaagcagaaggccttcgtgctgaaccccgccatcggccccgagggcctgagcggcagcagcagaatgaagggcggcagcgccaccaagatcctgctggagaccctgctgctggccgcccacaagaccgtggaccagggcatcgccgccagccagagatgcctgctggagatcctgagaaccttcgagagagcccaccaggtgacctacagccagagccccaagatcgccaccctgatgaagagcgtgagcaccagcctggagaagaagggccacgtgtacctggtgggctggcagaccctgggcatcatcgccatcatggacggcgtggagtgcatccacaccttcggcgccgacttcagagacgtgagaggcttcctgatcggcgaccacagcgacatgttcaaccagaaggccgagctgaccaaccagggcccccagttcaccttcagccaggaggacttcctgaccagcatcctgcccagcctgaccgagatcgacaccgtggtgttcatcttcaccctggacgacaacctgaccgaggtgcagaccatcgtggagcaggtgaaggagaagaccaaccacatccaggccctggcccacagcaccgtgggccagaccctgctgatccccctgaagaagctgttccccagcatcatcagcatcacctggcccctgctgttcttcgagtacgagggcaacttcatccagaagttccagagagagctgagcaccaagtgggtgctgaacaccgtgagcaccggcgcccacgtgctgctgggcaagatcctgcagaaccacatgctggacctgagaatcagcaacagcaagctgttctggagagccctggccatgctgcagagattcagcggccagagcaaggccagatgcatcgagagcctgctgagagccatccacttcccccagcccctgagcgacgacatcagagccgcccccatcagctgccacgtgcaggtggcccacgagaaggagcaggtgatccccatcgccctgctgagcctgctgttcagatgcagcatcaccgaggcccaggcccacctggccgccgcccccagcgtgtgcgaggccgtgagaagcgccctggccggccccggccagaagagaaccgccgaccccctggagatcctggagcccgacgtgcagtag

SEQ ID NO: 83022 - DNA, 1659 bp, Artificial Sequence
  Description of Artificial Sequence: Synthetic coding sequence
atgagactgctgcccctggcccccggcagactgagaagaggcagccccagacacctgcccagctgcagccccgccctgctgctgctggtgctgggcggctgcctgggcgtgttcggcgtggccgccggcaccagaagacccaacgtggtgctgctgctgaccgacgaccaggacgaggtgctgggcggcatgacccccctgaagaagaccaaggccctgatcggcgagatgggcatgaccttcagcagcgcctacgtgcccagcgccctgtgctgccccagcagagccagcatcctgaccggcaagtacccccacaaccaccacgtggtgaacaacaccctggagggcaactgcagcagcaagagctggcagaagatccaggagcccaacaccttccccgccatcctgagaagcatgtgcggctaccagaccttcttcgccggcaagtacctgaacgagtacggcgcccccgacgccggcggcctggagcacgtgcccctgggctggagctactggtacgccctggagaagaacagcaagtactacaactacaccctgagcatcaacggcaaggccagaaagcacggcgagaactacagcgtggactacctgaccgacgtgctggccaacgtgagcctggacttcctggactacaagagcaacttcgagcccttcttcatgatgatcgccacccccgccccccacagcccctggaccgccgccccccagtaccagaaggccttccagaacgtgttcgcccccagaaacaagaacttcaacatccacggcaccaacaagcactggctgatcagacaggccaagacccccatgaccaacagcagcatccagttcctggacaacgccttcagaaagagatggcagaccctgctgagcgtggacgacctggtggagaagctggtgaagagactggagttcaccggcgagctgaacaacacctacatcttctacaccagcgacaacggctaccacaccggccagttcagcctgcccatcgacaagagacagctgtacgagttcgacatcaaggtgcccctgctggtgagaggccccggcatcaagcccaaccagaccagcaagatgctggtggccaacatcgacctgggccccaccatcctggacatcgccggctacgacctgaacaagacccagatggacggcatgagcctgctgcccatcctgagaggcgccagcaacctgacctggagaagcgacgtgctggtggagtaccagggcgagggcagaaacgtgaccgaccccacctgccccagcctgagccccggcgtgagccagtgcttccccgactgcgtgtgcgaggacgcctacaacaacacctacgcctgcgtgagaaccatgagcgccctgtggaacctgcagtactgcgagttcgacgaccaggaggtgttcgtggaggtgtacaacctgaccgccgaccccgaccagatcaccaacatcgccaagaccatcgaccccgagctgctgggcaagatgaactacagactgatgatgctgcagagctgcagcggccccacctgcagaacccccggcgtgttcgaccccggctacagattcgaccccagactgatgttcagcaacagaggcagcgtgagaaccagaagattcagcaagcacctgctgtag

SEQ ID NO: 83023 - DNA, 1410 bp, Artificial Sequence
  Description of Artificial Sequence: Synthetic coding sequence
atgtacgtgcccagcgccctgtgctgccccagcagagccagcatcctgaccggcaagtacccccacaaccaccacgtggtgaacaacaccctggagggcaactgcagcagcaagagctggcagaagatccaggagcccaacaccttccccgccatcctgagaagcatgtgcggctaccagaccttcttcgccggcaagtacctgaacgagtacggcgcccccgacgccggcggcctggagcacgtgcccctgggctggagctactggtacgccctggagaagaacagcaagtactacaactacaccctgagcatcaacggcaaggccagaaagcacggcgagaactacagcgtggactacctgaccgacgtgctggccaacgtgagcctggacttcctggactacaagagcaacttcgagcccttcttcatgatgatcgccacccccgccccccacagcccctggaccgccgccccccagtaccagaaggccttccagaacgtgttcgcccccagaaacaagaacttcaacatccacggcaccaacaagcactggctgatcagacaggccaagacccccatgaccaacagcagcatccagttcctggacaacgccttcagaaagagatggcagaccctgctgagcgtggacgacctggtggagaagctggtgaagagactggagttcaccggcgagctgaacaacacctacatcttctacaccagcgacaacggctaccacaccggccagttcagcctgcccatcgacaagagacagctgtacgagttcgacatcaaggtgcccctgctggtgagaggccccggcatcaagcccaaccagaccagcaagatgctggtggccaacatcgacctgggccccaccatcctggacatcgccggctacgacctgaacaagacccagatggacggcatgagcctgctgcccatcctgagaggcgccagcaacctgacctggagaagcgacgtgctggtggagtaccagggcgagggcagaaacgtgaccgaccccacctgccccagcctgagccccggcgtgagccagtgcttccccgactgcgtgtgcgaggacgcctacaacaacacctacgcctgcgtgagaaccatgagcgccctgtggaacctgcagtactgcgagttcgacgaccaggaggtgttcgtggaggtgtacaacctgaccgccgaccccgaccagatcaccaacatcgccaagaccatcgaccccgagctgctgggcaagatgaactacagactgatgatgctgcagagctgcagcggccccacctgcagaacccccggcgtgttcgaccccggctacagattcgaccccagactgatgttcagcaacagaggcagcgtgagaaccagaagattcagcaagcacctgctgtag

SEQ ID NO: 83024 - DNA, 1599 bp, Artificial Sequence
  Description of Artificial Sequence: Synthetic coding sequence
atgagactgctgcccctggcccccggcagactgagaagaggcagccccagacacctgcccagctgcagccccgccctgctgctgctggtgctgggcggctgcctgggcgtgttcggcgtggccgccggcaccagaagacccaacgtggtgctgctgctgaccgacgaccaggacgaggtgctgggcggcatgtacgtgcccagcgccctgtgctgccccagcagagccagcatcctgaccggcaagtacccccacaaccaccacgtggtgaacaacaccctggagggcaactgcagcagcaagagctggcagaagatccaggagcccaacaccttccccgccatcctgagaagcatgtgcggctaccagaccttcttcgccggcaagtacctgaacgagtacggcgcccccgacgccggcggcctggagcacgtgcccctgggctggagctactggtacgccctggagaagaacagcaagtactacaactacaccctgagcatcaacggcaaggccagaaagcacggcgagaactacagcgtggactacctgaccgacgtgctggccaacgtgagcctggacttcctggactacaagagcaacttcgagcccttcttcatgatgatcgccacccccgccccccacagcccctggaccgccgccccccagtaccagaaggccttccagaacgtgttcgcccccagaaacaagaacttcaacatccacggcaccaacaagcactggctgatcagacaggccaagacccccatgaccaacagcagcatccagttcctggacaacgccttcagaaagagatggcagaccctgctgagcgtggacgacctggtggagaagctggtgaagagactggagttcaccggcgagctgaacaacacctacatcttctacaccagcgacaacggctaccacaccggccagttcagcctgcccatcgacaagagacagctgtacgagttcgacatcaaggtgcccctgctggtgagaggccccggcatcaagcccaaccagaccagcaagatgctggtggccaacatcgacctgggccccaccatcctggacatcgccggctacgacctgaacaagacccagatggacggcatgagcctgctgcccatcctgagaggcgccagcaacctgacctggagaagcgacgtgctggtggagtaccagggcgagggcagaaacgtgaccgaccccacctgccccagcctgagccccggcgtgagccagtgcttccccgactgcgtgtgcgaggacgcctacaacaacacctacgcctgcgtgagaaccatgagcgccctgtggaacctgcagtactgcgagttcgacgaccaggaggtgttcgtggaggtgtacaacctgaccgccgaccccgaccagatcaccaacatcgccaagaccatcgaccccgagctgctgggcaagatgaactacagactgatgatgctgcagagctgcagcggccccacctgcagaacccccggcgtgttcgaccccggctacagattcgaccccagactgatgttcagcaacagaggcagcgtgagaaccagaagattcagcaagcacctgctgtag

SEQ ID NO: 83025 - DNA, 2154 bp, Artificial Sequence
  Description of Artificial Sequence: Synthetic coding sequence
atgcccatcggcgactgcagcgtggccgccaagcccagaaagcagctgctgtgcagcctgttccagaccaccctgggctacagagccagagccagcggctggaagcccatggtgatctgcagaggcagccacgccttcaaggacctgatcaacacctacagaatgatcgagcaggacgacttcgacatcaacaccagactgcacaccatcgtgagaggcgaggacgaggccgccatggtggagagcgtgggcctggccctggtgaagctgcccgacgtgctgaacagactgaagcccgacatcatgatcgtgcacggcgacagattcgacgccctggccctggccaccagcgccgccctgatgaacatcagaatcctgcacatcgagggcggcgaggtgagcggcaccatcgacgacagcatcagacacgccatcaccaagctggcccactaccacgtgtgctgcaccagaagcgccgagcagcacctgatcagcatgtgcgaggaccacgacagaatcctgctggccggctgccccagctacgacaagctgctgagcgccaagaacaaggactacatgagcatcatcagaatgtggctgggcgacgacgtgaagagcaaggactacatcgtggccctgcagcaccccgtgaccaccgacatcaagcacagcatcaagatgttcgagctgaccctggacgccctgatcagcttcaacaagagaaccctggtgctgttccccaacatcgacgccggcagcaaggagatggtgagagtgatgagaaagaagggcatcgagcaccaccccaacttcagagccgtgaagcacgtgcccttcgaccagttcatccagctggtggcccacgccggctgcatgatcggcaacagcagctgcggcgtgagagaggtgggcgccttcggcacccccgtgatcaacctgggcaccagacagatcggcagagagaccggcgagaacgtgctgcacgtgagagacgccgacacccaggacaagatcctgcaggccctgcacctgcagttcggcaagcagtacccctgcagcaagatctacggcgacggcaacgccgtgcccagaatcctgaagttcctgaagagcatcgacctgcaggagcccctgcagaagaagttctgcttcccccccgtgaaggagaacatcagccaggacatcgaccacatcctggagaccctgagcgccctggccgtggacctgggcggcaccaacctgagagtggccatcgtgagcatgaagggcgagatcgtgaagaagtacacccagttcaaccccaagacctacgaggagagaatcaacctgatcctgcagatgtgcgtggaggccgccgccgaggccgtgaagctgaactgcagaatcctgggcgtgggcatcagcaccggcggcagagtgaaccccagagagggcatcgtgctgcacagcaccaagctgatccaggagtggaacagcgtggacctgagaacccccctgagcgacaccctgcacctgcccgtgtgggtggacaacgacggcaactgcgccgccctggccgagagaaagttcggccagggcaagggcctggagaacttcgtgaccctgatcaccggcaccggcatcggcggcggcatcatccaccagcacgagctgatccacggcagcagcttctgcgccgccgagctgggccacctggtggtgagcctggacggccccgactgcagctgcggcagccacggctgcatcgaggcctacgccagcggcatggccctgcagagagaggccaagaagctgcacgacgaggacctgctgctggtggagggcatgagcgtgcccaaggacgaggccgtgggcgccctgcacctgatccaggccgccaagctgggcaacgccaaggcccagagcatcctgagaaccgccggcaccgccctgggcctgggcgtggtgaacatcctgcacaccatgaaccccagcctggtgatcctgagcggcgtgctggccagccactacatccacatcgtgaaggacgtgatcagacagcaggccctgagcagcgtgcaggacgtggacgtggtggtgagcgacctggtggaccccgccctgctgggcgccgccagcatggtgctggactacaccaccagaagaatctactag

SEQ ID NO: 83026 - DNA, 2169 bp, Artificial Sequence
  Description of Artificial Sequence: Synthetic coding sequence
atggagaagaacggcaacaacagaaagctgagagtgtgcgtggccacctgcaacagagccgactacagcaagctggcccccatcatgttcggcatcaagaccgagcccgagttcttcgagctggacgtggtggtgctgggcagccacctgatcgacgactacggcaacacctacagaatgatcgagcaggacgacttcgacatcaacaccagactgcacaccatcgtgagaggcgaggacgaggccgccatggtggagagcgtgggcctggccctggtgaagctgcccgacgtgctgaacagactgaagcccgacatcatgatcgtgcacggcgacagattcgacgccctggccctggccaccagcgccgccctgatgaacatcagaatcctgcacatcgagggcggcgaggtgagcggcaccatcgacgacagcatcagacacgccatcaccaagctggcccactaccacgtgtgctgcaccagaagcgccgagcagcacctgatcagcatgtgcgaggaccacgacagaatcctgctggccggctgccccagctacgacaagctgctgagcgccaagaacaaggactacatgagcatcatcagaatgtggctgggcgacgacgtgaagagcaaggactacatcgtggccctgcagcaccccgtgaccaccgacatcaagcacagcatcaagatgttcgagctgaccctggacgccctgatcagcttcaacaagagaaccctggtgctgttccccaacatcgacgccggcagcaaggagatggtgagagtgatgagaaagaagggcatcgagcaccaccccaacttcagagccgtgaagcacgtgcccttcgaccagttcatccagctggtggcccacgccggctgcatgatcggcaacagcagctgcggcgtgagagaggtgggcgccttcggcacccccgtgatcaacctgggcaccagacagatcggcagagagaccggcgagaacgtgctgcacgtgagagacgccgacacccaggacaagatcctgcaggccctgcacctgcagttcggcaagcagtacccctgcagcaagatctacggcgacggcaacgccgtgcccagaatcctgaagttcctgaagagcatcgacctgcaggagcccctgcagaagaagttctgcttcccccccgtgaaggagaacatcagccaggacatcgaccacatcctggagaccctgagcgccctggccgtggacctgggcggcaccaacctgagagtggccatcgtgagcatgaagggcgagatcgtgaagaagtacacccagttcaaccccaagacctacgaggagagaatcaacctgatcctgcagatgtgcgtggaggccgccgccgaggccgtgaagctgaactgcagaatcctgggcgtgggcatcagcaccggcggcagagtgaaccccagagagggcatcgtgctgcacagcaccaagctgatccaggagtggaacagcgtggacctgagaacccccctgagcgacaccctgcacctgcccgtgtgggtggacaacgacggcaactgcgccgccctggccgagagaaagttcggccagggcaagggcctggagaacttcgtgaccctgatcaccggcaccggcatcggcggcggcatcatccaccagcacgagctgatccacggcagcagcttctgcgccgccgagctgggccacctggtggtgagcctggacggccccgactgcagctgcggcagccacggctgcatcgaggcctacgccagcggcatggccctgcagagagaggccaagaagctgcacgacgaggacctgctgctggtggagggcatgagcgtgcccaaggacgaggccgtgggcgccctgcacctgatccaggccgccaagctgggcaacgccaaggcccagagcatcctgagaaccgccggcaccgccctgggcctgggcgtggtgaacatcctgcacaccatgaaccccagcctggtgatcctgagcggcgtgctggccagccactacatccacatcgtgaaggacgtgatcagacagcaggccctgagcagcgtgcaggacgtggacgtggtggtgagcgacctggtggaccccgccctgctgggcgccgccagcatggtgctggactacaccaccagaagaatctactag

SEQ ID NO: 83027 - DNA, 2262 bp, Artificial Sequence
  Description of Artificial Sequence: Synthetic coding sequence
atggagacctacggctacctgcagagagagagctgcttccagggcccccacgagctgtacttcaagaacctgagcaagagaaacaagcagatcatggagaagaacggcaacaacagaaagctgagagtgtgcgtggccacctgcaacagagccgactacagcaagctggcccccatcatgttcggcatcaagaccgagcccgagttcttcgagctggacgtggtggtgctgggcagccacctgatcgacgactacggcaacacctacagaatgatcgagcaggacgacttcgacatcaacaccagactgcacaccatcgtgagaggcgaggacgaggccgccatggtggagagcgtgggcctggccctggtgaagctgcccgacgtgctgaacagactgaagcccgacatcatgatcgtgcacggcgacagattcgacgccctggccctggccaccagcgccgccctgatgaacatcagaatcctgcacatcgagggcggcgaggtgagcggcaccatcgacgacagcatcagacacgccatcaccaagctggcccactaccacgtgtgctgcaccagaagcgccgagcagcacctgatcagcatgtgcgaggaccacgacagaatcctgctggccggctgccccagctacgacaagctgctgagcgccaagaacaaggactacatgagcatcatcagaatgtggctgggcgacgacgtgaagagcaaggactacatcgtggccctgcagcaccccgtgaccaccgacatcaagcacagcatcaagatgttcgagctgaccctggacgccctgatcagcttcaacaagagaaccctggtgctgttccccaacatcgacgccggcagcaaggagatggtgagagtgatgagaaagaagggcatcgagcaccaccccaacttcagagccgtgaagcacgtgcccttcgaccagttcatccagctggtggcccacgccggctgcatgatcggcaacagcagctgcggcgtgagagaggtgggcgccttcggcacccccgtgatcaacctgggcaccagacagatcggcagagagaccggcgagaacgtgctgcacgtgagagacgccgacacccaggacaagatcctgcaggccctgcacctgcagttcggcaagcagtacccctgcagcaagatctacggcgacggcaacgccgtgcccagaatcctgaagttcctgaagagcatcgacctgcaggagcccctgcagaagaagttctgcttcccccccgtgaaggagaacatcagccaggacatcgaccacatcctggagaccctgagcgccctggccgtggacctgggcggcaccaacctgagagtggccatcgtgagcatgaagggcgagatcgtgaagaagtacacccagttcaaccccaagacctacgaggagagaatcaacctgatcctgcagatgtgcgtggaggccgccgccgaggccgtgaagctgaactgcagaatcctgggcgtgggcatcagcaccggcggcagagtgaaccccagagagggcatcgtgctgcacagcaccaagctgatccaggagtggaacagcgtggacctgagaacccccctgagcgacaccctgcacctgcccgtgtgggtggacaacgacggcaactgcgccgccctggccgagagaaagttcggccagggcaagggcctggagaacttcgtgaccctgatcaccggcaccggcatcggcggcggcatcatccaccagcacgagctgatccacggcagcagcttctgcgccgccgagctgggccacctggtggtgagcctggacggccccgactgcagctgcggcagccacggctgcatcgaggcctacgccagcggcatggccctgcagagagaggccaagaagctgcacgacgaggacctgctgctggtggagggcatgagcgtgcccaaggacgaggccgtgggcgccctgcacctgatccaggccgccaagctgggcaacgccaaggcccagagcatcctgagaaccgccggcaccgccctgggcctgggcgtggtgaacatcctgcacaccatgaaccccagcctggtgatcctgagcggcgtgctggccagccactacatccacatcgtgaaggacgtgatcagacagcaggccctgagcagcgtgcaggacgtggacgtggtggtgagcgacctggtggaccccgccctgctgggcgccgccagcatggtgctggactacaccaccagaagaatctactag

SEQ ID NO: 83028 - DNA, 399 bp, Artificial Sequence
  Description of Artificial Sequence: Synthetic coding sequence
atgttcgagctgaccctggacgccctgatcagcttcaacaagagaaccctggtgctgttccccaacatcgacgccggcagcaaggagatggtgagagtgatgagaaagaagggcatcgagcaccaccccaacttcagagccgtgaagcacgtgcccttcgaccagttcatccagctggtggcccacgccggctgcatgatcggcaacagcagctgcggcgtgagagaggtgggcgccctgaccagactgtacacctacgtgagctgctacaagcacacccacacccacacccacacccaccccagcagcagcaaccccaagctgagaagccagaaggtgatccagagcgagaacagaggcaagagctaccaggagggcctgaagtacaccttcttctag

SEQ ID NO: 83029 - DNA, 2169 bp, Artificial Sequence; identical to SEQ ID NO: 83026
  Description of Artificial Sequence: Synthetic coding sequence

SEQ ID NO: 83030 - DNA, 1947 bp, Artificial Sequence
  Description of Artificial Sequence: Synthetic coding sequence
atggagaagaacggcaacaacagaaagctgagagtgtgcgtggccacctgcaacagagccgactacagcaagctggcccccatcatgttcggcatcaagaccgagcccgagttcttcgagctggacgtggtggtgctgggcagccacctgatcgacgactacggcaacacctacagaatgatcgagcaggacgacttcgacatcaacaccagactgcacaccatcgtgagaggcgaggacgaggccgccatggtggagagcgtgggcctggccctggtgaagctgcccgacgtgctgaacagactgaagcccgacatcatgatcgtgcacggcgacagattcgacgccctggccctggccaccagcgccgccctgatgaacatcagaatcctgcacatcgagggcggcgaggtgagcggcaccatcgacgacagcatcagacacgccatcaccaagctggcccactaccacgtgtgctgcaccagaagcgccgagcagcacctgatcagcatgtgcgaggaccacgacagaatcctgctggccggctgccccagctacgacaagctgctgagcgccaagaacaaggactacatgagcatcatcagaatgtggctgggcgacgacgtgaagagcaaggactacatcgtggccctgcagcaccccgtgaccaccgacatcaagcacagcatcaagatgttcgagctgaccctggacgccctgatcagcttcaacaagagaaccctggtgctgttccccaacatcgacgccggcagcaaggagatggtgagagtgatgagaaagaagggcatcgagcaccaccccaacttcagagccgtgaagcacgtgcccttcgaccagttcatccagctggtggcccacgccggctgcatgatcggcaacagcagctgcggcgtgagagaggtgggcgccttcggcacccccgtgatcaacctgggcaccagacagatcggcagagagaccggcgagaacgtgctgcacgtgagagacgccgacacccaggacaagatcctgcaggccctgcacctgcagttcggcaagcagtacccctgcagcaagatctacggcgacggcaacgccgtgcccagaatcctgaagttcctgaagagcatcgacctgcaggagcccctgcagaagaagttctgcttcccccccgtgaaggagaacatcagccaggacatcgaccacatcctggagaccctgagcgccctggccgtggacctgggcggcaccaacctgagagtggccatcgtgagcatgaagggcgagatcgtgaagaagtacacccagttcaaccccaagacctacgaggagagaatcaacctgatcctgcagatgtgcgtggaggccgccgccgaggccgtgaagctgaactgcagaatcctgggcgtgggcatcggcggcggcatcatccaccagcacgagctgatccacggcagcagcttctgcgccgccgagctgggccacctggtggtgagcctggacggccccgactgcagctgcggcagccacggctgcatcgaggcctacgccagcggcatggccctgcagagagaggccaagaagctgcacgacgaggacctgctgctggtggagggcatgagcgtgcccaaggacgaggccgtgggcgccctgcacctgatccaggccgccaagctgggcaacgccaaggcccagagcatcctgagaaccgccggcaccgccctgggcctgggcgtggtgaacatcctgcacaccatgaaccccagcctggtgatcctgagcggcgtgctggccagccactacatccacatcgtgaaggacgtgatcagacagcaggccctgagcagcgtgcaggacgtggacgtggtggtgagcgacctggtggaccccgccctgctgggcgccgccagcatggtgctggactacaccaccagaagaatctactag

SEQ ID NO: 83031 - DNA, 1839 bp, Artificial Sequence
  Description of Artificial Sequence: Synthetic coding sequence
atgatcgagcaggacgacttcgacatcaacaccagactgcacaccatcgtgagaggcgaggacgaggccgccatggtggagagcgtgggcctggccctggtgaagctgcccgacgtgctgaacagactgaagcccgacatcatgatcgtgcacggcgacagattcgacgccctggccctggccaccagcgccgccctgatgaacatcagaatcctgcacatcgagggcggcgaggtgagcggcaccatcgacgacagcatcagacacgccatcaccaagctggcccactaccacgtgtgctgcaccagaagcgccgagcagcacctgatcagcatgtgcgaggaccacgacagaatcctgctggccggctgccccagctacgacaagctgctgagcgccaagaacaaggactacatgagcatcatcagaatgtggctgggcagcaaggagatggtgagagtgatgagaaagaagggcatcgagcaccaccccaacttcagagccgtgaagcacgtgcccttcgaccagttcatccagctggtggcccacgccggctgcatgatcggcaacagcagctgcggcgtgagagaggtgggcgccttcggcacccccgtgatcaacctgggcaccagacagatcggcagagagaccggcgagaacgtgctgcacgtgagagacgccgacacccaggacaagatcctgcaggccctgcacctgcagttcggcaagcagtacccctgcagcaagatctacggcgacggcaacgccgtgcccagaatcctgaagttcctgaagagcatcgacctgcaggagcccctgcagaagaagttctgcttcccccccgtgaaggagaacatcagccaggacatcgaccacatcctggagaccctgagcgccctggccgtggacctgggcggcaccaacctgagagtggccatcgtgagcatgaagggcgagatcgtgaagaagtacacccagttcaaccccaagacctacgaggagagaatcaacctgatcctgcagatgtgcgtggaggccgccgccgaggccgtgaagctgaactgcagaatcctgggcgtgggcatcagcaccggcggcagagtgaaccccagagagggcatcgtgctgcacagcaccaagctgatccaggagtggaacagcgtggacctgagaacccccctgagcgacaccctgcacctgcccgtgtgggtggacaacgacggcaactgcgccgccctggccgagagaaagttcggccagggcaagggcctggagaacttcgtgaccctgatcaccggcaccggcatcggcggcggcatcatccaccagcacgagctgatccacggcagcagcttctgcgccgccgagctgggccacctggtggtgagcctggacggccccgactgcagctgcggcagccacggctgcatcgaggcctacgccagcggcatggccctgcagagagaggccaagaagctgcacgacgaggacctgctgctggtggagggcatgagcgtgcccaaggacgaggccgtgggcgccctgcacctgatccaggccgccaagctgggcaacgccaaggcccagagcatcctgagaaccgccggcaccgccctgggcctgggcgtggtgaacatcctgcacaccatgaaccccagcctggtgatcctgagcggcgtgctggccagccactacatccacatcgtgaaggacgtgatcagacagcaggccctgagcagcgtgcaggacgtggacgtggtggtgagcgacctggtggaccccgccctgctgggcgccgccagcatggtgctggactacaccaccagaagaatctactag

SEQ ID NO: 83032 - DNA, 870 bp, Artificial Sequence
  Description of Artificial Sequence: Synthetic coding sequence
atgaagctgatcatcctggagcactacagccaggccagcgagtgggccgccaagtacatcagaaacagaatcatccagttcaaccccggccccgagaagtacttcaccctgggcctgcccaccggcagcacccccctgggctgctacaagaagctgatcgagtactacaagaacggcgacctgagcttcaagtacgtgaagaccttcaacatggacgagtacgtgggcctgcccagagaccaccccgagagctaccacagcttcatgtggaacaacttcttcaagcacatcgacatccaccccgagaacacccacatcctggacggcaacgccgtggacctgcaggccgagtgcgacgccttcgaggagaagatcaaggccgccggcggcatcgagctgttcgtgggcggcatcggccccgacggccacatcgccttcaacgagcccggcagcagcctggtgagcagaaccagagtgaagaccctggccatggacaccatcctggccaacgccagattcttcgacggcgagctgaccaaggtgcccaccatggccctgaccgtgggcgtgggcaccgtgatggacgccagagaggtgatgatcctgatcaccggcgcccacaaggccttcgccctgtacaaggccatcgaggagggcgtgaaccacatgtggaccgtgagcgccttccagcagcaccccagaaccgtgttcgtgtgcgacgaggacgccaccctggagctgaaggtgaagaccgtgaagtacttcaagggcctgatgctggtgcacaacaagctggtggaccccctgtacagcatcaaggagaaggagaccgagaagagccagagcagcaagaagccctacagcgactag

SEQ ID NO: 83033 - DNA, 768 bp, Artificial Sequence
  Description of Artificial Sequence: Synthetic coding sequence
atgaagctgatcatcctggagcactacagccaggccagcgagtgggccgccaagtacatcagaaacagaatcatccagttcaaccccggccccgagaagtacttcaccctgggcctgcccaccggcctgcccagagaccaccccgagagctaccacagcttcatgtggaacaacttcttcaagcacatcgacatccaccccgagaacacccacatcctggacggcaacgccgtggacctgcaggccgagtgcgacgccttcgaggagaagatcaaggccgccggcggcatcgagctgttcgtgggcggcatcggccccgacggccacatcgccttcaacgagcccggcagcagcctggtgagcagaaccagagtgaagaccctggccatggacaccatcctggccaacgccagattcttcgacggcgagctgaccaaggtgcccaccatggccctgaccgtgggcgtgggcaccgtgatggacgccagagaggtgatgatcctgatcaccggcgcccacaaggccttcgccctgtacaaggccatcgaggagggcgtgaaccacatgtggaccgtgagcgccttccagcagcaccccagaaccgtgttcgtgtgcgacgaggacgccaccctggagctgaaggtgaagaccgtgaagtacttcaagggcctgatgctggtgcacaacaagctggtggaccccctgtacagcatcaaggagaaggagaccgagaagagccagagcagcaagaagccctacagcgactag

SEQ ID NO: 83034 - DNA, 870 bp, Artificial Sequence; identical to SEQ ID NO: 83032
  Description of Artificial Sequence: Synthetic coding sequence

SEQ ID NO: 83035 - DNA, 417 bp, Artificial Sequence
  Description of Artificial Sequence: Synthetic coding sequence
atgaagctgatcatcctggagcactacagccaggccagcgagtgggccgccaagtacatcagaaacagaatcatccagttcaaccccggccccgagaagtacttcaccctgggcctgcccaccggcagcacccccctgggctgctacaagaagctgatcgagtactacaagaacggcgacctgagcttcaagtacgtgaagaccttcaacatggacgagtacgtgggcctgcccagagaccaccccgagagctaccacagcttcatgtggaacaacttcttcaagcacatcgacatccaccccgagaacacccacatcctggacggcaacgccgtggacctgcaggccgagtgcgacgccttcgaggagaagatcaaggccgccggcggcatcgagctgttcgtgggcggcatctag

SEQ ID NO: 83036 - DNA, 870 bp, Artificial Sequence; identical to SEQ ID NO: 83032
  Description of Artificial Sequence: Synthetic coding sequence

SEQ ID NO: 83037 - DNA, 90 bp, Artificial Sequence
  Description of Artificial Sequence: Synthetic coding sequence
atgaagctgatcatcctggagcactacagccaggccagcgagtgggccgccaagtacatcagaaacagaatcatccagttcaacccctag

SEQ ID NO: 83038 - DNA, 870 bp, Artificial Sequence; identical to SEQ ID NO: 83032
  Description of Artificial Sequence: Synthetic coding sequence

SEQ ID NO: 83039 - DNA, 486 bp, Artificial Sequence
  Description of Artificial Sequence: Synthetic coding sequence
atgaagctgatcatcctggagcactacagccaggccagcgagtgggccgccaagtacatcagaaacagaatcatccagttcaaccccggccccgagaagtacttcaccctgggcctgcccaccggcagcacccccctgggctgctacaagaagctgatcgagtactacaagaacggcgacctgagcttcaagtacgtgaagaccttcaacatggacgagtacgtgggcctgcccagagaccaccccgagagctaccacagcttcatgtggaacaacttcttcaagcacatcgacatccaccccgagaacacccacatcctggacggcaacgccgtggacctgcaggccgagtgcgacgccttcgaggagaagatcaaggccgccggcggcatcgagctgttcgtgggcggcatcggccccgacggccacatcgccttcaacgagcccggcagcagcctggtgagcagaaccagagtgaagacctag

SEQ ID NO: 83040 - DNA, 639 bp, Artificial Sequence
  Description of Artificial Sequence: Synthetic coding sequence
atgaagctgatcatcctggagcactacagccaggccagcgagtgggccgccaagtacatcagaaacagaatcatccagttcaaccccggccccgagaagtacttcaccctgggcctgcccaccggcagcacccccctgggctgctacaagaagctgatcgagtactacaagaacggcgacctgagcttcaagtacgtgaagaccttcaacgagcccggcagcagcctggtgagcagaaccagagtgaagaccctggccatggacaccatcctggccaacgccagattcttcgacggcgagctgaccaaggtgcccaccatggccctgaccgtgggcgtgggcaccgtgatggacgccagagaggtgatgatcctgatcaccggcgcccacaaggccttcgccctgtacaaggccatcgaggagggcgtgaaccacatgtggaccgtgagcgccttccagcagcaccccagaaccgtgttcgtgtgcgacgaggacgccaccctggagctgaaggtgaagaccgtgaagtacttcaagggcctgatgctggtgcacaacaagctggtggaccccctgtacagcatcaaggagaaggagaccgagaagagccagagcagcaagaagccctacagcgactag

SEQ ID NO: 83041 - DNA, 831 bp, Artificial Sequence
  Description of Artificial Sequence: Synthetic coding sequence
atgagactggtgatcctggacaactacgacctggccagcgagtgggccgccaagtacatctgcaacagaatcatccagttcaagcccggccaggacagatacttcaccctgggcctgcccaccggcagcacccccctgggctgctacaagaagctgatcgagtaccacaagaacggccacctgagcttcaagtacgtgaagaccttcaacatggacgagtacgtgggcctgcccagaaaccaccccgagagctaccacagctacatgtggaacaacttcttcaagcacatcgacatcgaccccaacaacgcccacatcctggacggcaacgccgccgacctgcaggccgagtgcgacgccttcgagaacaagatcaaggaggccggcggcatcgacctgttcgtgggcggcatcggccccgacggccacatcgccttcaacgagcccggcagcagcctggtgagcagaaccagactgaagaccctggccatggacaccatcctggccaacgccaagtacttcgacggcgacctgagcaaggtgcccaccatggccctgaccgtgggcgtgggcaccgtgatggacgccagagaggtgatgatcctgatcaccggcgcccacaaggccttcgccctgtacaaggccatcgaggagggcgtgaaccacatgtggaccgtgagcgccttccagcagcaccccagaaccatcttcgtgtgcgacgaggacgccaccctggagctgagagtgaagaccgtgaagtacttcaagggcctgatgcacgtgcacaacaagctggtggaccccctgttcagcatgaaggacggcaactag

SEQ ID NO: 83042 - DNA, 780 bp, Artificial Sequence
  Description of Artificial Sequence: Synthetic coding sequence
atgagactggtgatcctggacaactacgacctggccagcgagtgggccgccaagtacatctgcaacagaatcatccagttcaagcccggccaggacagatacttcaccctgggcctgcccaccggcagcacccccctgggctgctacaagaagctgatcgagtaccacaagaacggccacctgagcttcaagtacgtgaagaccttcaacatggacgagtacgtgggcctgcccagaaaccaccccgagagctaccacagctacatgtggaacaacttcttcaagcacatcgacatcgaccccaacaacgcccacatcctggacggcaacgccgccgacctgcaggccgagtgcgacgccttcgagaacaagatcaaggaggccggcggcatcgacctgttcgtgggcggcatcggccccgacggccacatcgccttcaacgagcccggcagcagcctggtgagcagaaccagactgaagaccctggccatggacaccatcctggccaacgccaagtacttcgacggcgacctgagcaaggtgcccaccatggccctgaccgtgggcgtgggcaccgtgatggacgccagagaggtgatgatcctgatcaccggcgcccacaaggccttcgccctgtacaaggccatcgaggagggcgtgaaccacatgtggaccgtgagcgccttccagcagcaccccagaaccatcttcgtgtgcgacgaggacgccaccctggagctgagagtgaagaccgtgaagtacttcaagggcgagcactag

SEQ ID NO: 83043 - DNA, 729 bp, Artificial Sequence
  Description of Artificial Sequence: Synthetic coding sequence
atgagactggtgatcctggacaactacgacctggccagcgagtgggccgccaagtacatctgcaacagaatcatccagttcaagcccggccaggacagatacttcaccctgggcctgcccaccggcctgcccagaaaccaccccgagagctaccacagctacatgtggaacaacttcttcaagcacatcgacatcgaccccaacaacgcccacatcctggacggcaacgccgccgacctgcaggccgagtgcgacgccttcgagaacaagatcaaggaggccggcggcatcgacctgttcgtgggcggcatcggccccgacggccacatcgccttcaacgagcccggcagcagcctggtgagcagaaccagactgaagaccctggccatggacaccatcctggccaacgccaagtacttcgacggcgacctgagcaaggtgcccaccatggccctgaccgtgggcgtgggcaccgtgatggacgccagagaggtgatgatcctgatcaccggcgcccacaaggccttcgccctgtacaaggccatcgaggagggcgtgaaccacatgtggaccgtgagcgccttccagcagcaccccagaaccatcttcgtgtgcgacgaggacgccaccctggagctgagagtgaagaccgtgaagtacttcaagggcctgatgcacgtgcacaacaagctggtggaccccctgttcagcatgaaggacggcaactag

SEQ ID NO: 83044 - DNA, 1287 bp, Artificial Sequence
  Description of Artificial Sequence: Synthetic coding sequence
atgctgagaaccctgctgagaagaagactgttcagctaccccaccaagtactacttcatggtgctggtgctgagcctgatcaccttcagcgtgctgagaatccaccagaagcccgagttcgtgagcgtgagacacctggagctggccggcgagaaccccagcagcgacatcaactgcaccaaggtgctgcagggcgacgtgaacgagatccagaaggtgaagctggagatcctgaccgtgaagttcaagaagagacccagatggacccccgacgactacatcaacatgaccagcgactgcagcagcttcatcaagagaagaaagtacatcgtggagcccctgagcaaggaggaggccgagttccccatcgcctacagcatcgtggtgcaccacaagatcgagatgctggacagactgctgagagccatctacatgccccagaacttctactgcatccacgtggacaccaagagcgaggacagctacctggccgccgtgatgggcatcgccagctgcttcagcaacgtgttcgtggccagcagactggagagcgtggtgtacgccagctggagcagagtgcaggccgacctgaactgcatgaaggacctgtacgccatgagcgccaactggaagtacctgatcaacctgtgcggcatggacttccccatcaagaccaacctggagatcgtgagaaagctgaagctgctgatgggcgagaacaacctggagaccgagagaatgcccagccacaaggaggagagatggaagaagagatacgaggtggtgaacggcaagctgaccaacaccggcaccgtgaagatgctgccccccctggagacccccctgttcagcggcagcgcctacttcgtggtgagcagagagtacgtgggctacgtgctgcagaacgagaagatccagaagctgatggagtgggcccaggacacctacagccccgacgagtacctgtgggccaccatccagagaatccccgaggtgcccggcagcctgcccgccagccacaagtacgacctgagcgacatgcaggccgtggccagattcgtgaagtggcagtacttcgagggcgacgtgagcaagggcgccccctaccccccctgcgacggcgtgcacgtgagaagcgtgtgcatcttcggcgccggcgacctgaactggatgctgagaaagcaccacctgttcgccaacaagttcgacgtggacgtggacctgttcgccatccagtgcctggacgagcacctgagacacaaggccctggagaccctgaagcactag

SEQ ID NO: 83045 - DNA, 1287 bp, Artificial Sequence; identical to SEQ ID NO: 83044
  Description of Artificial Sequence: Synthetic coding sequence

SEQ ID NO: 83046 - DNA, 1287 bp, Artificial Sequence; identical to SEQ ID NO: 83044
  Description of Artificial Sequence: Synthetic coding sequence

SEQ ID NO: 83047 - DNA, 1287 bp, Artificial Sequence; identical to SEQ ID NO: 83044
  Description of Artificial Sequence: Synthetic coding sequence

SEQ ID NO: 83048 - DNA, 1209 bp, Artificial Sequence
  Description of Artificial Sequence: Synthetic coding sequence
atgaacttctggagatactgcttcttcgccttcaccctgctgagcgtggtgatcttcgtgagattctacagcagccagctgagcccccccaagagctacgagaagctgaacagcagcagcgagagatacttcagaaagaccgcctgcaaccacgccctggagaagatgcccgtgttcctgtgggagaacatcctgcccagccccctgagaagcgtgccctgcaaggactacctgacccagaaccactacatcaccagccccctgagcgaggaggaggccgccttccccctggcctacgtgatggtgatccacaaggacttcgacaccttcgagagactgttcagagccatctacatgccccagaacgtgtactgcgtgcacgtggacgagaaggcccccgccgagtacaaggagagcgtgagacagctgctgagctgcttccagaacgccttcatcgccagcaagaccgagagcgtggtgtacgccggcatcagcagactgcaggccgacctgaactgcctgaaggacctggtggccagcgaggtgccctggaagtacgtgatcaacacctgcggccaggacttccccctgaagaccaacagagagatcgtgcagcacctgaagggcttcaagggcaagaacatcacccccggcgtgctgccccccgaccacgccatcaagagaaccaagtacgtgcaccaggagcacaccgacaagggcggcttcttcgtgaagaacaccaacatcctgaagaccagccccccccaccagctgaccatctacttcggcaccgcctacgtggccctgaccagagacttcgtggacttcgtgctgagagaccagagagccatcgacctgctgcagtggagcaaggacacctacagccccgacgagcacttctgggtgaccctgaacagagtgagcggcgtgcccggcagcatgcccaacgccagctggaccggcaacctgagagccatcaagtggagcgacatggaggacagacacggcggctgccacggccactacgtgcacggcatctgcatctacggcaacggcgacctgaagtggctggtgaacagccccagcctgttcgccaacaagttcgagctgaacacctaccccctgaccgtggagtgcctggagctgagacacagagagagaaccctgaaccagagcgagaccgccatccagcccagctggtacttctag

SEQ ID NO: 83049 - DNA, 1203 bp, Artificial Sequence
  Description of Artificial Sequence: Synthetic coding sequence
atgcccctgagcatgagatacctgttcatcatcagcgtgagcagcgtgatcatcttcatcgtgttcagcgtgttcaacttcggcggcgaccccagcttccagagactgaacatcagcgaccccctgagactgacccaggtgtgcaccagcttcatcaacggcaagaccagattcctgtggaagaacaagctgatgatccacgagaagagcagctgcaaggagtacctgacccagagccactacatcaccgcccccctgagcaaggaggaggccgacttccccctggcctacatcatggtgatccaccaccacttcgacaccttcgccagactgttcagagccatctacatgccccagaacatctactgcgtgcacgtggacgagaaggccaccaccgagttcaaggacgccgtggagcagctgctgagctgcttccccaacgccttcctggccagcaagatggagcccgtggtgtacggcggcatcagcagactgcaggccgacctgaactgcatcagagacctgagcgccttcgaggtgagctggaagtacgtgatcaacacctgcggccaggacttccccctgaagaccaacaaggagatcgtgcagtacctgaagggcttcaagggcaagaacatcacccccggcgtgctgccccccgcccacgccatcggcagaaccaagtacgtgcaccaggagcacctgggcaaggagctgagctacgtgatcagaaccaccgccctgaagcccccccccccccacaacctgaccatctacttcggcagcgcctacgtggccctgagcagagagttcgccaacttcgtgctgcacgaccccagagccgtggacctgctgcagtggagcaaggacaccttcagccccgacgagcacttctgggtgaccctgaacagaatccccggcgtgcccggcagcatgcccaacgccagctggaccggcaacctgagagccatcaagtggagcgacatggaggacagacacggcggctgccacggccactacgtgcacggcatctgcatctacggcaacggcgacctgaagtggctggtgaacagccccagcctgttcgccaacaagttcgagctgaacacctaccccctgaccgtggagtgcctggagctgagacacagagagagaaccctgaaccagagcgagaccgccatccagcccagctggtacttctag

SEQ ID NO: 83050 - DNA, 1209 bp, Artificial Sequence
  Description of Artificial Sequence: Synthetic coding sequence
atgatgggcagctggaagcactgcctgttcagcgccagcctgatcagcgccctgatcttcgtgttcgtgtacaacaccgagctgtgggagaacaagagattcctgagagccgccctgagcaacgccagcctgctggccgaggcctgccaccagatcttcgagggcaaggtgttctaccccaccgagaacgccctgaagaccaccctggacgaggccacctgctacgagtacatggtgagaagccactacgtgaccgagaccctgagcgaggaggaggccggcttccccctggcctacaccgtgaccatccacaaggacttcggcaccttcgagagactgttcagagccatctacatgccccagaacgtgtactgcgtgcacctggaccagaaggccaccgacgccttcaagggcgccgtgaagcagctgctgagctgcttccccaacgccttcctggccagcaagaaggagagcgtggtgtacggcggcatcagcagactgcaggccgacctgaactgcctggaggacctggtggccagcgaggtgccctggaagtacgtgatcaacacctgcggccaggacttccccctgaagaccaacagagagatcgtgcagtacctgaagggcttcaagggcaagaacatcacccccggcgtgctgccccccgaccacgccgtgggcagaaccaagtacgtgcaccaggagctgctgaaccacaagaacagctacgtgatcaagaccaccaagctgaagaccccccccccccacgacatggtgatctacttcggcaccgcctacgtggccctgaccagagacttcgccaacttcgtgctgcaggaccagctggccctggacctgctgagctggagcaaggacacctacagccccgacgagcacttctgggtgaccctgaacagaatccccggcgtgcccggcagcatgcccaacgccagctggaccggcaacctgagagccatcaagtggagcgacatggaggacagacacggcggctgccacggccactacgtgcacggcatctgcatctacggcaacggcgacctgaagtggctggtgaacagccccagcctgttcgccaacaagttcgagctgaacacctaccccctgaccgtggagtgcctggagctgagacacagagagagaaccctgaaccagagcgagaccgccatccagcccagctggtacttctag

SEQ ID NO: 83051 - DNA, 1209 bp, Artificial Sequence; identical to SEQ ID NO: 83050
  Description of Artificial Sequence: Synthetic coding sequence

SEQ ID NO: 83052 - DNA, 1317 bp, Artificial Sequence
  Description of Artificial Sequence: Synthetic coding sequence
atggtgcagtggaagagactgtgccagctgcactacctgtgggccctgggctgctacatgctgctggccaccgtggccctgaagctgagcttcagactgaagtgcgacagcgaccacctgggcctggagagcagagagagccagagccagtactgcagaaacatcctgtacaacttcctgaagctgcccgccaagagaagcatcaactgcagcggcgtgaccagaggcgaccaggaggccgtgctgcaggccatcctgaacaacctggaggtgaagaagaagagagagcccttcaccgacacccactacctgagcctgaccagagactgcgagcacttcaaggccgagagaaagttcatccagttccccctgagcaaggaggaggtggagttccccatcgcctacagcatggtgatccacgagaagatcgagaacttcgagagactgctgagagccgtgtacgccccccagaacatctactgcgtgcacgtggacgagaagagccccgagaccttcaaggaggccgtgaaggccatcatcagctgcttccccaacgtgttcatcgccagcaagctggtgagagtggtgtacgccagctggagcagagtgcaggccgacctgaactgcatggaggacctgctgcagagcagcgtgccctggaagtacttcctgaacacctgcggcaccgacttccccatcaagagcaacgccgagatggtgcaggccctgaagatgctgaacggcagaaacagcatggagagcgaggtgccccccaagcacaaggagaccagatggaagtaccacttcgaggtggtgagagacaccctgcacctgaccaacaagaagaaggacccccccccctacaacctgaccatgttcaccggcaacgcctacatcgtggccagcagagacttcgtgcagcacgtgctgaagaaccccaagagccagcagctgatcgagtgggtgaaggacacctacagccccgacgagcacctgtgggccaccctgcagagagccagatggatgcccggcagcgtgcccaaccaccccaagtacgacatcagcgacatgaccagcatcgccagactggtgaagtggcagggccacgagggcgacatcgacaagggcgccccctacgccccctgcagcggcatccaccagagagccatctgcgtgtacggcgccggcgacctgaactggatgctgcagaaccaccacctgctggccaacaagttcgaccccaaggtggacgacaacgccctgcagtgcctggaggagtacctgagatacaaggccatctacggcaccgagctgtag

SEQ ID NO: 83053 - DNA, 264 bp, Artificial Sequence
  Description of Artificial Sequence: Synthetic coding sequence
atggtgcagtggaagagactgtgccagctgcactacctgtgggccctgggctgctacatgctgctggccaccgtggccctgaagctgagcttcagactgaagtgcgacagcgaccacctgggcctggagagcagagagagccagagccagtactgcagaaacatcctgtacaacttcctgaagctgcccgccaagagaagcatcaactgcagcggcgtgaccagaggcgaccaggaggccgtgctgcaggccatcctgaactag

SEQ ID NO: 83054 - DNA, 462 bp, Artificial Sequence
  Description of Artificial Sequence: Synthetic coding sequence
atggtgcagtggaagagactgtgccagctgcactacctgtgggccctgggctgctacatgctgctggccaccgtggccctgaagctgagcttcagactgaagtgcgacagcgaccacctgggcctggagagcagagagagccagagccagtactgcagaaacatcctgtacaacttcctgaagctgcccgccaagagaagcatcaactgcagcggcgtgaccagaggcgaccaggaggccgtgctgcaggccatcctgaacaacctggaggtgaagaagaagagagagcccttcaccgacacccactacctgagcctgaccagagactgcgagcacttcaaggccgagagaaagttcatccagttccccctgagcaaggaggaggtggagttccccatcgcctacagcatggtgatccacgagaagatcgagaacttcgagagactgctgagagccgtgtag

SEQ ID NO: 83055 - DNA, 162 bp, Artificial Sequence
  Description of Artificial Sequence: Synthetic coding sequence
atggtgcagtggaagagactgtgccagctgcactacctgtgggccctgggctgctacatgctgctggccaccgtggccctgaagctgagcttcagactgaagtgcgacagcgaccacctgggcctggagagcagagagagccagagccagtactgcagatag

SEQ ID NO: 83056 - DNA, 1317 bp, Artificial Sequence; identical to SEQ ID NO: 83052
  Description of Artificial Sequence: Synthetic coding sequence

SEQ ID NO: 83057 - DNA, 1041 bp, Artificial Sequence
  Description of Artificial Sequence: Synthetic coding sequence
atggagagcaccctgggcgccggcatcgtgatcgccgaggccctgcagaaccagctggcctggctggagaacgtgtggctgtggatcaccttcctgggcgaccccaagatcctgttcctgttctacttccccgccgcctactacgccagcagaagagtgggcatcgccgtgctgtggatcagcctgatcaccgagtggctgaacctgatcttcaagtggttcctgttcggcgacagacccttctggtgggtgcacgagagcggctactacagccaggcccccgcccaggtgcaccagttccccagcagctgcgagaccggccccggcagccccagcggccactgcatgatcaccggcgccgccctgtggcccatcatgaccgccctgagcagccaggtggccaccagagccagaagcagatgggtgagagtgatgcccagcctggcctactgcaccttcctgctggccgtgggcctgagcagaatcttcatcctggcccacttcccccaccaggtgctggccggcctgatcaccggcgccgtgctgggctggctgatgacccccagagtgcccatggagagagagctgagcttctacggcctgaccgccctggccctgatgctgggcaccagcctgatctactggaccctgttcaccctgggcctggacctgagctggagcatcagcctggccttcaagtggtgcgagagacccgagtggatccacgtggacagcagacccttcgccagcctgagcagagacagcggcgccgccctgggcctgggcatcgccctgcacagcccctgctacgcccaggtgagaagagcccagctgggcaacggccagaagatcgcctgcctggtgctggccatgggcctgctgggccccctggactggctgggccaccccccccagatcagcctgttctacatcttcaacttcctgaagtacaccctgtggccctgcctggtgctggccctggtgccctgggccgtgcacatgttcagcgcccaggaggccccccccatccacagcagctag

SEQ ID NO: 83058 - DNA, 465 bp, Artificial Sequence
  Description of Artificial Sequence: Synthetic coding sequence
atggacttcctgcacagaaacggcgtgctgatcatccagcacctgcagaaggactacagagcctactacaccttcctgaacttcatgagcaacgtgggcgaccccagaaacatcttcttcatctacttccccctgtgcttccagttcaaccagaccgtgggcaccaagatgatctgggtggccgtgatcggcgactggctgaacctgatcttcaagtggatcctgttcggccacagaccctactggtgggtgcaggagacccagatctaccccaaccacagcagcccctgcctggagcagttccccaccacctgcgagaccggccccggcagccccagcggccacgccatgggcgccagctgcgtgtggtacgtgatggtgaccgccgccctgagccacaccgtgtgcggcatggacaagttcagcatcaccctgcacagacacgccggcggcagaggcctgtag

SEQ ID NO: 83059 - DNA, 1068 bp, Artificial Sequence
  Description of Artificial Sequence: Synthetic coding sequence
atggacttcctgcacagaaacggcgtgctgatcatccagcacctgcagaaggactacagagcctactacaccttcctgaacttcatgagcaacgtgggcgaccccagaaacatcttcttcatctacttccccctgtgcttccagttcaaccagaccgtgggcaccaagatgatctgggtggccgtgatcggcgactggctgaacctgatcttcaagtggatcctgttcggccacagaccctactggtgggtgcaggagacccagatctaccccaaccacagcagcccctgcctggagcagttccccaccacctgcgagaccggccccggcagccccagcggccacgccatgggcgccagctgcgtgtggtacgtgatggtgaccgccgccctgagccacaccgtgtgcggcatggacaagttcagcatcaccctgcacagactgacctggagcttcctgtggagcgtgttctggctgatccagatcagcgtgtgcatcagcagagtgttcatcgccacccacttcccccaccaggtgatcctgggcgtgatcggcggcatgctggtggccgaggccttcgagcacacccccggcatccagaccgccagcctgggcacctacctgaagaccaacctgttcctgttcctgttcgccgtgggcttctacctgctgctgagagtgctgaacatcgacctgctgtggagcgtgcccatcgccaagaagtggtgcgccaaccccgactggatccacatcgacaccacccccttcgccggcctggtgagaaacctgggcgtgctgttcggcctgggcttcgccatcaacagcgagatgttcctgctgagctgcagaggcggcaacaactacaccctgagcttcagactgctgtgcgccctgaccagcctgaccatcctgcagctgtaccacttcctgcagatccccacccacgaggagcacctgttctacgtgctgagcttctgcaagagcgccagcatccccctgaccgtggtggccttcatcccctacagcgtgcacatgctgatgaagcagagcggcaagaagagccagtag

SEQ ID NO: 83060 - DNA, 1677 bp, Artificial Sequence
  Description of Artificial Sequence: Synthetic coding sequence
atggccgccctgaccagagacccccagttccagaagctgcagcagtggtacagagagcacagaagcgagctgaacctgagaagactgttcgacgccaacaaggacagattcaaccacttcagcctgaccctgaacaccaaccacggccacatcctggtggactacagcaagaacctggtgaccgaggacgtgatgagaatgctggtggacctggccaagagcagaggcgtggaggccgccagagagagaatgttcaacggcgagaagatcaactacaccgagggcagagccgtgctgcacgtggccctgagaaacagaagcaacacccccatcctggtggacggcaaggacgtgatgcccgaggtgaacaaggtgctggacaagatgaagagcttctgccagagagtgagaagcggcgactggaagggctacaccggcaagaccatcaccgacgtgatcaacatcggcatcggcggcagcgacctgggccccctgatggtgaccgaggccctgaagccctacagcagcggcggccccagagtgtggtacgtgagcaacatcgacggcacccacatcgccaagaccctggcccagctgaaccccgagagcagcctgttcatcatcgccagcaagaccttcaccacccaggagaccatcaccaacgccgagaccgccaaggagtggttcctgcaggccgccaaggaccccagcgccgtggccaagcacttcgtggccctgagcaccaacaccaccaaggtgaaggagttcggcatcgacccccagaacatgttcgagttctgggactgggtgggcggcagatacagcctgtggagcgccatcggcctgagcatcgccctgcacgtgggcttcgacaacttcgagcagctgctgagcggcgcccactggatggaccagcacttcagaaccacccccctggagaagaacgcccccgtgctgctggccctgctgggcatctggtacatcaactgcttcggctgcgagacccacgccatgctgccctacgaccagtacctgcacagattcgccgcctacttccagcagggcgacatggagagcaacggcaagtacatcaccaagagcggcaccagagtggaccaccagaccggccccatcgtgtggggcgagcccggcaccaacggccagcacgccttctaccagctgatccaccagggcaccaagatgatcccctgcgacttcctgatccccgtgcagacccagcaccccatcagaaagggcctgcaccacaagatcctgctggccaacttcctggcccagaccgaggccctgatgagaggcaagagcaccgaggaggccagaaaggagctgcaggccgccggcaagagccccgaggacctggagagactgctgccccacaaggtgttcgagggcaacagacccaccaacagcatcgtgttcaccaagctgacccccttcatgctgggcgccctggtggccatgtacgagcacaagatcttcgtgcagggcatcatctgggacatcaacagcttcgaccagtggggcgtggagctgggcaagcagctggccaagaagatcgagcccgagctggacggcagcgcccaggtgaccagccacgacgccagcaccaacggcctgatcaacttcatcaagcagcagagagaggccagagtgcagtag

SEQ ID NO: 83061 - DNA, 1563 bp, Artificial Sequence
  Description of Artificial Sequence: Synthetic coding sequence
agcagacacggcagaagccaccccggcccccccgtgcccgaggccgccgccatggtgcccagagcccccctgagagccgagcccgccccccccctgagatgccagcagggccccctgcagcccctgcaggtgagagccggcagaagaagaggcctgcccagagccgcccccggcaccggccacgccggcctgggcagcggcggcggcggcagcggcgccagaggcccccagagccccaccagcagacccagaaccggcgcccaggccgagagcgccctgagaccctggagcctgctgggcgtgagaagctggggcctggccgccagccccggcgtgagcgcccccggcctgctgagatacgaggagaagagagcccccccctggggccacttccccagcagcagcccctgcagcagcggccacctgagcagaggcagcttcagaagctgcgaggagagaccctggctgacccagcaggccggcaagggctgccccttccccagcgcccccggccacatgagcctgggcgccagcgccggcagagccgccagagccggcgtgttcgagggcgccggctggaaggacggcgacgtgggcagagacagctgcagaagacacctgtgcaccaccggcaagtgggagggcgtgttcgagcagatcatgggcggcagcgccgccaagggcgccctgatcaccgacaccggcggcggcggcggcggcgagagactgtggctgagagccagaagacccgacggccacccctgccacctggacggctgcctgagcaacctgagacagaaggtggaggccctgggcagaggcggcccccccctgcagagcggcctgctgatccagggcctgcccgccagcaccgtgtgcgaggacggcttcttcctgtgggccgccgtggccgaccaccccggcggccccgccggcgacagacaccaccactgcgccggctggcccagacccctgtggggcgtgggccagggcggctgcttcttctgggagcagctgctgctgagagcctggctgcccgccagagagaccagagtgtggagcgccgccagccccagcttctgcagcctgaccctgaacaccaaccacggccacatcctggtggactacagcaagaacctggtgaccgaggacgtgatgagaatgctggtggacctggccaagagcagaggcgtggaggccgccagagagagaatgttcaacggcgagaagatcaactacaccgaggtgagcagaccccacatccccagcggcgccagcttcctgcccttcggcgtgtacctgaccgtgagcagaatcaccctgtgcctgcaccccttcagctgggccatgctgctgctgaacgagggccccgagggcctgttcccccccgcctgcagcagagccctgggctgcgccttccacaagatcggcctggtgagcagcctggagtggttccccgtgagcgcctgggaggagcacatcagctacccccagggcgagttcctgaaggccgacatcttcctggagaagctgaccctgatctacccccagtgcaagttctag

SEQ ID NO: 83062 - DNA, 1710 bp, Artificial Sequence
  Description of Artificial Sequence: Synthetic coding sequence
atggtggccctgtgcagcctgcagcacctgggcagcagcgaccccagagccctgcccaccctgcccaccgccaccagcggccagagacccgccaagagaagaagaaagagccccgccatggccgccctgaccagagacccccagttccagaagctgcagcagtggtacagagagcacagaagcgagctgaacctgagaagactgttcgacgccaacaaggacagattcaaccacttcagcctgaccctgaacaccaaccacggccacatcctggtggactacagcaagaacctggtgaccgaggacgtgatgagaatgctggtggacctggccaagagcagaggcgtggaggccgccagagagagaatgttcaacggcgagaagatcaactacaccgagggcagagccgtgctgcacgtggccctgagaaacagaagcaacacccccatcctggtggacggcaaggacgtgatgcccgaggtgaacaaggtgctggacaagatgaagagcttctgccagggccccctgatggtgaccgaggccctgaagccctacagcagcggcggccccagagtgtggtacgtgagcaacatcgacggcacccacatcgccaagaccctggcccagctgaaccccgagagcagcctgttcatcatcgccagcaagaccttcaccacccaggagaccatcaccaacgccgagaccgccaaggagtggttcctgcaggccgccaaggaccccagcgccgtggccaagcacttcgtggccctgagcaccaacaccaccaaggtgaaggagttcggcatcgacccccagaacatgttcgagttctgggactgggtgggcggcagatacagcctgtggagcgccatcggcctgagcatcgccctgcacgtgggcttcgacaacttcgagcagctgctgagcggcgcccactggatggaccagcacttcagaaccacccccctggagaagaacgcccccgtgctgctggccctgctgggcatctggtacatcaactgcttcggctgcgagacccacgccatgctgccctacgaccagtacctgcacagattcgccgcctacttccagcagggcgacatggagagcaacggcaagtacatcaccaagagcggcaccagagtggaccaccagaccggccccatcgtgtggggcgagcccggcaccaacggccagcacgccttctaccagctgatccaccagggcaccaagatgatcccctgcgacttcctgatccccgtgcagacccagcaccccatcagaaagggcctgcaccacaagatcctgctggccaacttcctggcccagaccgaggccctgatgagaggcaagagcaccgaggaggccagaaaggagctgcaggccgccggcaagagccccgaggacctggagagactgctgccccacaaggtgttcgagggcaacagacccaccaacagcatcgtgttcaccaagctgacccccttcatgctgggcgccctggtggccatgtacgagcacaagatcttcgtgcagggcatcatctgggacatcaacagcttcgaccagtggggcgtggagctgggcaagcagctggccaagaagatcgagcccgagctggacggcagcgcccaggtgaccagccacgacgccagcaccaacggcctgatcaacttcatcaagcagcagagagaggccagagtgcagtag

SEQ ID NO: 83063 - DNA, 2901 bp, Artificial Sequence
  Description of Artificial Sequence: Synthetic coding sequence
atggccgccgtggccgccgtggccgccagaagaagaagaagctgggccagcctggtgctggccttcctgggcgtgtgcctgggcatcaccctggccgtggacagaagcaacttcaagacctgcgaggagagcagcttctgcaagagacagagaagcatcagacccggcctgagcccctacagagccctgctggacagcctgcagctgggccccgacagcctgaccgtgcacctgatccacgaggtgaccaaggtgctgctggtgctggagctgcagggcctgcagaagaacatgaccagattcagaatcgacgagctggagcccagaagacccagatacagagtgcccgacgtgctggtggccgacccccccatcgccagactgagcgtgagcggcagagacgagaacagcgtggagctgaccatggccgagggcccctacaagatcatcctgaccgccagacccttcagactggacctgctggaggacagaagcctgctgctgagcgtgaacgccagaggcctgctggagttcgagcaccagagagcccccagagtgagcttcagcgacaaggtgaacctgaccctgggcagcatctgggacaagatcaagaacctgttcagcagacagggcagcaaggaccccgccgagggcgacggcgcccagcccgaggagacccccagagacggcgacaagcccgaggagacccagggcaaggccgagaaggacgagcccggcgcctgggaggagaccttcaagacccacagcgacagcaagccctacggccccatgagcgtgggcctggacttcagcctgcccggcatggagcacgtgtacggcatccccgagcacgccgacaacctgagactgaaggtgaccgagggcggcgagccctacagactgtacaacctggacgtgttccagtacgagctgtacaaccccatggccctgtacggcagcgtgcccgtgctgctggcccacaacccccacagagacctgggcatcttctggctgaacgccgccgagacctgggtggacatcagcagcaacaccgccggcaagaccctgttcggcaagatgatggactacctgcagggcagcggcgagaccccccagaccgacgtgagatggatgagcgagaccggcatcatcgacgtgttcctgctgctgggccccagcatcagcgacgtgttcagacagtacgccagcctgaccggcacccaggccctgccccccctgttcagcctgggctaccaccagagcagatggaactacagagacgaggccgacgtgctggaggtggaccagggcttcgacgaccacaacctgccctgcgacgtgatctggctggacatcgagcacgccgacggcaagagatacttcacctgggaccccagcagattcccccagcccagaaccatgctggagagactggccagcaagagaagaaagctggtggccatcgtggacccccacatcaaggtggacagcggctacagagtgcacgaggagctgagaaacctgggcctgtacgtgaagaccagagacggcagcgactacgagggctggtgctggcccggcagcgccggctaccccgacttcaccaaccccaccatgagagcctggtgggccaacatgttcagctacgacaactacgagggcagcgcccccaacctgttcgtgtggaacgacatgaacgagcccagcgtgttcaacggccccgaggtgaccatgctgaaggacgcccagcactacggcggctgggagcacagagacgtgcacaacatctacggcctgtacgtgcacatggccaccgccgacggcctgagacagagaagcggcggcatggagagacccttcgtgctggccagagccttcttcgccggcagccagagattcggcgccgtgtggaccggcgacaacaccgccgagtgggaccacctgaagatcagcatccccatgtgcctgagcctgggcctggtgggcctgagcttctgcggcgccgacgtgggcggcttcttcaagaaccccgagcccgagctgctggtgagatggtaccagatgggcgcctaccagcccttcttcagagcccacgcccacctggacaccggcagaagagagccctggctgctgcccagccagcacaacgacatcatcagagacgccctgggccagagatacagcctgctgcccttctggtacaccctgctgtaccaggcccacagagagggcatccccgtgatgagacccctgtgggtgcagtacccccaggacgtgaccaccttcaacatcgacgaccagtacctgctgggcgacgccctgctggtgcaccccgtgagcgacagcggcgcccacggcgtgcaggtgtacctgcccggccagggcgaggtgtggtacgacatccagagctaccagaagcaccacggcccccagaccctgtacctgcccgtgaccctgagcagcatccccgtgttccagagaggcggcaccatcgtgcccagatggatgagagtgagaagaagcagcgagtgcatgaaggacgaccccatcaccctgttcgtggccctgagcccccagggcaccgcccagggcgagctgttcctggacgacggccacaccttcaactaccagaccagacaggagttcctgctgagaagattcagcttcagcggcaacaccctggtgagcagcagcgccgaccccgagggccacttcgagacccccatctggatcgagagagtggtgatcatcggcgccggcaagcccgccgccgtggtgctgcagaccaagggcagccccgagagcagactgagcttccagcacgaccccgagaccagcgtgctggtgctgagaaagcccggcatcaacgtggccagcgactggagcatccacctgagatag

SEQ ID NO: 83064 - DNA, 2835 bp, Artificial Sequence
  Description of Artificial Sequence: Synthetic coding sequence
atggccgccgtggccgccgtggccgccagaagaagaagaagctgggccagcctggtgctggccttcctgggcgtgtgcctgggcatcaccctggccgtggacagaagcaacttcaagacctgcgaggagagcagcttctgcaagagacagagaagcatcagacccggcctgagcccctacagagccctgctggacagcctgcagctgggccccgacagcctgaccgtgcacctgatccacgaggtgaccaaggtgctgctggtgctggagctgcagggcctgcagaagaacatgaccagattcagaatcgacgagctggagcccagaagacccagatacagagtgcccgacgtgctggtggccgacccccccatcgccagactgagcgtgagcggcagagacgagaacagcgtggagctgaccatggccgagggcccctacaagatcatcctgaccgccagacccttcagactggacctgctggaggacagaagcctgctgctgagcgtgaacgccagaggcctgctggagttcgagcaccagagagcccccagagtgagccagggcagcaaggaccccgccgagggcgacggcgcccagcccgaggagacccccagagacggcgacaagcccgaggagacccagggcaaggccgagaaggacgagcccggcgcctgggaggagaccttcaagacccacagcgacagcaagccctacggccccatgagcgtgggcctggacttcagcctgcccggcatggagcacgtgtacggcatccccgagcacgccgacaacctgagactgaaggtgaccgagggcggcgagccctacagactgtacaacctggacgtgttccagtacgagctgtacaaccccatggccctgtacggcagcgtgcccgtgctgctggcccacaacccccacagagacctgggcatcttctggctgaacgccgccgagacctgggtggacatcagcagcaacaccgccggcaagaccctgttcggcaagatgatggactacctgcagggcagcggcgagaccccccagaccgacgtgagatggatgagcgagaccggcatcatcgacgtgttcctgctgctgggccccagcatcagcgacgtgttcagacagtacgccagcctgaccggcacccaggccctgccccccctgttcagcctgggctaccaccagagcagatggaactacagagacgaggccgacgtgctggaggtggaccagggcttcgacgaccacaacctgccctgcgacgtgatctggctggacatcgagcacgccgacggcaagagatacttcacctgggaccccagcagattcccccagcccagaaccatgctggagagactggccagcaagagaagaaagctggtggccatcgtggacccccacatcaaggtggacagcggctacagagtgcacgaggagctgagaaacctgggcctgtacgtgaagaccagagacggcagcgactacgagggctggtgctggcccggcagcgccggctaccccgacttcaccaaccccaccatgagagcctggtgggccaacatgttcagctacgacaactacgagggcagcgcccccaacctgttcgtgtggaacgacatgaacgagcccagcgtgttcaacggccccgaggtgaccatgctgaaggacgcccagcactacggcggctgggagcacagagacgtgcacaacatctacggcctgtacgtgcacatggccaccgccgacggcctgagacagagaagcggcggcatggagagacccttcgtgctggccagagccttcttcgccggcagccagagattcggcgccgtgtggaccggcgacaacaccgccgagtgggaccacctgaagatcagcatccccatgtgcctgagcctgggcctggtgggcctgagcttctgcggcgccgacgtgggcggcttcttcaagaaccccgagcccgagctgctggtgagatggtaccagatgggcgcctaccagcccttcttcagagcccacgcccacctggacaccggcagaagagagccctggctgctgcccagccagcacaacgacatcatcagagacgccctgggccagagatacagcctgctgcccttctggtacaccctgctgtaccaggcccacagagagggcatccccgtgatgagacccctgtgggtgcagtacccccaggacgtgaccaccttcaacatcgacgaccagtacctgctgggcgacgccctgctggtgcaccccgtgagcgacagcggcgcccacggcgtgcaggtgtacctgcccggccagggcgaggtgtggtacgacatccagagctaccagaagcaccacggcccccagaccctgtacctgcccgtgaccctgagcagcatccccgtgttccagagaggcggcaccatcgtgcccagatggatgagagtgagaagaagcagcgagtgcatgaaggacgaccccatcaccctgttcgtggccctgagcccccagggcaccgcccagggcgagctgttcctggacgacggccacaccttcaactaccagaccagacaggagttcctgctgagaagattcagcttcagcggcaacaccctggtgagcagcagcgccgaccccgagggccacttcgagacccccatctggatcgagagagtggtgatcatcggcgccggcaagcccgccgccgtggtgctgcagaccaagggcagccccgagagcagactgagcttccagcacgaccccgagaccagcgtgctggtgctgagaaagcccggcatcaacgtggccagcgactggagcatccacctgagatag

SEQ ID NO: 83065 - DNA, 2544 bp, Artificial Sequence
  Description of Artificial Sequence: Synthetic coding sequence
atgaccagattcagaatcgacgagctggagcccagaagacccagatacagagtgcccgacgtgctggtggccgacccccccatcgccagactgagcgtgagcggcagagacgagaacagcgtggagctgaccatggccgagggcccctacaagatcatcctgaccgccagacccttcagactggacctgctggaggacagaagcctgctgctgagcgtgaacgccagaggcctgctggagttcgagcaccagagagcccccagagtgagccagggcagcaaggaccccgccgagggcgacggcgcccagcccgaggagacccccagagacggcgacaagcccgaggagacccagggcaaggccgagaaggacgagcccggcgcctgggaggagaccttcaagacccacagcgacagcaagccctacggccccatgagcgtgggcctggacttcagcctgcccggcatggagcacgtgtacggcatccccgagcacgccgacaacctgagactgaaggtgaccgagggcggcgagccctacagactgtacaacctggacgtgttccagtacgagctgtacaaccccatggccctgtacggcagcgtgcccgtgctgctggcccacaacccccacagagacctgggcatcttctggctgaacgccgccgagacctgggtggacatcagcagcaacaccgccggcaagaccctgttcggcaagatgatggactacctgcagggcagcggcgagaccccccagaccgacgtgagatggatgagcgagaccggcatcatcgacgtgttcctgctgctgggccccagcatcagcgacgtgttcagacagtacgccagcctgaccggcacccaggccctgccccccctgttcagcctgggctaccaccagagcagatggaactacagagacgaggccgacgtgctggaggtggaccagggcttcgacgaccacaacctgccctgcgacgtgatctggctggacatcgagcacgccgacggcaagagatacttcacctgggaccccagcagattcccccagcccagaaccatgctggagagactggccagcaagagaagaaagctggtggccatcgtggacccccacatcaaggtggacagcggctacagagtgcacgaggagctgagaaacctgggcctgtacgtgaagaccagagacggcagcgactacgagggctggtgctggcccggcagcgccggctaccccgacttcaccaaccccaccatgagagcctggtgggccaacatgttcagctacgacaactacgagggcagcgcccccaacctgttcgtgtggaacgacatgaacgagcccagcgtgttcaacggccccgaggtgaccatgctgaaggacgcccagcactacggcggctgggagcacagagacgtgcacaacatctacggcctgtacgtgcacatggccaccgccgacggcctgagacagagaagcggcggcatggagagacccttcgtgctggccagagccttcttcgccggcagccagagattcggcgccgtgtggaccggcgacaacaccgccgagtgggaccacctgaagatcagcatccccatgtgcctgagcctgggcctggtgggcctgagcttctgcggcgccgacgtgggcggcttcttcaagaaccccgagcccgagctgctggtgagatggtaccagatgggcgcctaccagcccttcttcagagcccacgcccacctggacaccggcagaagagagccctggctgctgcccagccagcacaacgacatcatcagagacgccctgggccagagatacagcctgctgcccttctggtacaccctgctgtaccaggcccacagagagggcatccccgtgatgagacccctgtgggtgcagtacccccaggacgtgaccaccttcaacatcgacgaccagtacctgctgggcgacgccctgctggtgcaccccgtgagcgacagcggcgcccacggcgtgcaggtgtacctgcccggccagggcgaggtgtggtacgacatccagagctaccagaagcaccacggcccccagaccctgtacctgcccgtgaccctgagcagcatccccgtgttccagagaggcggcaccatcgtgcccagatggatgagagtgagaagaagcagcgagtgcatgaaggacgaccccatcaccctgttcgtggccctgagcccccagggcaccgcccagggcgagctgttcctggacgacggccacaccttcaactaccagaccagacaggagttcctgctgagaagattcagcttcagcggcaacaccctggtgagcagcagcgccgaccccgagggccacttcgagacccccatctggatcgagagagtggtgatcatcggcgccggcaagcccgccgccgtggtgctgcagaccaagggcagccccgagagcagactgagcttccagcacgaccccgagaccagcgtgctggtgctgagaaagcccggcatcaacgtggccagcgactggagcatccacctgagatag

SEQ ID NO: 83066 - DNA, 2745 bp, Artificial Sequence
  Description of Artificial Sequence: Synthetic coding sequence
atggaggccgccgtgaaggaggagatcagcctggaggacgaggccgtggacaagaacatcttcagagactgcaacaagatcgccttctacagaagacagaagcagtggctgagcaagaagagcacctaccaggccctgctggacagcgtgaccaccgacgaggacagcaccagattccagatcatcaacgaggccagcaaggtgcccctgctggccgagatctacggcatcgagggcaacatcttcagactgaagatcaacgaggagacccccctgaagcccagattcgaggtgcccgacgtgctgaccagcaagcccagcaccgtgagactgatcagctgcagcggcgacaccggcagcctgatcctggccgacggcaagggcgacctgaagtgccacatcaccgccaaccccttcaaggtggacctggtgagcgaggaggaggtggtgatcagcatcaacagcctgggccagctgtacttcgagcacctgcagatcctgcacaagcagagagccgccaaggagaacgaggaggagaccagcgtggacaccagccaggagaaccaggaggacctgggcctgtgggaggagaagttcggcaagttcgtggacatcaaggccaacggccccagcagcatcggcctggacttcagcctgcacggcttcgagcacctgtacggcatcccccagcacgccgagagccaccagctgaagaacaccggcgacggcgacgcctacagactgtacaacctggacgtgtacggctaccagatctacgacaagatgggcatctacggcagcgtgccctacctgctggcccacaagctgggcagaaccatcggcatcttctggctgaacgccagcgagaccctggtggagatcaacaccgagcccgccgtggagtacaccctgacccagatgggccccgtggccgccaagcagaaggtgagaagcagaacccacgtgcactggatgagcgagagcggcatcatcgacgtgttcctgctgaccggccccacccccagcgacgtgttcaagcagtacagccacctgaccggcacccaggccatgccccccctgttcagcctgggctaccaccagtgcagatggaactacgaggacgagcaggacgtgaaggccgtggacgccggcttcgacgagcacgacatcccctacgacgccatgtggctggacatcgagcacaccgagggcaagagatacttcacctgggacaagaacagattccccaaccccaagagaatgcaggagctgctgagaagcaagaagagaaagctggtggtgatcagcgacccccacatcaagatcgaccccgactacagcgtgtacgtgaaggccaaggaccagggcttcttcgtgaagaaccaggagggcgaggacttcgagggcgtgtgctggcccggcctgagcagctacctggacttcaccaaccccaaggtgagagagtggtacagcagcctgttcgccttccccgtgtaccagggcagcaccgacatcctgttcctgtggaacgacatgaacgagcccagcgtgttcagaggccccgagcagaccatgcagaagaacgccatccaccacggcaactgggagcacagagagctgcacaacatctacggcttctaccaccagatggccaccgccgagggcctgatcaagagaagcaagggcaaggagagacccttcgtgctgaccagaagcttcttcgccggcagccagaagtacggcgccgtgtggaccggcgacaacaccgccgagtggagcaacctgaagatcagcatccccatgctgctgaccctgagcatcaccggcatcagcttctgcggcgccgacatcggcggcttcatcggcaaccccgagaccgagctgctggtgagatggtaccaggccggcgcctaccagcccttcttcagaggccacgccaccatgaacaccaagagaagagagccctggctgttcggcgaggagcacaccagactgatcagagaggccatcagagagagatacggcctgctgccctactggtacagcctgttctaccacgcccacgtggccagccagcccgtgatgagacccctgtgggtggagttccccgacgagctgaagaccttcgacatggaggacgagtacatgctgggcagcgccctgctggtgcaccccgtgaccgagcccaaggccaccaccgtggacgtgttcctgcccggcagcaacgaggtgtggtacgactacaagaccttcgcccactgggagggcggctgcaccgtgaagatccccgtggccctggacaccatccccgtgttccagagaggcggcagcgtgatccccatcaagaccaccgtgggcaagagcaccggctggatgaccgagagcagctacggcctgagagtggccctgagcaccaagggcagcagcgtgggcgagctgtacctggacgacggccacagcttccagtacctgcaccagaagcagttcctgcacagaaagttcagcttctgcagcagcgtgctgatcaacagcttcgccgaccagagaggccactaccccagcaagtgcgtggtggagaagatcctggtgctgggcttcagaaaggagcccagcagcgtgaccacccacagcagcgacggcaaggaccagcccgtggccttcacctactgcgccaagaccagcatcctgagcctggagaagctgagcctgaacatcgccaccgactgggaggtgagaatcatctag

SEQ ID NO: 83067 - DNA, 849 bp, Artificial Sequence
  Description of Artificial Sequence: Synthetic coding sequence
atggaggccgccgtgaaggaggagatcagcctggaggacgaggccgtggacaagaacatcttcagagactgcaacaagatcgccttctacagaagacagaagcagtggctgagcaagaagagcacctaccaggccctgctggacagcgtgaccaccgacgaggacagcaccagattccagatcatcaacgaggccagcaaggtgagatgccaggaccagagccccaccaccctggacgccttcaagggcaaggagaccaccgtgcaggaggagacccaggacctgagcaccagacagcacctggcccagaaggaggccgaggagcccgacaagcagggccagatcacctgggacatcagcaacgtggcccccaagaccgagaacttcgaggacctgctggagcagaccccctgcagcgcctgcctgcagggcttcaccagagacaacaccagcagcagcttcagcgaggacgccggcatcagcctgagcaccagcgtgaagctgcccctggccagcagcagcaagcccaacgagaacgaggccctgcccaaccagccccccagccagcagatcagacacaactacagactgctggccagcaccgtgagcgccgagatggccagaaacagacagctgatctgggagctggccagacagagcgaggcccacctggacagacccgtggtgctgggcgagcaggccagcgcccagagagaggtggccagcatcctgtgcagaaagagcgtgctggccatcaaccagctggccgccaccgtggagggcaccatcagcgtgctgcagcagttcaacgagctgctggaccaccccctggaccccggcagaagctag

SEQ ID NO: 83068 - DNA, 1230 bp, Artificial Sequence
  Description of Artificial Sequence: Synthetic coding sequence
atgagaagatacctgagagtggtggtgctgtgcgtggcctgcggcttctgcagcctgctgtacgccttcagccagctggccgtgagcctggaggagggcaccggcggcggcggcggcaagccccaggccgccgtggccagctggctggccggcggcggcagaggcgccgtgagaggcgccggcgtggccggccccgccgcccaccccggcgtgagcgacagatacagcctgaagatccagcccgtggagaagatgcacctggccgtggtggcctgcggcgagagactggaggagaccatgaccatgctgaagagcgccatcatcttcagcatcaagcccctgcagttccacatcttcgccgaggaccagctgcaccacagcttcaagggcagactggacaactggagcttcctgcagaccttcaactacaccctgtaccccatcaccttccccagcgagaacgccgccgagtggaagaagctgttcaagccctgcgccagccagagactgttcctgcccctgatcctgaaggaggtggacagcctgctgtacgtggacaccgacatcctgttcctgagacccgtggacgacatctggagcctgctgaagaagttcaacagcacccagatcgccgccatggcccccgagcacgaggagcccagaatcggctggtacaacagattcgccagacacccctactacggcaagaccggcgtgaacagcggcgtgatgctgatgaacatgaccagaatgagaagaaagtacttcaagaacgacatgaccaccgtgagactgcagtggggcgacatcctgatgcccctgctgaagaagtacaagctgaacatcacctggggcgaccaggacctgctgaacatcgtgttcttccacaaccccgagagcctgttcgtgttcccctgccagtggaactacagacccgaccactgcatctacggcagcaactgccaggaggccgaggagggcggcatcttcatcctgcacggcaacagaggcgtgtaccacgacgacaagcagcccgccttcagagccgtgtacgaggccctgagaaactgcagcttcgaggacgacaacatcagaagcctgctgaagcccctggagctggagctgcagaagaccgtgcacacctactgcggcaagatctacaagatcttcatcaagcagctggccaagagcgtgagagacagatacgccagaagccccaaggagaagtag

SEQ ID NO: 83069 - DNA, 1323 bp, Artificial Sequence
  Description of Artificial Sequence: Synthetic coding sequence
atgagaagatacctgagagtggtggtgctgtgcgtggcctgcggcttctgcagcctgctgtacgccttcagccagctggccgtgagcctggaggagggcaccggcggcggcggcggcaagccccaggccgccgtggccagctggctggccggcggcggcagaggcgccgtgagaggcgccggcgtggccggccccgccgcccaccccggcgtgagcgacagatgcaaggacttcagcctgtgctactggaacccctactggatgctgcccagcgacgtgtgcggcatgaactgcttctgggaggccgccttcagatacagcctgaagatccagcccgtggagaagatgcacctggccgtggtggcctgcggcgagagactggaggagaccatgaccatgctgaagagcgccatcatcttcagcatcaagcccctgcagttccacatcttcgccgaggaccagctgcaccacagcttcaagggcagactggacaactggagcttcctgcagaccttcaactacaccctgtaccccatcaccttccccagcgagaacgccgccgagtggaagaagctgttcaagccctgcgccagccagagactgttcctgcccctgatcctgaaggaggtggacagcctgctgtacgtggacaccgacatcctgttcctgagacccgtggacgacatctggagcctgctgaagaagttcaacagcacccagatcgccgccatggcccccgagcacgaggagcccagaatcggctggtacaacagattcgccagacacccctactacggcaagaccggcgtgaacagcggcgtgatgctgatgaacatgaccagaatgagaagaaagtacttcaagaacgacatgaccaccgtgagactgcagtggggcgacatcctgatgcccctgctgaagaagtacaagctgaacatcacctggggcgaccaggacctgctgaacatcgtgttcttccacaaccccgagagcctgttcgtgttcccctgccagtggaactacagacccgaccactgcatctacggcagcaactgccaggaggccgaggagggcggcatcttcatcctgcacggcaacagaggcgtgtaccacgacgacaagcagcccgccttcagagccgtgtacgaggccctgagaaactgcagcttcgaggacgacaacatcagaagcctgctgaagcccctggagctggagctgcagaagaccgtgcacacctactgcggcaagatctacaagatcttcatcaagcagctggccaagagcgtgagagacagatacgccagaagccccaaggagaagtag

SEQ ID NO: 83070 - DNA, 1332 bp, Artificial Sequence
  Description of Artificial Sequence: Synthetic coding sequence
atgaagctgagaagcaaggccgccgccctgctgctgctggccctggccgccctgctgctggccctgctgagcctgagagccggcagagccgagccccccgccctgcccgccagacccgccagcgccccccagagacaccccgcccccgtgcccgccagatggcccggccccggcgccctgcccggcgccagccccggcgtgagaagaagaagaccccccagacccagacccagagccggcagaagaggcgccgccagactggagaagctggccagaagacccggcgagcccagaagcttccaggccgtgctgccccccgagctgtggatccacctggccgtggtggcctgcggcaacagactggaggagaccctggtgatgctgaagagcgccgtgctgttcagccacagaaagatccagttccacatcttcaccgaggacagcctgaagcccgagttcgacaagcagctgagacagtggcccgacagctacaccaagaagttcgagcacagaatctaccccatcaccttcagcgtgggcaacccccaggagtggaagaagctgttcaagccctgcgccgcccagagactgttcctgcccgtgatcctgaaggacgtggacagcctgctgtacgtggacaccgacgtgctgttcctgagacccgtggacgacatctggaagctgctgagactgttcaacagcacccagctggccgccatggcccccgagcacgagatccccaagatcggctggtacagcagattcgccagacaccccttctacggcagcgccggcgtgaacagcggcgtgatgctgatgaacctgaccagaatcagaagcacccagttcaagaacagcatgatccccaccggcctggcctgggaggacatgctgtaccccctgtaccagaagtacaagaacgccatcacctggggcgaccaggacctgctgaacatcatcttctacttcaaccccgagtgcctgtacgtgttcccctgccagtggaactacagacccgaccactgcatgtacggcagcaactgcagagaggccgagcacgagggcgtgagcgtgctgcacggcaacagaggcgtgtaccacgacgacaagcagcccaccttcagagccctgtacgaggccatcagagacttccccttccaggacaacctgttccagagcatgtactaccccctgcagctgaagttcctggagaccgtgcacaccctgtgcggcagaatcccccaggtgttcctgaagcagatcgagaagaccatgaagagagcctacgagaagcacgtgatcatccacgtgggccccaaccagatgcactag

SEQ ID NO: 83071 - DNA, 1854 bp, Artificial Sequence
  Description of Artificial Sequence: Synthetic coding sequence
atgagatgcctggccgccagagtgaactacaagaccctgatcatcatctgcgccctgttcaccctggtgaccgtgctgctgtggaacaagtgcagcagcgacaaggccatccagttccccagaagaagcagcagcggcttcagagtggacggcttcgagaagagagccgccgccagcgagagcaacaactacatgaaccacgtggccaagcagcagagcgaggaggccttcccccaggagcagcagaaggccccccccgtggtgggcggcttcaacagcaacgtgggcagcaaggtgctgggcctgaagtacgaggagatcgactgcctgatcaacgacgagcacaccatcaagggcagaagagagggcaacgaggtgttcctgcccttcacctgggtggagaagtacttcgacgtgtacggcaaggtggtgcagtacgacggctacgacagattcgagttcagccacagctacagcaaggtgtacgcccagagagccccctaccaccccgacggcgtgttcatgagcttcgagggctacaacgtggaggtgagagacagagtgaagtgcatcagcggcgtggagggcgtgcccctgagcacccagtggggcccccagggctacttctaccccatccagatcgcccagtacggcctgagccactacagcaagaacctgaccgagaagcccccccacatcgaggtgtacgagaccgccgaggacagagacaagaacaagcccaacgactggaccgtgcccaagggctgcttcatggccaacgtggccgacaagagcagattcaccaacgtgaagcagttcatcgcccccgagaccagcgagggcgtgagcctgcagctgggcaacaccaaggacttcatcatcagcttcgacctgaagttcctgaccaacggcagcgtgagcgtggtgctggagaccaccgagaagaaccagctgttcaccatccactacgtgagcaacgcccagctgatcgccttcaaggagagagacatctactacggcatcggccccagaaccagctggagcaccgtgaccagagacctggtgaccgacctgagaaagggcgtgggcctgagcaacaccaaggccgtgaagcccaccaagatcatgcccaagaaggtggtgagactgatcgccaagggcaagggcttcctggacaacatcaccatcagcaccaccgcccacatggccgccttcttcgccgccagcgactggctggtgagaaaccaggacgagaagggcggctggcccatcatggtgaccagaaagctgggcgagggcttcaagagcctggagcccggctggtacagcgccatggcccagggccaggccatcagcaccctggtgagagcctacctgctgaccaaggaccacatcttcctgaacagcgccctgagagccaccgccccctacaagttcctgagcgagcagcacggcgtgaaggccgtgttcatgaacaagcacgactggtacgaggagtaccccaccacccccagcagcttcgtgctgaacggcttcatgtacagcctgatcggcctgtacgacctgaaggagaccgccggcgagaagctgggcaaggaggccagaagcctgtacgagagaggcatggagagcctgaaggccatgctgcccctgtacgacaccggcagcggcaccatctacgacctgagacacttcatgctgggcatcgcccccaacctggccagatgggactaccacaccacccacatcaaccagctgcagctgctgagcaccatcgacgagagccccgtgttcaaggagttcgtgaagagatggaagagctacctgaagggcagcagagccaagcacaactag

SEQ ID NO: 83072 - DNA, 1662 bp, Artificial Sequence
  Description of Artificial Sequence: Synthetic coding sequence
atgaaccacgtggccaagcagcagagcgaggaggccttcccccaggagcagcagaaggccccccccgtggtgggcggcttcaacagcaacgtgggcagcaaggtgctgggcctgaagtacgaggagatcgactgcctgatcaacgacgagcacaccatcaagggcagaagagagggcaacgaggtgttcctgcccttcacctgggtggagaagtacttcgacgtgtacggcaaggtggtgcagtacgacggctacgacagattcgagttcagccacagctacagcaaggtgtacgcccagagagccccctaccaccccgacggcgtgttcatgagcttcgagggctacaacgtggaggtgagagacagagtgaagtgcatcagcggcgtggagggcgtgcccctgagcacccagtggggcccccagggctacttctaccccatccagatcgcccagtacggcctgagccactacagcaagaacctgaccgagaagcccccccacatcgaggtgtacgagaccgccgaggacagagacaagaacaagcccaacgactggaccgtgcccaagggctgcttcatggccaacgtggccgacaagagcagattcaccaacgtgaagcagttcatcgcccccgagaccagcgagggcgtgagcctgcagctgggcaacaccaaggacttcatcatcagcttcgacctgaagttcctgaccaacggcagcgtgagcgtggtgctggagaccaccgagaagaaccagctgttcaccatccactacgtgagcaacgcccagctgatcgccttcaaggagagagacatctactacggcatcggccccagaaccagctggagcaccgtgaccagagacctggtgaccgacctgagaaagggcgtgggcctgagcaacaccaaggccgtgaagcccaccaagatcatgcccaagaaggtggtgagactgatcgccaagggcaagggcttcctggacaacatcaccatcagcaccaccgcccacatggccgccttcttcgccgccagcgactggctggtgagaaaccaggacgagaagggcggctggcccatcatggtgaccagaaagctgggcgagggcttcaagagcctggagcccggctggtacagcgccatggcccagggccaggccatcagcaccctggtgagagcctacctgctgaccaaggaccacatcttcctgaacagcgccctgagagccaccgccccctacaagttcctgagcgagcagcacggcgtgaaggccgtgttcatgaacaagcacgactggtacgaggagtaccccaccacccccagcagcttcgtgctgaacggcttcatgtacagcctgatcggcctgtacgacctgaaggagaccgccggcgagaagctgggcaaggaggccagaagcctgtacgagagaggcatggagagcctgaaggccatgctgcccctgtacgacaccggcagcggcaccatctacgacctgagacacttcatgctgggcatcgcccccaacctggccagatgggactaccacaccacccacatcaaccagctgcagctgctgagcaccatcgacgagagccccgtgttcaaggagttcgtgaagagatggaagagctacctgaagggcagcagagccaagcacaactag

SEQ ID NO: 83073 - DNA, 1956 bp, Artificial Sequence
  Description of Artificial Sequence: Synthetic coding sequence
atggccagaggcagcgccgtggcctgggccgccctgggccccctgctgtggggctgcgccctgggcctgcagggcggcatgctgtacccccaggagagccccagcagagagtgcaaggagctggacggcctgtggagcttcagagccgacttcagcgacaacagaagaagaggcttcgaggagcagtggtacagaagacccctgtgggagagcggccccaccgtggacatgcccgtgcccagcagcttcaacgacatcagccaggactggagactgagacacttcgtgggctgggtgtggtacgagagagaggtgatcctgcccgagagatggacccaggacctgagaaccagagtggtgctgagaatcggcagcgcccacagctacgccatcgtgtgggtgaacggcgtggacaccctggagcacgagggcggctacctgcccttcgaggccgacatcagcaacctggtgcaggtgggccccctgcccagcagactgagaatcaccatcgccatcaacaacaccctgacccccaccaccctgccccccggcaccatccagtacctgaccgacaccagcaagtaccccaagggctacttcgtgcagaacacctacttcgacttcttcaactacgccggcctgcagagaagcgtgctgctgtacaccacccccaccacctacatcgacgacatcaccgtgaccaccagcgtggagcaggacagcggcctggtgaactaccagatcagcgtgaagggcagcaacctgttcaagctggaggtgagactgctggacgccgagaacaaggtggtggccaacggcaccggcacccagggccagctgaaggtgcccggcgtgagcctgtggtggccctacctgatgcacgagagacccgcctacctgtacagcctggaggtgcagctgaccgcccagaccagcctgggccccgtgagcgacttctacaccctgcccgtgggcatcagaaccgtggccgtgaccaagagccagttcctgatcaacggcaagcccttctacttccacggcgtgaacaagcacgaggacgccgacatcagaggcaagggcttcgactggcccctgctggtgaaggacttcaacctgctgagatggctgggcgccaacgccttcagaaccagccactacccctacgccgaggaggtgatgcagatgtgcgacagatacggcatcgtggtgatcgacgagtgccccggcgtgggcctggccctgccccagttcttcaacaacgtgagcctgcaccaccacatgcaggtgatggaggaggtggtgagaagagacaagaaccaccccgccgtggtgatgtggagcgtggccaacgagcccgccagccacctggagagcgccggctactacctgaagatggtgatcgcccacaccaagagcctggaccccagcagacccgtgaccttcgtgagcaacagcaactacgccgccgacaagggcgccccctacgtggacgtgatctgcctgaacagctactacagctggtaccacgactacggccacctggagctgatccagctgcagctggccacccagttcgagaactggtacaagaagtaccagaagcccatcatccagagcgagtacggcgccgagaccatcgccggcttccaccaggacccccccctgatgttcaccgaggagtaccagaagagcctgctggagcagtaccacctgggcctggaccagaagagaagaaagtacgtggtgggcgagctgatctggaacttcgccgacttcatgaccgagcagagccccaccagagtgctgggcaacaagaagggcatcttcaccagacagagacagcccaagagcgccgccttcctgctgagagagagatactggaagatcgccaacgagaccagatacccccacagcgtggccaagagccagtgcctggagaacagcctgttcacctag

SEQ ID NO: 83074 - DNA, 1803 bp, Artificial Sequence
  Description of Artificial Sequence: Synthetic coding sequence
atggccagaggcagcgccgtggcctgggccgccctgggccccctgctgtggggctgcgccctgggcctgcagggcggcatgctgtacccccaggagagccccagcagagagtgcaaggagctggacggcctgtggagcttcagagccgacttcagcgacaacagaagaagaggcttcgaggagcagtggtacagaagacccctgtgggagagcggccccaccgtggacatgcccgtgcccagcagcttcaacgacatcagccaggactggagactgagacacttcgtgggctgggtgtggtacgagagagaggtgatcctgcccgagagatggacccaggacctgagaaccagagtggtgctgagaatcggcagcgcccacagctacgccatcgtgtgggtgaacggcgtggacaccctggagcacgagggcggctacctgcccttcgaggccgacatcagcaacctggtgcaggtgggccccctgcccagcagactgagaatcaccatcgccatcaacaacaccctgacccccaccaccctgccccccggcaccatccagtacctgaccgacaccagcaagtaccccaagggctacttcgtgcagaacacctacttcgacttcttcaactacgccggcctgcagagaagcgtgctgctgtacaccacccccaccacctacatcgacgacatcaccgtgaccaccagcgtggagcaggacagcggcctggtgaactaccagatcagcgtgaagggcagcaacctgttcaagctggaggtgagactgctggacgccgagaacaaggtggtggccaacggcaccggcacccagggccagctgaaggtgcccggcgtgagcctgtggtggccctacctgatgcacgagagacccgcctacctgtacagcctggagatcagaggcaagggcttcgactggcccctgctggtgaaggacttcaacctgctgagatggctgggcgccaacgccttcagaaccagccactacccctacgccgaggaggtgatgcagatgtgcgacagatacggcatcgtggtgatcgacgagtgccccggcgtgggcctggccctgccccagttcttcaacaacgtgagcctgcaccaccacatgcaggtgatggaggaggtggtgagaagagacaagaaccaccccgccgtggtgatgtggagcgtggccaacgagcccgccagccacctggagagcgccggctactacctgaagatggtgatcgcccacaccaagagcctggaccccagcagacccgtgaccttcgtgagcaacagcaactacgccgccgacaagggcgccccctacgtggacgtgatctgcctgaacagctactacagctggtaccacgactacggccacctggagctgatccagctgcagctggccacccagttcgagaactggtacaagaagtaccagaagcccatcatccagagcgagtacggcgccgagaccatcgccggcttccaccaggacccccccctgatgttcaccgaggagtaccagaagagcctgctggagcagtaccacctgggcctggaccagaagagaagaaagtacgtggtgggcgagctgatctggaacttcgccgacttcatgaccgagcagagccccaccagagtgctgggcaacaagaagggcatcttcaccagacagagacagcccaagagcgccgccttcctgctgagagagagatactggaagatcgccaacgagaccagatacccccacagcgtggccaagagccagtgcctggagaacagcctgttcacctag

SEQ ID NO: 83075 - DNA, 675 bp, Artificial Sequence
  Description of Artificial Sequence: Synthetic coding sequence
atggccagcagcacccccagcagcagcgccaccagcagcaacgccggcgccgaccccaacaccaccaacctgagacccaccacctacgacacctggtgcggcgtggcccacggctgcaccagaaagctgggcctgaagatctgcggcttcctgcagagaaccaacagcctggaggagaagagcagactggtgagcgccttcaaggagagacagagcagcaagaacctgctgagctgcgagaacagcgacagagacgccagattcagaagaaccgagaccgacttcagcaacctgttcgccagagacctgctgcccgccaagaacggcgaggagcagaccgtgcagttcctgctggaggtggtggacatcctgctgaactacgtgagaaagaccttcgacagaagcaccaaggtgctggacttccaccacccccaccagctgctggagggcatggagggcttcaacctggagctgagcgaccaccccgagagcctggagcagatcctggtggactgcagagacaccctgaagtacggcgtgagaaccggccaccccagattcttcaaccagctgagcaccggcctggacatcatcggcctggccggcgagtggctgaccagcaccgccaacaccaacatgcccagcgacatgagagagtgctggctgctgagatag

SEQ ID NO: 83076 - DNA, 1785 bp, Artificial Sequence
  Description of Artificial Sequence: Synthetic coding sequence
atggccagcagcacccccagcagcagcgccaccagcagcaacgccggcgccgaccccaacaccaccaacctgagacccaccacctacgacacctggtgcggcgtggcccacggctgcaccagaaagctgggcctgaagatctgcggcttcctgcagagaaccaacagcctggaggagaagagcagactggtgagcgccttcaaggagagacagagcagcaagaacctgctgagctgcgagaacagcgacagagacgccagattcagaagaaccgagaccgacttcagcaacctgttcgccagagacctgctgcccgccaagaacggcgaggagcagaccgtgcagttcctgctggaggtggtggacatcctgctgaactacgtgagaaagaccttcgacagaagcaccaaggtgctggacttccaccacccccaccagctgctggagggcatggagggcttcaacctggagctgagcgaccaccccgagagcctggagcagatcctggtggactgcagagacaccctgaagtacggcgtgagaaccggccaccccagattcttcaaccagctgagcaccggcctggacatcatcggcctggccggcgagtggctgaccagcaccgccaacaccaacatgttcacctacgagatcgcccccgtgttcgtgctgatggagcagatcaccctgaagaagatgagagagatcgtgggctggagcagcaaggacggcgacggcatcttcagccccggcggcgccatcagcaacatgtacagcatcatggccgccagatacaagtacttccccgaggtgaagaccaagggcatggccgccgtgcccaagctggtgctgttcaccagcgagcagagccactacagcatcaagaaggccggcgccgccctgggcttcggcaccgacaacgtgatcctgatcaagtgcaacgagagaggcaagatcatccccgccgacttcgaggccaagatcctggaggccaagcagaagggctacgtgcccttctacgtgaacgccaccgccggcaccaccgtgtacggcgccttcgaccccatccaggagatcgccgacatctgcgagaagtacaacctgtggctgcacgtggacgccgcctggggcggcggcctgctgatgagcagaaagcacagacacaagctgaacggcatcgagagagccaacagcgtgacctggaacccccacaagatgatgggcgtgctgctgcagtgcagcgccatcctggtgaaggagaagggcatcctgcagggctgcaaccagatgtgcgccggctacctgttccagcccgacaagcagtacgacgtgagctacgacaccggcgacaaggccatccagtgcggcagacacgtggacatcttcaagttctggctgatgtggaaggccaagggcaccgtgggcttcgagaaccagatcaacaagtgcctggagctggccgagtacctgtacgccaagatcaagaacagagaggagttcgagatggtgttcaacggcgagcccgagcacaccaacgtgtgcttctggtacatcccccagagcctgagaggcgtgcccgacagcccccagagaagagagaagctgcacaaggtggcccccaagatcaaggccctgatgatggagagcggcaccaccatggtgggctaccagccccagggcgacaaggccaacttcttcagaatggtgatcagcaaccccgccgccacccagagcgacatcgacttcctgatcgaggagatcgagagactgggccaggacctgtag

SEQ ID NO: 83077 - DNA, 675 bp, Artificial Sequence; identical to SEQ ID NO: 83075
  Description of Artificial Sequence: Synthetic coding sequence

SEQ ID NO: 83078 - DNA, 114 bp, Artificial Sequence
  Description of Artificial Sequence: Synthetic coding sequence
atggccagcagcacccccagcagcagcgccaccagcagcaacgccggcgccgaccccaacaccaccaacctgagacccaccacctacgacacctggtgcggcgtggcccactag

SEQ ID NO: 83079 - DNA, 258 bp, Artificial Sequence
  Description of Artificial Sequence: Synthetic coding sequence
atggccagcagcacccccagcagcagcgccaccagcagcaacgccggcgccgaccccaacaccaccaacctgagacccaccacctacgacacctggtgcggcgtggcccacggctgcaccagaaagctgggcctgaagatctgcggcttcctgcagagaaccaacagcctggaggagaagagcagactggtgagcgccttcaaggagagacagagcagcaagaacctgctgagctgcgagaacagcgacagagactag

SEQ ID NO: 83080 - DNA, 348 bp, Artificial Sequence
  Description of Artificial Sequence: Synthetic coding sequence
atggccagcagcacccccagcagcagcgccaccagcagcaacgccggcgccgaccccaacaccaccaacctgagacccaccacctacgacacctggtgcggcgtggcccacggctgcaccagaaagctgggcctgaagatctgcggcttcctgcagagaaccaacagcctggaggagaagagcagactggtgagcgccttcaaggagagacagagcagcaagaacctgctgagctgcgagaacagcgacagagacgccagattcagaagaaccgagaccgacttcagcaacctgttcgccagagacctgctgcccgccaagaacggcgaggagcagaccgtgcagtag

SEQ ID NO: 83081 - DNA, 366 bp, Artificial Sequence
  Description of Artificial Sequence: Synthetic coding sequence
atggccagcagcacccccagcagcagcgccaccagcagcaacgccggcgccgaccccaacaccaccaacctgagacccaccacctacgacacctggtgcggcgtggcccacggctgcaccagaaagctgggcctgaagatctgcggcttcctgcagagaaccaacagcctggaggagaagagcagactggtgagcgccttcaaggagagacagagcagcaagaacctgctgagctgcgagaacagcgacagagacgccagattcagaagaaccgagaccgacttcagcaacctgttcgccagagacctgctgcccgccaagaacggcgaggagcagaccgtgcagttcctgctggaggtggtgtag

SEQ ID NO: 83082 - DNA, 1758 bp, Artificial Sequence
  Description of Artificial Sequence: Synthetic coding sequence
atggccagccccggcagcggcttctggagcttcggcagcgaggacggcagcggcgacagcgagaaccccggcaccgccagagcctggtgccaggtggcccagaagttcaccggcggcatcggcaacaagctgtgcgccctgctgtacggcgacgccgagaagcccgccgagagcggcggcagccagccccccagagccgccgccagaaaggccgcctgcgcctgcgaccagaagccctgcagctgcagcaaggtggacgtgaactacgccttcctgcacgccaccgacctgctgcccgcctgcgacggcgagagacccaccctggccttcctgcaggacgtgatgaacatcctgctgcagtacgtggtgaagagcttcgacagaagcaccaaggtgatcgacttccactaccccaacgagctgctgcaggagtacaactgggagctggccgaccagccccagaacctggaggagatcctgatgcactgccagaccaccctgaagtacgccatcaagaccggccaccccagatacttcaaccagctgagcaccggcctggacatggtgggcctggccgccgactggctgaccagcaccgccaacaccaacatgttcacctacgagatcgcccccgtgttcgtgctgctggagtacgtgaccctgaagaagatgagagagatcatcggctggcccggcggcagcggcgacggcatcttcagccccggcggcgccatcagcaacatgtacgccatgatgatcgccagattcaagatgttccccgaggtgaaggagaagggcatggccgccctgcccagactgatcgccttcaccagcgagcacagccacttcagcctgaagaagggcgccgccgccctgggcatcggcaccgacagcgtgatcctgatcaagtgcgacgagagaggcaagatgatccccagcgacctggagagaagaatcctggaggccaagcagaagggcttcgtgcccttcctggtgagcgccaccgccggcaccaccgtgtacggcgccttcgaccccctgctggccgtggccgacatctgcaagaagtacaagatctggatgcacgtggacgccgcctggggcggcggcctgctgatgagcagaaagcacaagtggaagctgagcggcgtggagagagccaacagcgtgacctggaacccccacaagatgatgggcgtgcccctgcagtgcagcgccctgctggtgagagaggagggcctgatgcagaactgcaaccagatgcacgccagctacctgttccagcaggacaagcactacgacctgagctacgacaccggcgacaaggccctgcagtgcggcagacacgtggacgtgttcaagctgtggctgatgtggagagccaagggcaccaccggcttcgaggcccacgtggacaagtgcctggagctggccgagtacctgtacaacatcatcaagaacagagagggctacgagatggtgttcgacggcaagccccagcacaccaacgtgtgcttctggtacatcccccccagcctgagaaccctggaggacaacgaggagagaatgagcagactgagcaaggtggcccccgtgatcaaggccagaatgatggagtacggcaccaccatggtgagctaccagcccctgggcgacaaggtgaacttcttcagaatggtgatcagcaaccccgccgccacccaccaggacatcgacttcctgatcgaggagatcgagagactgggccaggacctgtag

SEQ ID NO: 83083 - DNA, 390 bp, Artificial Sequence
  Description of Artificial Sequence: Synthetic coding sequence
atgaacatcctgctgcagtacgtggtgaagagcttcgacagaagcaccaaggtgatcgacttccactaccccaacgagctgctgcaggagtacaactgggagctggccgaccagccccagaacctggaggagatcctgatgcactgccagaccaccctgaagtacgccatcaagaccggccaccccagatacttcaaccagctgagcaccggcctggacatggtgggcctggccgccgactggctgaccagcaccgccaacaccaacatgttcacctacgagatcgcccccgtgttcgtgctgctggagtacgtgaccctgaagaagatgagagagatcatcggctggcccggcggcagcggcgacggcatcttcagccccggcacctag

SEQ ID NO: 83084 - DNA, 1758 bp, Artificial Sequence; identical to SEQ ID NO: 83082
  Description of Artificial Sequence: Synthetic coding sequence

SEQ ID NO: 83085 - DNA, 567 bp, Artificial Sequence
  Description of Artificial Sequence: Synthetic coding sequence
atggccagccccggcagcggcttctggagcttcggcagcgaggacggcagcggcgacagcgagaaccccggcaccgccagagcctggtgccaggtggcccagaagttcaccggcggcatcggcaacaagctgtgcgccctgctgtacggcgacgccgagaagcccgccgagagcggcggcagccagccccccagagccgccgccagaaaggccgcctgcgcctgcgaccagaagccctgcagctgcagcaaggtggacgtgaactacgccttcctgcacgccaccgacctgctgcccgcctgcgacggcgagagacccaccctggccttcctgcaggacgtgatgaacatcctgctgcagtacgtggtgaagagcttcgacagaagcaccaaggtgatcgacttccactaccccaacgagctgctgcaggagtacaactgggagctggccgaccagccccagaacctggaggagatcctgatgcactgccagaccaccctgaagtacgccatcaagaccggcatcgtgagcagcaagatcatcaagctgttcttcagactgcagtag

SEQ ID NO: 83086 - DNA, 1677 bp, Artificial Sequence
  Description of Artificial Sequence: Synthetic coding sequence
atgtacagatacctgggcgaggccctgctgctgagcagagccggccccgccgccctgggcagcgccagcgccgacagcgccgccctgctgggctgggccagaggccagcccgccgccgccccccagcccggcctggccctggccgccagaagacactacagcgaggccgtggccgacagagaggacgaccccaacttcttcaagatggtggagggcttcttcgacagaggcgccagcatcgtggaggacaagctggtggaggacctgagaaccagagagagcgaggagcagaagagaaacagagtgagaggcatcctgagaatcatcaagccctgcaaccacgtgctgagcctgagcttccccatcagaagagacgacggcagctgggaggtgatcgagggctacagagcccagcacagccagcacagaaccccctgcaagggcggcatcagatacagcaccgacgtgagcgtggacgaggtgaaggccctggccagcctgatgacctacaagtgcgccgtggtggacgtgcccttcggcggcgccaaggccggcgtgaagatcaaccccaagaactacaccgacaacgagctggagaagatcaccagaagattcaccatggagctggccaagaagggcttcatcggccccggcatcgacgtgcccgcccccgacatgagcaccggcgagagagagatgagctggatcgccgacacctacgccagcaccatcggccactacgacatcaacgcccacgcctgcgtgaccggcaagcccatcagccagggcggcatccacggcagaatcagcgccaccggcagaggcgtgttccacggcatcgagaacttcatcaacgaggccagctacatgagcatcctgggcatgacccccggcttcggcgacaagaccttcgtggtgcagggcttcggcaacgtgggcctgcacagcatgagatacctgcacagattcggcgccaagtgcatcgccgtgggcgagagcgacggcagcatctggaaccccgacggcatcgaccccaaggagctggaggacttcaagctgcagcacggcagcatcctgggcttccccaaggccaagccctacgagggcagcatcctggaggccgactgcgacatcctgatccccgccgccagcgagaagcagctgaccaagagcaacgcccccagagtgaaggccaagatcatcgccgagggcgccaacggccccaccacccccgaggccgacaagatcttcctggagagaaacatcatggtgatccccgacctgtacctgaacgccggcggcgtgaccgtgagctacttcgagtggctgaagaacctgaaccacgtgagctacggcagactgaccttcaagtacgagagagacagcaactaccacctgctgatgagcgtgcaggagagcctggagagaaagttcggcaagcacggcggcaccatccccatcgtgcccaccgccgagttccaggacagaatcagcggcgccagcgagaaggacatcgtgcacagcggcctggcctacaccatggagagaagcgccagacagatcatgagaaccgccatgaagtacaacctgggcctggacctgagaaccgccgcctacgtgaacgccatcgagaaggtgttcaaggtgtacaacgaggccggcgtgaccttcacctag

SEQ ID NO: 83087 - DNA, 1548 bp, Artificial Sequence
  Description of Artificial Sequence: Synthetic coding sequence
atgtacagatacctgggccccggcaccgccagaagaagacccgccgccggcgccggcatcggcagacccgcccccctgcagagaggcggcggcagacccagaggcagaccccagctgctgcaggacggcggcggcctgctgagaagcagaagacagcacagaggcggccaggccggcggcggccccgaggaccccggcgagagaggcgccgaggccgagcccggcgccagacaccccgccgaccaccaggccctgcagccctgcgccgagagcctgctgccccagcacagccagcacagaaccccctgcaagggcggcatcagatacagcaccgacgtgagcgtggacgaggtgaaggccctggccagcctgatgacctacaagtgcgccgtggtggacgtgcccttcggcggcgccaaggccggcgtgaagatcaaccccaagaactacaccgacaacgagctggagaagatcaccagaagattcaccatggagctggccaagaagggcttcatcggccccggcatcgacgtgcccgcccccgacatgagcaccggcgagagagagatgagctggatcgccgacacctacgccagcaccatcggccactacgacatcaacgcccacgcctgcgtgaccggcaagcccatcagccagggcggcatccacggcagaatcagcgccaccggcagaggcgtgttccacggcatcgagaacttcatcaacgaggccagctacatgagcatcctgggcatgacccccggcttcggcgacaagaccttcgtggtgcagggcttcggcaacgtgggcctgcacagcatgagatacctgcacagattcggcgccaagtgcatcgccgtgggcgagagcgacggcagcatctggaaccccgacggcatcgaccccaaggagctggaggacttcaagctgcagcacggcagcatcctgggcttccccaaggccaagccctacgagggcagcatcctggaggccgactgcgacatcctgatccccgccgccagcgagaagcagctgaccaagagcaacgcccccagagtgaaggccaagatcatcgccgagggcgccaacggccccaccacccccgaggccgacaagatcttcctggagagaaacatcatggtgatccccgacctgtacctgaacgccggcggcgtgaccgtgagctacttcgagtggctgaagaacctgaaccacgtgagctacggcagactgaccttcaagtacgagagagacagcaactaccacctgctgatgagcgtgcaggagagcctggagagaaagttcggcaagcacggcggcaccatccccatcgtgcccaccgccgagttccaggacagaatcagcggcgccagcgagaaggacatcgtgcacagcggcctggcctacaccatggagagaagcgccagacagatcatgagaaccgccatgaagtacaacctgggcctggacctgagaaccgccgcctacgtgaacgccatcgagaaggtgttcaaggtgtacaacgaggccggcgtgaccttcacctag

SEQ ID NO: 83088 - DNA, 1473 bp, Artificial Sequence
  Description of Artificial Sequence: Synthetic coding sequence
atggtggagggcttcttcgacagaggcgccagcatcgtggaggacaagctggtggaggacctgagaaccagagagagcgaggagcagaagagaaacagagtgagaggcatcctgagaatcatcaagccctgcaaccacgtgctgagcctgagcttccccatcagaagagacgacggcagctgggaggtgatcgagggctacagagcccagcacagccagcacagaaccccctgcaagggcggcatcagatacagcaccgacgtgagcgtggacgaggtgaaggccctggccagcctgatgacctacaagtgcgccgtggtggacgtgcccttcggcggcgccaaggccggcgtgaagatcaaccccaagaactacaccgacaacgagctggagaagatcaccagaagattcaccatggagctggccaagaagggcttcatcggccccggcatcgacgtgcccgcccccgacatgagcaccggcgagagagagatgagctggatcgccgacacctacgccagcaccatcggccactacgacatcaacgcccacgcctgcgtgaccggcaagcccatcagccagggcggcatccacggcagaatcagcgccaccggcagaggcgtgttccacggcatcgagaacttcatcaacgaggccagctacatgagcatcctgggcatgacccccggcttcggcgacaagaccttcgtggtgcagggcttcggcaacgtgggcctgcacagcatgagatacctgcacagattcggcgccaagtgcatcgccgtgggcgagagcgacggcagcatctggaaccccgacggcatcgaccccaaggagctggaggacttcaagctgcagcacggcagcatcctgggcttccccaaggccaagccctacgagggcagcatcctggaggccgactgcgacatcctgatccccgccgccagcgagaagcagctgaccaagagcaacgcccccagagtgaaggccaagatcatcgccgagggcgccaacggccccaccacccccgaggccgacaagatcttcctggagagaaacatcatggtgatccccgacctgtacctgaacgccggcggcgtgaccgtgagctacttcgagtggctgaagaacctgaaccacgtgagctacggcagactgaccttcaagtacgagagagacagcaactaccacctgctgatgagcgtgcaggagagcctggagagaaagttcggcaagcacggcggcaccatccccatcgtgcccaccgccgagttccaggacagaatcagcggcgccagcgagaaggacatcgtgcacagcggcctggcctacaccatggagagaagcgccagacagatcatgagaaccgccatgaagtacaacctgggcctggacctgagaaccgccgcctacgtgaacgccatcgagaaggtgttcaaggtgtacaacgaggccggcgtgaccttcacctag

SEQ ID NO: 83089 - DNA, 774 bp, Artificial Sequence
  Description of Artificial Sequence: Synthetic coding sequence
gagaacttcatcgtggagggcttcggcaacgtgggcctgcacagcatgagatacctgcacagattcggcgccaagtgcatcgccgtgggcgagagcgacggcagcatctggaaccccgacggcatcgaccccaaggagctggaggacttcaagctgcagcacggcagcatcctgggcttccccaaggccaagccctacgagggcagcatcctggaggccgactgcgacatcctgatccccgccgccagcgagaagcagctgaccaagagcaacgcccccagagtgaaggccaagatcatcgccgagggcgccaacggccccaccacccccgaggccgacaagatcttcctggagagaaacatcatggtgatccccgacctgtacctgaacgccggcggcgtgaccgtgagctacttcgagtggctgaagaacctgaaccacgtgagctacggcagactgaccttcaagtacgagagagacagcaactaccacctgctgatgagcgtgcaggagagcctggagagaaagttcggcaagcacggcggcaccatccccatcgtgcccaccgccgagttccaggacagaatcagcggcgccagcgagaaggacatcgtgcacagcggcctggcctacaccatggagagaagcgccagacagatcatgagaaccgccatgaagtacaacctgggcctggacctgagaaccgccgcctacgtgaacgccatcgagaaggtgttcaaggtgtacaacgaggccggcgtgaccttcacctag

SEQ ID NO: 83090 - DNA, 1176 bp, Artificial Sequence
  Description of Artificial Sequence: Synthetic coding sequence
atgacctacaagtgcgccgtggtggacgtgcccttcggcggcgccaaggccggcgtgaagatcaaccccaagaactacaccgacaacgagctggagaagatcaccagaagattcaccatggagctggccaagaagggcttcatcggccccggcatcgacgtgcccgcccccgacatgagcaccggcgagagagagatgagctggatcgccgacacctacgccagcaccatcggccactacgacatcaacgcccacgcctgcgtgaccggcaagcccatcagccagggcggcatccacggcagaatcagcgccaccggcagaggcgtgttccacggcatcgagaacttcatcaacgaggccagctacatgagcatcctgggcatgacccccggcttcggcgacaagaccttcgtggtgcagggcttcggcaacgtgggcctgcacagcatgagatacctgcacagattcggcgccaagtgcatcgccgtgggcgagagcgacggcagcatctggaaccccgacggcatcgaccccaaggagctggaggacttcaagctgcagcacggcagcatcctgggcttccccaaggccaagccctacgagggcagcatcctggaggccgactgcgacatcctgatccccgccgccagcgagaagcagctgaccaagagcaacgcccccagagtgaaggccaagatcatcgccgagggcgccaacggccccaccacccccgaggccgacaagatcttcctggagagaaacatcatggtgatccccgacctgtacctgaacgccggcggcgtgaccgtgagctacttcgagtggctgaagaacctgaaccacgtgagctacggcagactgaccttcaagtacgagagagacagcaactaccacctgctgatgagcgtgcaggagagcctggagagaaagttcggcaagcacggcggcaccatccccatcgtgcccaccgccgagttccaggacagaatcagcggcgccagcgagaaggacatcgtgcacagcggcctggcctacaccatggagagaagcgccagacagatcatgagaaccgccatgaagtacaacctgggcctggacctgagaaccgccgcctacgtgaacgccatcgagaaggtgttcaaggtgtacaacgaggccggcgtgaccttcacctag

SEQ ID NO: 83091 - DNA, 1278 bp, Artificial Sequence
  Description of Artificial Sequence: Synthetic coding sequence
atgacctgcccctgcgacaacgccagcagcgtgttcctgggcttctgcatcagatacagcaccgacgtgagcgtggacgaggtgaaggccctggccagcctgatgacctacaagtgcgccgtggtggacgtgcccttcggcggcgccaaggccggcgtgaagatcaaccccaagaactacaccgacaacgagctggagaagatcaccagaagattcaccatggagctggccaagaagggcttcatcggccccggcatcgacgtgcccgcccccgacatgagcaccggcgagagagagatgagctggatcgccgacacctacgccagcaccatcggccactacgacatcaacgcccacgcctgcgtgaccggcaagcccatcagccagggcggcatccacggcagaatcagcgccaccggcagaggcgtgttccacggcatcgagaacttcatcaacgaggccagctacatgagcatcctgggcatgacccccggcttcggcgacaagaccttcgtggtgcagggcttcggcaacgtgggcctgcacagcatgagatacctgcacagattcggcgccaagtgcatcgccgtgggcgagagcgacggcagcatctggaaccccgacggcatcgaccccaaggagctggaggacttcaagctgcagcacggcagcatcctgggcttccccaaggccaagccctacgagggcagcatcctggaggccgactgcgacatcctgatccccgccgccagcgagaagcagctgaccaagagcaacgcccccagagtgaaggccaagatcatcgccgagggcgccaacggccccaccacccccgaggccgacaagatcttcctggagagaaacatcatggtgatccccgacctgtacctgaacgccggcggcgtgaccgtgagctacttcgagtggctgaagaacctgaaccacgtgagctacggcagactgaccttcaagtacgagagagacagcaactaccacctgctgatgagcgtgcaggagagcctggagagaaagttcggcaagcacggcggcaccatccccatcgtgcccaccgccgagttccaggacagaatcagcggcgccagcgagaaggacatcgtgcacagcggcctggcctacaccatggagagaagcgccagacagatcatgagaaccgccatgaagtacaacctgggcctggacctgagaaccgccgcctacgtgaacgccatcgagaaggtgttcaaggtgtacaacgaggccggcgtgaccttcacctag

SEQ ID NO: 83092 - DNA, 1677 bp, Artificial Sequence
  Description of Artificial Sequence: Synthetic coding sequence
atgtacagatacctggccaaggccctgctgcccagcagagccggccccgccgccctgggcagcgccgccaaccacagcgccgccctgctgggcagaggcagaggccagcccgccgccgccagccagcccggcctggccctggccgccagaagacactacagcgagctggtggccgacagagaggacgaccccaacttcttcaagatggtggagggcttcttcgacagaggcgccagcatcgtggaggacaagctggtgaaggacctgagaacccaggagagcgaggagcagaagagaaacagagtgagaggcatcctgagaatcatcaagccctgcaaccacgtgctgagcctgagcttccccatcagaagagacgacggcagctgggaggtgatcgagggctacagagcccagcacagccagcacagaaccccctgcaagggcggcatcagatacagcaccgacgtgagcgtggacgaggtgaaggccctggccagcctgatgacctacaagtgcgccgtggtggacgtgcccttcggcggcgccaaggccggcgtgaagatcaaccccaagaactacaccgagaacgagctggagaagatcaccagaagattcaccatggagctggccaagaagggcttcatcggccccggcgtggacgtgcccgcccccgacatgaacaccggcgagagagagatgagctggatcgccgacacctacgccagcaccatcggccactacgacatcaacgcccacgcctgcgtgaccggcaagcccatcagccagggcggcatccacggcagaatcagcgccaccggcagaggcgtgttccacggcatcgagaacttcatcaacgaggccagctacatgagcatcctgggcatgacccccggcttcagagacaagaccttcgtggtgcagggcttcggcaacgtgggcctgcacagcatgagatacctgcacagattcggcgccaagtgcatcgccgtgggcgagagcgacggcagcatctggaaccccgacggcatcgaccccaaggagctggaggacttcaagctgcagcacggcagcatcctgggcttccccaaggccaagccctacgagggcagcatcctggaggtggactgcgacatcctgatccccgccgccaccgagaagcagctgaccaagagcaacgcccccagagtgaaggccaagatcatcgccgagggcgccaacggccccaccacccccgaggccgacaagatcttcctggagagaaacatcctggtgatccccgacctgtacctgaacgccggcggcgtgaccgtgagctacttcgagtggctgaagaacctgaaccacgtgagctacggcagactgaccttcaagtacgagagagacagcaactaccacctgctgctgagcgtgcaggagagcctggagagaaagttcggcaagcacggcggcaccatccccatcgtgcccaccgccgagttccaggacagcatcagcggcgccagcgagaaggacatcgtgcacagcgccctggcctacaccatggagagaagcgccagacagatcatgcacaccgccatgaagtacaacctgggcctggacctgagaaccgccgcctacgtgaacgccatcgagaaggtgttcaaggtgtacagcgaggccggcgtgaccttcacctag

SEQ ID NO: 83093 - DNA, 3342 bp, Artificial Sequence
  Description of Artificial Sequence: Synthetic coding sequence
atgatcgccgtgagcttcaagtgcagatgccagatcctgagaagactgaccaaggacgagagcccctacaccaagagcgccagccagaccaagccccccgacggcgccctggccgtgagaagacagagcatccccgaggagttcaagggcagcaccgtggtggagctgatgaagaaggagggcaccaccctgggcctgaccgtgagcggcggcatcgacaaggacggcaagcccagagtgagcaacctgagacagggcggcatcgccgccagaagcgaccagctggacgtgggcgactacatcaaggccgtgaacggcatcaacctggccaagttcagacacgacgagatcatcagcctgctgaagaacgtgggcgagagagtggtgctggaggtggagtacgagctgccccccgtgagcgtgcagggcagcagcgtgatcttcagaaccgtggaggtgaccctgcacaaggagggcaacaccttcggcttcgtgatcagaggcggcgcccacgacgacagaaacaagagcagacccgtggtgatcacctgcgtgagacccggcggccccgccgacagagagggcaccatcaagcccggcgacagactgctgagcgtggacggcatcagactgctgggcaccacccacgccgaggccatgagcatcctgaagcagtgcggccaggaggccgccctgctgatcgagtacgacgtgagcgtgatggacagcgtggccaccgccagcggccccctgctggtggaggtggccaagacccccggcgccagcctgggcgtggccctgaccaccagcatgtgctgcaacaagcaggtgatcgtgatcgacaagatcaagagcgccagcatcgccgacagatgcggcgccctgcacgtgggcgaccacatcctgagcatcgacggcaccagcatggagtactgcaccctggccgaggccacccagttcctggccaacaccaccgaccaggtgaagctggagatcctgccccaccaccagaccagactggccctgaagggccccgaccacgtgaagatccagagaagcgacagacagctgacctgggacagctgggccagcaaccacagcagcctgcacaccaaccaccactacaacacctaccaccccgaccactgcagagtgcccgccctgaccttccccaaggcccccccccccaacagcccccccgccctggtgagcagcagcttcagccccaccagcatgagcgcctacagcctgagcagcctgaacatgggcaccctgcccagaagcctgtacagcaccagccccagaggcaccatgatgagaagaagactgaagaagaaggacttcaagagcagcctgagcctggccagcagcaccgtgggcctggccggccaggtggtgcacaccgagaccaccgaggtggtgctgaccgccgaccccgtgaccggcttcggcatccagctgcagggcagcgtgttcgccaccgagaccctgagcagcccccccctgatcagctacatcgaggccgacagccccgccgagagatgcggcgtgctgcagatcggcgacagagtgatggccatcaacggcatccccaccgaggacagcaccttcgaggaggccagccagctgctgagagacagcagcatcaccagcaaggtgaccctggagatcgagttcgacgtggccgagagcgtgatccccagcagcggcaccttccacgtgaagctgcccaagaagcacaacgtggagctgggcatcaccatcagcagccccagcagcagaaagcccggcgaccccctggtgatcagcgacatcaagaagggcagcgtggcccacagaaccggcaccctggagctgggcgacaagctgctggccatcgacaacatcagactggacaactgcagcatggaggacgccgtgcagatcctgcagcagtgcgaggacctggtgaagctgaagatcagaaaggacgaggacaacagcgacgagcaggagagcagcggcgccatcatctacaccgtggagctgaagagatacggcggccccctgggcatcaccatcagcggcaccgaggagcccttcgaccccatcatcatcagcagcctgaccaagggcggcctggccgagagaaccggcgccatccacatcggcgacagaatcctggccatcaacagcagcagcctgaagggcaagcccctgagcgaggccatccacctgctgcagatggccggcgagaccgtgaccctgaagatcaagaagcagaccgacgcccagagcgccagcagccccaagaagttccccatcagcagccacctgagcgacctgggcgacgtggaggaggacagcagccccgcccagaagcccggcaagctgagcgacatgtaccccagcaccgtgcccagcgtggacagcgccgtggacagctgggacggcagcgccatcgacaccagctacggcacccagggcaccagcttccaggccagcggctacaacttcaacacctacgactggagaagccccaagcagagaggcagcctgagccccgtgaccaagcccagaagccagacctaccccgacgtgggcctgagctacgaggactgggacagaagcaccgccagcggcttcgccggcgccgccgacagcgccgagaccgagcaggaggagaacttctggagccaggccctggaggacctggagacctgcggccagagcggcatcctgagagagctggaggccaccatcatgagcggcagcaccatgagcctgaaccacgaggcccccacccccagaagccagctgggcagacaggccagcttccaggagagaagcagcagcagaccccactacagccagaccaccagaagcaacaccctgcccagcgacgtgggcagaaagagcgtgaccctgagaaagatgaagcaggagatcaaggagatcatgagccccacccccgtggagctgcacaaggtgaccctgtacaaggacagcgacatggaggacttcggcttcagcgtggccgacggcctgctggagaagggcgtgtacgtgaagaacatcagacccgccggccccggcgacctgggcggcctgaagccctacgacagactgctgcaggtgaaccacgtgagaaccagagacttcgactgctgcctggtggtgcccctgatcgccgagagcggcaacaagctggacctggtgatcagcagaaaccccctggccagccagaagagcatcgaccagcagagcctgcccggcgactggagcgagcagaacagcgccttcttccagcagcccagccacggcggcaacctggagaccagagagcccaccaacaccctgtag

SEQ ID NO: 83094 - DNA, 3387 bp, Artificial Sequence
  Description of Artificial Sequence: Synthetic coding sequence
atgatcgccgtgagcttcaagtgcagatgccagatcctgagaagactgaccaaggacgagagcccctacaccaagagcgccagccagaccaagccccccgacggcgccctggccgtgagaagacagagcatccccgaggagttcaagggcagcaccgtggtggagctgatgaagaaggagggcaccaccctgggcctgaccgtgagcggcggcatcgacaaggacggcaagcccagagtgagcaacctgagacagggcggcatcgccgccagaagcgaccagctggacgtgggcgactacatcaaggccgtgaacggcatcaacctggccaagttcagacacgacgagatcatcagcctgctgaagaacgtgggcgagagagtggtgctggaggtggagtacgagctgccccccgtgagcgtgcagggcagcagcgtgatcttcagaaccgtggaggtgaccctgcacaaggagggcaacaccttcggcttcgtgatcagaggcggcgcccacgacgacagaaacaagagcagacccgtggtgatcacctgcgtgagacccggcggccccgccgacagagagggcaccatcaagcccggcgacagactgctgagcgtggacggcatcagactgctgggcaccacccacgccgaggccatgagcatcctgaagcagtgcggccaggaggccgccctgctgatcgagtacgacgtgagcgtgatggacagcgtggccaccgccagcggccccctgctggtggaggtggccaagacccccggcgccagcctgggcgtggccctgaccaccagcatgtgctgcaacaagcaggtgatcgtgatcgacaagatcaagagcgccagcatcgccgacagatgcggcgccctgcacgtgggcgaccacatcctgagcatcgacggcaccagcatggagtactgcaccctggccgaggccacccagttcctggccaacaccaccgaccaggtgaagctggagatcctgccccaccaccagaccagactggccctgaagggccccgaccacgtgaagatccagagaagcgacagacagctgacctgggacagctgggccagcaaccacagcagcctgcacaccaaccaccactacaacacctaccaccccgaccactgcagagtgcccgccctgaccttccccaaggcccccccccccaacagcccccccgccctggtgagcagcagcttcagccccaccagcatgagcgcctacagcctgagcagcctgaacatgggcaccctgcccagaagcctgtacagcaccagccccagaggcaccatgatgagaagaagactgaagaagaaggacttcaagagcagcctgagcctggccagcagcaccgtgggcctggccggccaggtggtgcacaccgagaccaccgaggtggtgctgaccgccgaccccgtgaccggcttcggcatccagctgcagggcagcgtgttcgccaccgagaccctgagcagcccccccctgatcagctacatcgaggccgacagccccgccgagagatgcggcgtgctgcagatcggcgacagagtgatggccatcaacggcatccccaccgaggacagcaccttcgaggaggccagccagctgctgagagacagcagcatcaccagcaaggtgaccctggagatcgagttcgacgtggccgagagcgtgatccccagcagcggcaccttccacgtgaagctgcccaagaagcacaacgtggagctgggcatcaccatcagcagccccagcagcagaaagcccggcgaccccctggtgatcagcgacatcaagaagggcagcgtggcccacagaaccggcaccctggagctgggcgacaagctgctggccatcgacaacatcagactggacaactgcagcatggaggacgccgtgcagatcctgcagcagtgcgaggacctggtgaagctgaagatcagaaaggacgaggacaacagcgacgagcaggagagcagcggcgccatcatctacaccgtggagctgaagagatacggcggccccctgggcatcaccatcagcggcaccgaggagcccttcgaccccatcatcatcagcagcctgaccaagggcggcctggccgagagaaccggcgccatccacatcggcgacagaatcctggccatcaacagcagcagcctgaagggcaagcccctgagcgaggccatccacctgctgcagatggccggcgagaccgtgaccctgaagatcaagaagcagaccgacgcccagagcgccagcagccccaagaagttccccatcagcagccacctgagcgacctgggcgacgtggaggaggacagcagccccgcccagaagcccggcaagctgagcgacatgtaccccagcaccgtgcccagcgtggacagcgccgtggacagctgggacggcagcgccatcgacaccagctacggcacccagggcaccagcttccaggccagcggctacaacttcaacacctacgactggagaagccccaagcagagaggcagcctgagccccgtgaccaagcccagaagccagacctaccccgacgtgggcctgagctacgaggactgggacagaagcaccgccagcggcttcgccggcgccgccgacagcgccgagaccgagcaggaggagaacttctggagccaggccctggaggacctggagacctgcggccagagcggcatcctgagagagctggaggagaaggccgacagaagagtgagcctgagaaacatgaccctgctggccaccatcatgagcggcagcaccatgagcctgaaccacgaggcccccacccccagaagccagctgggcagacaggccagcttccaggagagaagcagcagcagaccccactacagccagaccaccagaagcaacaccctgcccagcgacgtgggcagaaagagcgtgaccctgagaaagatgaagcaggagatcaaggagatcatgagccccacccccgtggagctgcacaaggtgaccctgtacaaggacagcgacatggaggacttcggcttcagcgtggccgacggcctgctggagaagggcgtgtacgtgaagaacatcagacccgccggccccggcgacctgggcggcctgaagccctacgacagactgctgcaggtgaaccacgtgagaaccagagacttcgactgctgcctggtggtgcccctgatcgccgagagcggcaacaagctggacctggtgatcagcagaaaccccctggccagccagaagagcatcgaccagcagagcctgcccggcgactggagcgagcagaacagcgccttcttccagcagcccagccacggcggcaacctggagaccagagagcccaccaacaccctgtag

SEQ ID NO: 83095 - DNA, 3231 bp, Artificial Sequence
  Description of Artificial Sequence: Synthetic coding sequence
atgatcgccgtgagcttcaagtgcagatgccagatcctgagaagactgaccaaggacgagagcccctacaccaagagcgccagccagaccaagccccccgacggcgccctggccgtgagaagacagagcatccccgaggagttcaagggcagcaccgtggtggagctgatgaagaaggagggcaccaccctgggcctgaccgtgagcggcggcatcgacaaggacggcaagcccagagtgagcaacctgagacagggcggcatcgccgccagaagcgaccagctggacgtgggcgactacatcaaggccgtgaacggcatcaacctggccaagttcagacacgacgagatcatcagcctgctgaagaacgtgggcgagagagtggtgctggaggtggagtacgagctgccccccgtgagcgtgcagggcagcagcgtgatcttcagaaccgtggaggtgaccctgcacaaggagggcaacaccttcggcttcgtgatcagaggcggcgcccacgacgacagaaacaagagcagacccgtggtgatcacctgcgtgagacccggcggccccgccgacagagagggcaccatcaagcccggcgacagactgctgagcgtggacggcatcagactgctgggcaccacccacgccgaggccatgagcatcctgaagcagtgcggccaggaggccgccctgctgatcgagtacgacgtgagcgtgatggacagcgtggccaccgccagcggccccctgctggtggaggtggccaagacccccggcgccagcctgggcgtggccctgaccaccagcatgtgctgcaacaagcaggtgatcgtgatcgacaagatcaagagcgccagcatcgccgacagatgcggcgccctgcacgtgggcgaccacatcctgagcatcgacggcaccagcatggagtactgcaccctggccgaggccacccagttcctggccaacaccaccgaccaggtgaagctggagatcctgccccaccaccagaccagactggccctgaagggccccgaccacgccgccctggtgagcagcagcttcagccccaccagcatgagcgcctacagcctgagcagcctgaacatgggcaccctgcccagaagcctgtacagcaccagccccagaggcaccatgatgagaagaagactgaagaagaaggacttcaagagcagcctgagcctggccagcagcaccgtgggcctggccggccaggtggtgcacaccgagaccaccgaggtggtgctgaccgccgaccccgtgaccggcttcggcatccagctgcagggcagcgtgttcgccaccgagaccctgagcagcccccccctgatcagctacatcgaggccgacagccccgccgagagatgcggcgtgctgcagatcggcgacagagtgatggccatcaacggcatccccaccgaggacagcaccttcgaggaggccagccagctgctgagagacagcagcatcaccagcaaggtgaccctggagatcgagttcgacgtggccgagagcgtgatccccagcagcggcaccttccacgtgaagctgcccaagaagcacaacgtggagctgggcatcaccatcagcagccccagcagcagaaagcccggcgaccccctggtgatcagcgacatcaagaagggcagcgtggcccacagaaccggcaccctggagctgggcgacaagctgctggccatcgacaacatcagactggacaactgcagcatggaggacgccgtgcagatcctgcagcagtgcgaggacctggtgaagctgaagatcagaaaggacgaggacaacagcgacgagcaggagagcagcggcgccatcatctacaccgtggagctgaagagatacggcggccccctgggcatcaccatcagcggcaccgaggagcccttcgaccccatcatcatcagcagcctgaccaagggcggcctggccgagagaaccggcgccatccacatcggcgacagaatcctggccatcaacagcagcagcctgaagggcaagcccctgagcgaggccatccacctgctgcagatggccggcgagaccgtgaccctgaagatcaagaagcagaccgacgcccagagcgccagcagccccaagaagttccccatcagcagccacctgagcgacctgggcgacgtggaggaggacagcagccccgcccagaagcccggcaagctgagcgacatgtaccccagcaccgtgcccagcgtggacagcgccgtggacagctgggacggcagcgccatcgacaccagctacggcacccagggcaccagcttccaggccagcggctacaacttcaacacctacgactggagaagccccaagcagagaggcagcctgagccccgtgaccaagcccagaagccagacctaccccgacgtgggcctgagctacgaggactgggacagaagcaccgccagcggcttcgccggcgccgccgacagcgccgagaccgagcaggaggagaacttctggagccaggccctggaggacctggagacctgcggccagagcggcatcctgagagagctggaggagaaggccgacagaagagtgagcctgagaaacatgaccctgctggccaccatcatgagcggcagcaccatgagcctgaaccacgaggcccccacccccagaagccagctgggcagacaggccagcttccaggagagaagcagcagcagaccccactacagccagaccaccagaagcaacaccctgcccagcgacgtgggcagaaagagcgtgaccctgagaaagatgaagcaggagatcaaggagatcatgagccccacccccgtggagctgcacaaggtgaccctgtacaaggacagcgacatggaggacttcggcttcagcgtggccgacggcctgctggagaagggcgtgtacgtgaagaacatcagacccgccggccccggcgacctgggcggcctgaagccctacgacagactgctgcaggtgaaccacgtgagaaccagagacttcgactgctgcctggtggtgcccctgatcgccgagagcggcaacaagctggacctggtgatcagcagaaaccccctggccagccagaagagcatcgaccagcagagcctgcccggcgactggagcgagcagaacagcgccttcttccagcagcccagccacggcggcaacctggagaccagagagcccaccaacaccctgtag

SEQ ID NO: 83096 - DNA, 2511 bp, Artificial Sequence
  Description of Artificial Sequence: Synthetic coding sequence
atggtgcagttcagcaccagcgagttcagactgaccccccacatcgacaacctggaggtggccaacagcttcgccgtgaccaacgccttctgcagccagttcagcagaggcgtgtacgccatcttcggcttctacgacaagaagagcgtgaacaccatcaccagcttctgcggcaccctgcacgtgagcttcatcacccccagcttccccaccgacggcacccaccccttcgtgatccagatgagacccgacctgaagggcgccctgctgagcctgatcgagtactaccagtgggacaagttcgcctacctgtacgacagcgacagaggcctgagcaccctgcaggccgtgctggacagcgccgccgagaagaagtggcaggtgaccgccatcaacgtgggcaacatcaacaacgacaagaaggacgagatgtacagaagcctgttccaggacctggagctgaagaaggagagaagagtgatcctggactgcgagagagacaaggtgaacgacatcgtggaccaggtgatcaccatcggcaagcacgtgaagggctaccactacatcatcgccaacctgggcttcaccgacggcgacctgctgaagatccagttcggcggcgccaacgtgagcggcttccagatcgtggactacgacgacagcctggtgagcaagttcatcgagagatggagcaccctggaggagaaggagtaccccggcgcccacaccaccaccatcaagtacaccagcgccctgacctacgacgccgtgcaggtgatgaccgaggccttcagaaacctgagaaagcagagaatcgagatcagcagaagaggcaacgccggcgactgcctggccaaccccgccgtgccctggggccagggcgtggagatcgagagagccctgaagcaggtgcaggtggagggcctgagcggcaacatcaagttcgaccagaacggcaagagaatcaactacaccatcaacatcatggagctgaagaccaacggccccagaaagatcggctactggagcgaggtggacaagatggtggtgaccctgaccgagctgcccagcggcaacgacaccagcggcctggagaacaagaccgtggtggtgaccaccatcctggagagcccctacgtgatgatgaagaagaaccacgagatgctggagggcaacgagagatacgagggctactgcgtggacctggccgccgagatcgccaagcactgcggcttcaagtacaagctgaccatcgtgggcgacggcaagtacggcgccagagacgccgacaccaagatctggaacggcatggtgggcgagctggtgtacggcaaggccgacatcgccatcgcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacaccgaggagttcgaggacggcagagagacccagagcagcgagagcaccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctgagcaagcagaccgagatcgcctacggcaccctggacagcggcagcaccaaggagttcttcagaagaagcaagatcgccgtgttcgacaagatgtggacctacatgagaagcgccgagcccagcgtgttcgtgagaaccaccgccgagggcgtggccagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcagcctgagaacccccgtgaacctggccgtgctgaagctgagcgagcagggcgtgctggacaagctgaagaacaagtggtggtacgacaagggcgagtgcggcgccaaggacagcggcagcaaggagaagaccagcgccctgagcctgagcaacgtggccggcgtgttctacatcctggtgggcggcctgggcctggccatgctggtggccctgatcgagttctgctacaagagcagagccgaggccaagagaatgaaggtggccaagaacgcccagaacatcaaccccagcagcagccagaacagccagaacttcgccacctacaaggagggctacaacgtgtacggcatcgagagcgtgaagatctag

SEQ ID NO: 83097 - DNA, 2706 bp, Artificial Sequence
  Description of Artificial Sequence: Synthetic coding sequence
atgagcaccatgagactgctgaccctggccctgctgttcagctgcagcgtggccagagccgcctgcgaccccaagatcgtgaacatcggcgccgtgctgagcaccagaaagcacgagcagatgttcagagaggccgtgaaccaggccaacaagagacacggcagctggaagatccagctgaacgccaccagcgtgacccacaagcccaacgccatccagatggccctgagcgtgtgcgaggacctgatcagcagccaggtgtacgccatcctggtgagccacccccccacccccaacgaccacttcacccccacccccgtgagctacaccgccggcttctacagaatccccgtgctgggcctgaccaccagaatgagcatctacagcgacaagagcatccacctgagcttcctgagaaccgtgcccccctacagccaccagagcagcgtgtggttcgagatgatgagagtgtacagctggaaccacatcatcctgctggtgagcgacgaccacgagggcagagccgcccagaagagactggagaccctgctggaggagagagagagcaaggccgagaaggtgctgcagttcgaccccggcaccaagaacgtgaccgccctgctgatggaggccaaggagctggaggccagagtgatcatcctgagcgccagcgaggacgacgccgccaccgtgtacagagccgccgccatgctgaacatgaccggcagcggctacgtgtggctggtgggcgagagagagatcagcggcaacgccctgagatacgcccccgacggcatcctgggcctgcagctgatcaacggcaagaacgagagcgcccacatcagcgacgccgtgggcgtggtggcccaggccgtgcacgagctgctggagaaggagaacatcaccgacccccccagaggctgcgtgggcaacaccaacatctggaagaccggccccctgttcaagagagtgctgatgagcagcaagtacgccgacggcgtgaccggcagagtggagttcaacgaggacggcgacagaaagttcgccaactacagcatcatgaacctgcagaacagaaagctggtgcaggtgggcatctacaacggcacccacgtgatccccaacgacagaaagatcatctggcccggcggcgagaccgagaagcccagaggctaccagatgagcaccagactgaagatcgtgaccatccaccaggagcccttcgtgtacgtgaagcccaccctgagcgacggcacctgcaaggaggagttcaccgtgaacggcgaccccgtgaagaaggtgatctgcaccggccccaacgacaccagccccggcagccccagacacaccgtgccccagtgctgctacggcttctgcatcgacctgctgatcaagctggccagaaccatgaacttcacctacgaggtgcacctggtggccgacggcaagttcggcacccaggagagagtgaacaacagcaacaagaaggagtggaacggcatgatgggcgagctgctgagcggccaggccgacatgatcgtggcccccctgaccatcaacaacgagagagcccagtacatcgagttcagcaagcccttcaagtaccagggcctgaccatcctggtgaagaaggagatccccagaagcaccctggacagcttcatgcagcccttccagagcaccctgtggctgctggtgggcctgagcgtgcacgtggtggccgtgatgctgtacctgctggacagattcagccccttcggcagattcaaggtgaacagcgaggaggaggaggaggacgccctgaccctgagcagcgccatgtggttcagctggggcgtgctgctgaacagcggcatcggcgagggcgcccccagaagcttcagcgccagaatcctgggcatggtgtgggccggcttcgccatgatcatcgtggccagctacaccgccaacctggccgccttcctggtgctggacagacccgaggagagaatcaccggcatcaacgaccccagactgagaaaccccagcgacaagttcatctacgccaccgtgaagcagagcagcgtggacatctacttcagaagacaggtggagctgagcaccatgtacagacacatggagaagcacaactacgagagcgccgccgaggccatccaggccgtgagagacaacaagctgcacgccttcatctgggacagcgccgtgctggagttcgaggccagccagaagtgcgacctggtgaccaccggcgagctgttcttcagaagcggcttcggcatcggcatgagaaaggacagcccctggaagcagaacgtgagcctgagcatcctgaagagccacgagaacggcttcatggaggacctggacaagacctgggtgagataccaggagtgcgacagcagaagcaacgcccccgccaccctgaccttcgagaacatggccggcgtgttcatgctggtggccggcggcatcgtggccggcatcttcctgatcttcatcgagatcgcctacaagagacacaaggacgccagaagaaagcagatgcagctggccttcgccgccgtgaacgtgtggagaaagaacctgcagagcaccggcggcggcagaggcgccctgcagaaccagaaggacaccgtgctgcccagaagagccatcgagagagaggagggccagctgcagctgtgcagcagacacagagagagctag

SEQ ID NO: 83098 - DNA, 2658 bp, Artificial Sequence
  Description of Artificial Sequence: Synthetic coding sequence
atgagcaccatgagactgctgaccctggccctgctgttcagctgcagcgtggccagagccgcctgcgaccccaagatcgtgaacatcggcgccgtgctgagcaccagaaagcacgagcagatgttcagagaggccgtgaaccaggccaacaagagacacggcagctggaagatccagctgaacgccaccagcgtgacccacaagcccaacgccatccagatggccctgagcgtgtgcgaggacctgatcagcagccaggtgtacgccatcctggtgagccacccccccacccccaacgaccacttcacccccacccccgtgagctacaccgccggcttctacagaatccccgtgctgggcctgaccaccagaatgagcatctacagcgacaagagcatccacctgagcttcctgagaaccgtgcccccctacagccaccagagcagcgtgtggttcgagatgatgagagtgtacagctggaaccacatcatcctgctggtgagcgacgaccacgagggcagagccgcccagaagagactggagaccctgctggaggagagagagagcaaggccgagaaggtgctgcagttcgaccccggcaccaagaacgtgaccgccctgctgatggaggccaaggagctggaggccagagtgatcatcctgagcgccagcgaggacgacgccgccaccgtgtacagagccgccgccatgctgaacatgaccggcagcggctacgtgtggctggtgggcgagagagagatcagcggcaacgccctgagatacgcccccgacggcatcctgggcctgcagctgatcaacggcaagaacgagagcgcccacatcagcgacgccgtgggcgtggtggcccaggccgtgcacgagctgctggagaaggagaacatcaccgacccccccagaggctgcgtgggcaacaccaacatctggaagaccggccccctgttcaagagagtgctgatgagcagcaagtacgccgacggcgtgaccggcagagtggagttcaacgaggacggcgacagaaagttcgccaactacagcatcatgaacctgcagaacagaaagctggtgcaggtgggcatctacaacggcacccacgtgatccccaacgacagaaagatcatctggcccggcggcgagaccgagaagcccagaggctaccagatgagcaccagactgaagatcgtgaccatccaccaggagcccttcgtgtacgtgaagcccaccctgagcgacggcacctgcaaggaggagttcaccgtgaacggcgaccccgtgaagaaggtgatctgcaccggccccaacgacaccagccccggcagccccagacacaccgtgccccagtgctgctacggcttctgcatcgacctgctgatcaagctggccagaaccatgaacttcacctacgaggtgcacctggtggccgacggcaagttcggcacccaggagagagtgaacaacagcaacaagaaggagtggaacggcatgatgggcgagctgctgagcggccaggccgacatgatcgtggcccccctgaccatcaacaacgagagagcccagtacatcgagttcagcaagcccttcaagtaccagggcctgaccatcctggtgaagaaggagatccccagaagcaccctggacagcttcatgcagcccttccagagcaccctgtggctgctggtgggcctgagcgtgcacgtggtggccgtgatgctgtacctgctggacagattcagccccttcggcagattcaaggtgaacagcgaggaggaggaggaggacgccctgaccctgagcagcgccatgtggttcagctggggcgtgctgctgaacagcggcatcggcgagggcgcccccagaagcttcagcgccagaatcctgggcatggtgtgggccggcttcgccatgatcatcgtggccagctacaccgccaacctggccgccttcctggtgctggacagacccgaggagagaatcaccggcatcaacgaccccagactgagaaaccccagcgacaagttcatctacgccaccgtgaagcagagcagcgtggacatctacttcagaagacaggtggagctgagcaccatgtacagacacatggagaagcacaactacgagagcgccgccgaggccatccaggccgtgagagacaacaagctgcacgccttcatctgggacagcgccgtgctggagttcgaggccagccagaagtgcgacctggtgaccaccggcgagctgttcttcagaagcggcttcggcatcggcatgagaaaggacagcccctggaagcagaacgtgagcctgagcatcctgaagagccacgagaacggcttcatggaggacctggacaagacctgggtgagataccaggagtgcgacagcagaagcaacgcccccgccaccctgaccttcgagaacatggccggcgtgttcatgctggtggccggcggcatcgtggccggcatcttcctgatcttcatcgagatcgcctacaagagacacaaggacgccagaagaaagcagatgcagctggccttcgccgccgtgaacgtgtggagaaagaacctgcagcagtaccaccccaccgacatcaccggccccctgaacctgagcgaccccagcgtgagcaccgtggtgtag

SEQ ID NO: 83099 - DNA, 2769 bp, Artificial Sequence
  Description of Artificial Sequence: Synthetic coding sequence
atggtgcagctgagaaagctgctgagagtgctgaccctgatgaagttcccctgctgcgtgctggaggtgctgctgtgcgccctggccgccgccgccagaggccaggagatgtacgccccccacagcatcagaatcgagggcgacgtgaccctgggcggcctgttccccgtgcacgccaagggccccagcggcgtgccctgcggcgacatcaagagagagaacggcatccacagactggaggccatgctgtacgccctggaccagatcaacagcgaccccaacctgctgcccaacgtgaccctgggcgccagaatcctggacacctgcagcagagacacctacgccctggagcagagcctgaccttcgtgcaggccctgatccagaaggacaccagcgacgtgagatgcaccaacggcgagccccccgtgttcgtgaagcccgagaaggtggtgggcgtgatcggcgccagcggcagcagcgtgagcatcatggtggccaacatcctgagactgttccagatcccccagatcagctacgccagcaccgcccccgagctgagcgacgacagaagatacgacttcttcagcagagtggtgccccccgacagcttccaggcccaggccatggtggacatcgtgaaggccctgggctggaactacgtgagcaccctggccagcgagggcagctacggcgagaagggcgtggagagcttcacccagatcagcaaggaggccggcggcctgtgcatcgcccagagcgtgagaatcccccaggagagaaaggacagaaccatcgacttcgacagaatcatcaagcagctgctggacacccccaacagcagagccgtggtgatcttcgccaacgacgaggacatcaagcagatcctggccgccgccaagagagccgaccaggtgggccacttcctgtgggtgggcagcgacagctggggcagcaagatcaaccccctgcaccagcacgaggacatcgccgagggcgccatcaccatccagcccaagagagccaccgtggagggcttcgacgcctacttcaccagcagaaccctggagaacaacagaagaaacgtgtggttcgccgagtactgggaggagaacttcaactgcaagctgaccatcagcggcagcaagaaggaggacaccgacagaaagtgcaccggccaggagagaatcggcaaggacagcaactacgagcaggagggcaaggtgcagttcgtgatcgacgccgtgtacgccatggcccacgccctgcaccacatgaacaaggacctgtgcgccgactacagaggcgtgtgccccgagatggagcaggccggcggcaagaagctgctgaagtacatcagaaacgtgaacttcaacggcagcgccggcacccccgtgatgttcaacaagaacggcgacgcccccggcagatacgacatcttccagtaccagaccaccaacaccagcaaccccggctacagactgatcggccagtggaccgacgagctgcagctgaacatcgaggacatgcagtggggcaagggcgtgagagagatccccgccagcgtgtgcaccctgccctgcaagcccggccagagaaagaagacccagaagggcaccccctgctgctggacctgcgagccctgcgacggctaccagtaccagttcgacgagatgacctgccagcactgcccctacgaccagagacccaacgagaacagaaccggctgccaggacatccccatcatcaagctggagtggcacagcccctgggccgtgatccccgtgttcctggccatgctgggcatcatcgccaccatcttcgtgatggccaccttcatcagatacaacgacacccccatcgtgagagccagcggcagagagctgagctacgtgctgctgaccggcatcttcctgtgctacatcatcaccttcctgatgatcgccaagcccgacgtggccgtgtgcagcttcagaagagtgttcctgggcctgggcatgtgcatcagctacgccgccctgctgaccaagaccaacagaatctacagaatcttcgagcagggcaagaagagcgtgaccgcccccagactgatcagccccaccagccagctggccatcaccagcagcctgatcagcgtgcagctgctgggcgtgttcatctggttcggcgtggacccccccaacatcatcatcgactacgacgagcacaagaccatgaaccccgagcaggccagaggcgtgctgaagtgcgacatcaccgacctgcagatcatctgcagcctgggctacagcatcctgctgatggtgacctgcaccgtgtacgccatcaagaccagaggcgtgcccgagaacttcaacgaggccaagcccatcggcttcaccatgtacaccacctgcatcgtgtggctggccttcatccccatcttcttcggcaccgcccagagcgccgagaagctgtacatccagaccaccaccctgaccatcagcatgaacctgagcgccagcgtggccctgggcatgctgtacatgcccaaggtgtacatcatcatcttccaccccgagctgaacgtgcagaagagaaagagaagcttcaaggccgtggtgaccgccgccaccatgagcagcagactgagccacaagcccagcgacagacccaacggcgaggccaagaccgagctgtgcgagaacgtggaccccaacaactgcatcccccccgtgagaaagagcgtgcagaagagcgtgacctggtacaccatcccccccaccgtgtag

SEQ ID NO: 83100 - DNA, 2685 bp, Artificial Sequence
  Description of Artificial Sequence: Synthetic coding sequence
atggccagacagaagaagatgggccagagcgtgctgagagccgtgttcttcctggtgctgggcctgctgggccacagccacggcggcttccccaacaccatcagcatcggcggcctgttcatgagaaacaccgtgcaggagcacagcgccttcagattcgccgtgcagctgtacaacaccaaccagaacaccaccgagaagcccttccacctgaactaccacgtggaccacctggacagcagcaacagcttcagcgtgaccaacgccttctgcagccagttcagcagaggcgtgtacgccatcttcggcttctacgaccagatgagcatgaacaccctgaccagcttctgcggcgccctgcacaccagcttcgtgacccccagcttccccaccgacgccgacgtgcagttcgtgatccagatgagacccgccctgaagggcgccatcctgagcctgctgggccactacaagtgggagaagttcgtgtacctgtacgacaccgagagaggcttcagcatcctgcaggccatcatggaggccgccgtgcagaacaactggcaggtgaccgccagaagcgtgggcaacatcaaggacgtgcaggagttcagaagaatcatcgaggagatggacagaagacaggagaagagatacctgatcgactgcgaggtggagagaatcaacaccatcctggagcaggtggtgatcctgggcaagcacagcagaggctaccactacatgctggccaacctgggcttcaccgacatcctgctggagagagtgatgcacggcggcgccaacatcaccggcttccagatcgtgaacaacgagaaccccatggtgcagcagttcatccagagatgggtgagactggacgagagagagttccccgaggccaagaacgcccccctgaagtacaccagcgccctgacccacgacgccatcctggtgatcgccgaggccttcagatacctgagaagacagagagtggacgtgagcagaagaggcagcgccggcgactgcctggccaaccccgccgtgccctggagccagggcatcgacatcgagagagccctgaagatggtgcaggtgcagggcatgaccggcaacatccagttcgacacctacggcagaagaaccaactacaccatcgacgtgtacgagatgaaggtgagcggcagcagaaaggccggctactggaacgagtacgagagattcgtgcccttcagcgaccagcagatcagcaacgacagcgccagcagcgagaacagaaccatcgtggtgaccaccatcctggagagcccctacgtgatgtacaagaagaaccacgagcagctggagggcaacgagagatacgagggctactgcgtggacctggcctacgagatcgccaagcacgtgagaatcaagtacaagctgagcatcgtgggcgacggcaagtacggcgccagagaccccgagaccaagatctggaacggcatggtgggcgagctggtgtacggcagagccgacatcgccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacctggaggacaacaacgaggagcccagagacccccagagcccccccgacccccccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggacagcggcagcaccaaggagttcttcagaagaagcaagatcgccgtgtacgagaagatgtggagctacatgaagagcgccgagcccagcgtgttcaccaagaccaccgccgacggcgtggccagagtgagaaagagcaagggcaagttcgccttcctgctggagagcaccatgaacgagtacatcgagcagagaaagccctgcgacaccatgaaggtgggcggcaacctggacagcaagggctacggcgtggccacccccaagggcagcgccctgagaaacgccgtgaacctggccgtgctgaagctgaacgagcagggcctgctggacaagctgaagaacaagtggtggtacgacaagggcgagtgcggcagcggcggcggcgacagcaaggacaagaccagcgccctgagcctgagcaacgtggccggcgtgttctacatcctggtgggcggcctgggcctggccatgatggtggccctgatcgagttctgctacaagagcagagccgagagcaagagaatgaagctgaccaagaacacccagaacttcaagcccgcccccgccaccaacacccagaactacgccacctacagagagggctacaacgtgtacggcaccgagagcgtgaagatctag

SEQ ID NO: 83101 - DNA, 432 bp, Artificial Sequence
  Description of Artificial Sequence: Synthetic coding sequence
atggccagacagaagaagatgggccagagcgtgctgagagccgtgttcttcctggtgctgggcctgctgggccacagccacggcggcttccccaacaccatcagcatcggcggcctgttcatgagaaacaccgtgcaggagcacagcgccttcagattcgccgtgcagctgtacaacaccaaccagaacaccaccgagaagcccttccacctgaactaccacgtggaccacctggacagcagcaacagcttcagcgtgaccaacgcctgccccgccgagagagactacctgccctggcccggcagcatcagagagaacaactggaccgccctgccctgctgcaaggaccacggcctgctgcacctgaagtgcagccccggcggcagacagaactgggcctactgcatctggggcgtgaccggcgagctgtag

SEQ ID NO: 83102 - DNA, 2685 bp, Artificial Sequence; identical to SEQ ID NO: 83100
  Description of Artificial Sequence: Synthetic coding sequence

SEQ ID NO: 83103 - DNA, 2685 bp, Artificial Sequence
  Description of Artificial Sequence: Synthetic coding sequence
atggccagacagaagaagatgggccagagcgtgctgagagccgtgttcttcctggtgctgggcctgctgggccacagccacggcggcttccccaacaccatcagcatcggcggcctgttcatgagaaacaccgtgcaggagcacagcgccttcagattcgccgtgcagctgtacaacaccaaccagaacaccaccgagaagcccttccacctgaactaccacgtggaccacctggacagcagcaacagcttcagcgtgaccaacgccttctgcagccagttcagcagaggcgtgtacgccatcttcggcttctacgaccagatgagcatgaacaccctgaccagcttctgcggcgccctgcacaccagcttcgtgacccccagcttccccaccgacgccgacgtgcagttcgtgatccagatgagacccgccctgaagggcgccatcctgagcctgctgggccactacaagtgggagaagttcgtgtacctgtacgacaccgagagaggcttcagcatcctgcaggccatcatggaggccgccgtgcagaacaactggcaggtgaccgccagaagcgtgggcaacatcaaggacgtgcaggagttcagaagaatcatcgaggagatggacagaagacaggagaagagatacctgatcgactgcgaggtggagagaatcaacaccatcctggagcaggtggtgatcctgggcaagcacagcagaggctaccactacatgctggccaacctgggcttcaccgacatcctgctggagagagtgatgcacggcggcgccaacatcaccggcttccagatcgtgaacaacgagaaccccatggtgcagcagttcatccagagatgggtgagactggacgagagagagttccccgaggccaagaacgcccccctgaagtacaccagcgccctgacccacgacgccatcctggtgatcgccgaggccttcagatacctgagaagacagagagtggacgtgagcagaagaggcagcgccggcgactgcctggccaaccccgccgtgccctggagccagggcatcgacatcgagagagccctgaagatggtgcaggtgcagggcatgaccggcaacatccagttcgacacctacggcagaagaaccaactacaccatcgacgtgtacgagatgaaggtgagcggcagcagaaaggccggctactggaacgagtacgagagattcgtgcccttcagcgaccagcagatcagcaacgacagcgccagcagcgagaacagaaccatcgtggtgaccaccatcctggagagcccctacgtgatgtacaagaagaaccacgagcagctggagggcaacgagagatacgagggctactgcgtggacctggcctacgagatcgccaagcacgtgagaatcaagtacaagctgagcatcgtgggcgacggcaagtacggcgccagagaccccgagaccaagatctggaacggcatggtgggcgagctggtgtacggcagagccgacatcgccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacctggaggacaacaacgaggagcccagagacccccagagcccccccgacccccccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggacagcggcagcaccaaggagttcttcagaagaagcaagatcgccgtgtacgagaagatgtggagctacatgaagagcgccgagcccagcgtgttcaccaagaccaccgccgacggcgtggccagagtgagaaagagcaagggcaagttcgccttcctgctggagagcaccatgaacgagtacatcgagcagagaaagccctgcgacaccatgaaggtgggcggcaacctggacagcaagggctacggcgtggccacccccaagggcagcgccctgagaacccccgtgaacctggccgtgctgaagctgagcgagcagggcatcctggacaagctgaagaacaagtggtggtacgacaagggcgagtgcggcgccaaggacagcggcagcaaggacaagaccagcgccctgagcctgagcaacgtggccggcgtgttctacatcctggtgggcggcctgggcctggccatgatggtggccctgatcgagttctgctacaagagcagagccgagagcaagagaatgaagctgaccaagaacacccagaacttcaagcccgcccccgccaccaacacccagaactacgccacctacagagagggctacaacgtgtacggcaccgagagcgtgaagatctag

SEQ ID NO: 83104 - DNA, 495 bp, Artificial Sequence
  Description of Artificial Sequence: Synthetic coding sequence
atggccagacagaagaagatgggccagagcgtgctgagagccgtgttcttcctggtgctgggcctgctgggccacagccacggcggcttccccaacaccatcagcatcggcggcctgttcatgagaaacaccgtgcaggagcacagcgccttcagattcgccgtgcagctgtacaacaccaaccagaacaccaccgagaagcccttccacctgaactaccacgtggaccacctggacagcagcaacagcttcagcgtgaccaacgcctgccccgccgagagagactacctgccctggcccggcagcatcagagagaacaactggaccgccctgccctgctgcaaggaccacggcctgctgcacctgaagtgcagccccggcggccccgccaagaccggccccatcgtgagcggcgccctgcaggtgaactgcaagatgagaaccagaagccaggtgagcaccaccagcagcctgctggagttcagcaccgagtag

SEQ ID NO: 83105 - DNA, 495 bp, Artificial Sequence; identical to SEQ ID NO: 83104
  Description of Artificial Sequence: Synthetic coding sequence

SEQ ID NO: 83106 - DNA, 1989 bp, Artificial Sequence
  Description of Artificial Sequence: Synthetic coding sequence
atgctgcagggcggcgaggagagcagactgttcggcagcctgctgtggaccctgccctggagaggcctgttcatgagaaacaccgtgcaggagcacagcgccttcagattcgccgtgcagctgtacaacaccaaccagaacaccaccgagaagcccttccacctgaactaccacgtggaccacctggacagcagcaacagcttcagcgtgaccaacgccttctgcagccagttcagcagaggcgtgtacgccatcttcggcttctacgaccagatgagcatgaacaccctgaccagcttctgcggcgccctgcacaccagcttcgtgacccccagcttccccaccgacgccgacgtgcagttcgtgatccagatgagacccgccctgaagggcgccatcctgagcctgctgggccactacaagtgggagaagttcgtgtacctgtacgacaccgagagaggcttcagcatcctgcaggccatcatggaggccgccgtgcagaacaactggcaggtgaccgccagaagcgtgggcaacatcaaggacgtgcaggagttcagaagaatcatcgaggagatggacagaagacaggagaagagatacctgatcgactgcgaggtggagagaatcaacaccatcctggagcaggtggtgatcctgggcaagcacagcagaggctaccactacatgctggccaacctgggcttcaccgacatcctgctggagagagtgatgcacggcggcgccaacatcaccggcttccagatcgtgaacaacgagaaccccatggtgcagcagttcatccagagatgggtgagactggacgagagagagttccccgaggccaagaacgcccccctgaagtacaccagcgccctgacccacgacgccatcctggtgatcgccgaggccttcagatacctgagaagacagagagtggacgtgagcagaagaggcagcgccggcgactgcctggccaaccccgccgtgccctggagccagggcatcgacatcgagagagccctgaagatggtgcaggtgcagggcatgaccggcaacatccagttcgacacctacggcagaagaaccaactacaccatcgacgtgtacgagatgaaggtgagcggcagcagaaaggccggctactggaacgagtacgagagattcgtgcccttcagcgaccagcagatcagcaacgacagcgccagcagcgagaacagaaccatcgtggtgaccaccatcctggagagcccctacgtgatgtacaagaagaaccacgagcagctggagggcaacgagagatacgagggctactgcgtggacctggcctacgagatcgccaagcacgtgagaatcaagtacaagctgagcatcgtgggcgacggcaagtacggcgccagagaccccgagaccaagatctggaacggcatggtgggcgagctggtgtacggcagagccgacatcgccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacctggaggacaacaacgaggagcccagagacccccagagcccccccgacccccccaacgagttcggcatcttcaacagcctgtggttcagcctgggcgccttcatgcagcagggctgcgacatcagccccagattcgtgttcgtggcctacagcatgccccactgcatcctgtggagctacagcatccacgtgcacatggtgttcatccacctgaacagcagattcttcagcttcaacatccccagcaacgacagactgagcagcagccactgcgtgtgcctgtgcccctag

SEQ ID NO: 83107 - DNA, 2475 bp, Artificial Sequence
  Description of Artificial Sequence: Synthetic coding sequence
atggccagacagaagaagatgggccagagcgtgctgagagccgtgttcttcctggtgctgggcctgctgggccacagccacggcggcttccccaacaccatcagcatcggcggcctgttcatgagaaacaccgtgcaggagcacagcgccttcagattcgccgtgcagctgtacaacaccaaccagaacaccaccgagaagcccttccacctgaactaccacgtggaccacctggacagcagcaacagcttcagcgtgaccaacgccttctgcagccagttcagcagaggcgtgtacgccatcttcggcttctacgaccagatgagcatgaacaccctgaccagcttctgcggcgccctgcacaccagcttcgtgacccccagcttccccaccgacgccgacgtgcagttcgtgatccagatgagacccgccctgaagggcgccatcctgagcctgctgggccactacaagtgggagaagttcgtgtacctgtacgacaccgagagaggcttcagcatcctgcaggccatcatggaggccgccgtgcagaacaactggcaggtgaccgccagaagcgtgggcaacatcaaggacgtgcaggagttcagaagaatcatcgaggagatggacagaagacaggagaagagatacctgatcgactgcgaggtggagagaatcaacaccatcctggagcaggtggtgatcctgggcaagcacagcagaggctaccactacatgctggccaacctgggcttcaccgacatcctgctggagagagtgatgcacggcggcgccaacatcaccggcttccagatcgtgaacaacgagaaccccatggtgcagcagttcatccagagatgggtgagactggacgagagagagttccccgaggccaagaacgcccccctgaagtacaccagcgccctgacccacgacgccatcctggtgatcgccgaggccttcagatacctgagaagacagagagtggacgtgagcagaagaggcagcgccggcgactgcctggccaaccccgccgtgccctggagccagggcatcgacatcgagagagccctgaagatggtgcaggtgcagggcatgaccggcaacatccagttcgacacctacggcagaagaaccaactacaccatcgacgtgtacgagatgaaggtgagcggcagcagaaaggccggctactggaacgagtacgagagattcgtgcccttcagcgaccagcagatcagcaacgacagcgccagcagcgagaacagaaccatcgtggtgaccaccatcctggagagcccctacgtgatgtacaagaagaaccacgagcagctggagggcaacgagagatacgagggctactgcgtggacctggcctacgagatcgccaagcacgtgagaatcaagtacaagctgagcatcgtgggcgacggcaagtacggcgccagagaccccgagaccaagatctggaacggcatggtgggcgagctggtgtacggcagagccgacatcgccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacctggaggacaacaacgaggagcccagagacccccagagcccccccgacccccccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggacagcggcagcaccaaggagttcttcagaagaagcaagatcgccgtgtacgagaagatgtggagctacatgaagagcgccgagcccagcgtgttcaccaagaccaccgccgacggcgtggccagagtgagaaagagcaagggcaagttcgccttcctgctggagagcaccatgaacgagtacatcgagcagagaaagccctgcgacaccatgaaggtgggcggcaacctggacagcaagggctacggcgtggccacccccaagggcagcgccctgagaaacgccgtgaacctggccgtgctgaagctgaacgagcagggcctgctggacaagctgaagaacaagtggtggtacgacaagggcgagtgcggcagcggcggcggcgacagcaagaacgcctgcaagccctgcagcatcgagacccagtag

SEQ ID NO: 83108 - DNA, 2709 bp, Artificial Sequence
  Description of Artificial Sequence: Synthetic coding sequence
atgagaatcatcagcagacagatcgtgctgctgttcagcggcttctggggcctggccatgggcgccttccccagcagcgtgcagatcggcggcctgttcatcagaaacaccgaccaggagtacaccgccttcagactggccatcttcctgcacaacaccagccccaacgccagcgaggcccccttcaacctggtgccccacgtggacaacatcgagaccgccaacagcttcgccgtgaccaacgccttctgcagccagtacagcagaggcgtgttcgccatcttcggcctgtacgacaagagaagcgtgcacaccctgaccagcttctgcagcgccctgcacatcagcctgatcacccccagcttccccaccgagggcgagagccagttcgtgctgcagctgagacccagcctgagaggcgccctgctgagcctgctggaccactacgagtggaactgcttcgtgttcctgtacgacaccgacagaggctacagcatcctgcaggccatcatggagaaggccggccagaacggctggcacgtgagcgccatctgcgtggagaacttcaacgacgtgagctacagacagctgctggaggagctggacagaagacaggagaagaagttcgtgatcgactgcgagatcgagagactgcagaacatcctggagcagatcgtgagcgtgggcaagcacgtgaagggctaccactacatcatcgccaacctgggcttcaaggacatcagcctggagagattcatccacggcggcgccaacgtgaccggcttccagctggtggacttcaacacccccatggtgatcaagctgatggacagatggaagaagctggaccagagagagtaccccggcagcgagaccccccccaagtacaccagcgccctgacctacgacggcgtgctggtgatggccgagaccttcagaagcctgagaagacagaagatcgacatcagcagaagaggcaacgccggcgactgcctggccaaccccgccgccccctggggccagggcatcgacatggagagaaccctgaagcaggtgagaatccagggcctgaccggcaacgtgcagttcgaccactacggcagaagagtgaactacaccatggacgtgttcgagctgaagagcaccggccccagaaaggtgggctactggaacgacatggacaagctggtgctgatccaggacgtgcccaccctgggcaacgacaccgccgccatcgagaacagaaccgtggtggtgaccaccatcatggagagcccctacgtgatgtacaagaagaaccacgagatgttcgagggcaacgacaagtacgagggctactgcgtggacctggccagcgagatcgccaagcacatcggcatcaagtacaagatcgccatcgtgcccgacggcaagtacggcgccagagacgccgacaccaagatctggaacggcatggtgggcgagctggtgtacggcaaggccgagatcgccatcgcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacaccgaggagcccgaggacggcaaggagggccccagcgaccagccccccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggacagcggcagcaccaaggagttcttcagaagaagcaagatcgccgtgtacgagaagatgtggacctacatgagaagcgccgagcccagcgtgttcaccagaaccaccgccgagggcgtggccagagtgagaaagagcaagggcaagttcgccttcctgctggagagcaccatgaacgagtacatcgagcagagaaagccctgcgacaccatgaaggtgggcggcaacctggacagcaagggctacggcgtggccacccccaagggcagcagcctgagaacccccgtgaacctggccgtgctgaagctgagcgaggccggcgtgctggacaagctgaagaacaagtggtggtacgacaagggcgagtgcggccccaaggacagcggcagcaaggacaagaccagcgccctgagcctgagcaacgtggccggcgtgttctacatcctggtgggcggcctgggcctggccatgctggtggccctgatcgagttctgctacaagagcagagccgaggccaagagaatgaagctgaccttcagcgaggccatcagaaacaaggccagactgagcatcaccggcagcgtgggcgagaacggcagagtgctgacccccgactgccccaaggccgtgcacaccggcaccgccatcagacagagcagcggcctggccgtgatcgccagcgacctgccctag

SEQ ID NO: 83109 - DNA, 1302 bp, Artificial Sequence
  Description of Artificial Sequence: Synthetic coding sequence
atgagaatcatcagcagacagatcgtgctgctgttcagcggcttctggggcctggccatgggcgccttccccagcagcgtgcagatcggcggcctgttcatcagaaacaccgaccaggagtacaccgccttcagactggccatcttcctgcacaacaccagccccaacgccagcgaggcccccttcaacctggtgccccacgtggacaacatcgagaccgccaacagcttcgccgtgaccaacgccttctgcagccagtacagcagaggcgtgttcgccatcttcggcctgtacgacaagagaagcgtgcacaccctgaccagcttctgcagcgccctgcacatcagcctgatcacccccagcttccccaccgagggcgagagccagttcgtgctgcagctgagacccagcctgagaggcgccctgctgagcctgctggaccactacgagtggaactgcttcgtgttcctgtacgacaccgacagaggctacagcatcctgcaggccatcatggagaaggccggccagaacggctggcacgtgagcgccatctgcgtggagaacttcaacgacgtgagctacagacagctgctggaggagctggacagaagacaggagaagaagttcgtgatcgactgcgagatcgagagactgcagaacatcctggagcagatcgtgagcgtgggcaagcacgtgaagggctaccactacatcatcgccaacctgggcttcaaggacatcagcctggagagattcatccacggcggcgccaacgtgaccggcttccagctggtggacttcaacacccccatggtgatcaagctgatggacagatggaagaagctggaccagagagagtaccccggcagcgagaccccccccaagtacaccagcgccctgacctacgacggcgtgctggtgatggccgagaccttcagaagcctgagaagacagaagatcgacatcagcagaagaggcaacgccggcgactgcctggccaaccccgccgccccctggggccagggcatcgacatggagagaaccctgaagcaggtgagaatccagggcctgaccggcaacgtgcagttcgaccactacggcagaagagtgaactacaccatggacgtgttcgagctgaagagcaccggccccagaaaggtgggctactggaacgacatggacaagctggtgctgatccaggacgtgcccaccctgggcaacgacaccgccgccatcgagaacagaaccgtggtggtgaccaccatcatgcccctgatgaagaaccccatcctgagaaactag

SEQ ID NO: 83110 - DNA, 2655 bp, Artificial Sequence
  Description of Artificial Sequence: Synthetic coding sequence
atgagaatcatcagcagacagatcgtgctgctgttcagcggcttctggggcctggccatgggcgccttccccagcagcgtgcagatcggcggcctgttcatcagaaacaccgaccaggagtacaccgccttcagactggccatcttcctgcacaacaccagccccaacgccagcgaggcccccttcaacctggtgccccacgtggacaacatcgagaccgccaacagcttcgccgtgaccaacgccttctgcagccagtacagcagaggcgtgttcgccatcttcggcctgtacgacaagagaagcgtgcacaccctgaccagcttctgcagcgccctgcacatcagcctgatcacccccagcttccccaccgagggcgagagccagttcgtgctgcagctgagacccagcctgagaggcgccctgctgagcctgctggaccactacgagtggaactgcttcgtgttcctgtacgacaccgacagaggctacagcatcctgcaggccatcatggagaaggccggccagaacggctggcacgtgagcgccatctgcgtggagaacttcaacgacgtgagctacagacagctgctggaggagctggacagaagacaggagaagaagttcgtgatcgactgcgagatcgagagactgcagaacatcctggagcagatcgtgagcgtgggcaagcacgtgaagggctaccactacatcatcgccaacctgggcttcaaggacatcagcctggagagattcatccacggcggcgccaacgtgaccggcttccagctggtggacttcaacacccccatggtgatcaagctgatggacagatggaagaagctggaccagagagagtaccccggcagcgagaccccccccaagtacaccagcgccctgacctacgacggcgtgctggtgatggccgagaccttcagaagcctgagaagacagaagatcgacatcagcagaagaggcaacgccggcgactgcctggccaaccccgccgccccctggggccagggcatcgacatggagagaaccctgaagcaggtgagaatccagggcctgaccggcaacgtgcagttcgaccactacggcagaagagtgaactacaccatggacgtgttcgagctgaagagcaccggccccagaaaggtgggctactggaacgacatggacaagctggtgctgatccaggacgtgcccaccctgggcaacgacaccgccgccatcgagaacagaaccgtggtggtgaccaccatcatggagagcccctacgtgatgtacaagaagaaccacgagatgttcgagggcaacgacaagtacgagggctactgcgtggacctggccagcgagatcgccaagcacatcggcatcaagtacaagatcgccatcgtgcccgacggcaagtacggcgccagagacgccgacaccaagatctggaacggcatggtgggcgagctggtgtacggcaaggccgagatcgccatcgcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacaccgaggagcccgaggacggcaaggagggccccagcgaccagccccccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggacagcggcagcaccaaggagttcttcagaagaagcaagatcgccgtgtacgagaagatgtggacctacatgagaagcgccgagcccagcgtgttcaccagaaccaccgccgagggcgtggccagagtgagaaagagcaagggcaagttcgccttcctgctggagagcaccatgaacgagtacatcgagcagagaaagccctgcgacaccatgaaggtgggcggcaacctggacagcaagggctacggcgtggccacccccaagggcagcagcctgagaaacgccgtgaacctggccgtgctgaagctgaacgagcagggcctgctggacaagctgaagaacaagtggtggtacgacaagggcgagtgcggcagcggcggcggcgacagcaaggacaagaccagcgccctgagcctgagcaacgtggccggcgtgttctacatcctggtgggcggcctgggcctggccatgctggtggccctgatcgagttctgctacaagagcagagccgaggccaagagaatgaaggtggccaagagcgcccagaccttcaaccccaccagcagccagaacacccagaacctggccacctacagagagggctacaacgtgtacggcaccgagagcatcaagatctag

SEQ ID NO: 83111 - DNA, 1302 bp, Artificial Sequence; identical to SEQ ID NO: 83109
  Description of Artificial Sequence: Synthetic coding sequence

SEQ ID NO: 83112 - DNA, 2655 bp, Artificial Sequence; identical to SEQ ID NO: 83110
  Description of Artificial Sequence: Synthetic coding sequence

SEQ ID NO: 83113 - DNA, 249 bp, Artificial Sequence
  Description of Artificial Sequence: Synthetic coding sequence
atgagaatcatcagcagacagatcgtgctgctgttcagcggcttctggggcctggccatgggcgccttccccagcagcgtgcagatcggcggcctgttcatcagaaacaccgaccaggagtacaccgccttcagactggccatcttcctgcacaacaccagccccaacgccagcgaggcccccttcaacctggtgccccacgtggacaacatcgagaccgccaacagcttcgccgtgaccaacgcctag

SEQ ID NO: 83114 - DNA, 249 bp, Artificial Sequence; identical to SEQ ID NO: 83113
  Description of Artificial Sequence: Synthetic coding sequence

SEQ ID NO: 83115 - DNA, 2709 bp, Artificial Sequence; identical to SEQ ID NO: 83108
  Description of Artificial Sequence: Synthetic coding sequence

SEQ ID NO: 83116 - DNA, 360 bp, Artificial Sequence
  Description of Artificial Sequence: Synthetic coding sequence
atgagaagcgccgagcccagcgtgttcaccagaaccaccgccgagggcgtggccagagtgagaaagagcaagggcaagttcgccttcctgctggagagcaccatgaacgagtacatcgagcagagaaagccctgcgacaccatgaaggtgggcggcaacctggacagcaagggctacggcgtggccacccccaagggcagcagcctgagaaacgccgtgaacctggccgtgctgaagctgaacgagcagggcctgctggacaagctgaagaacaagtggtggtacgacaagggcgagtgcggcagcggcggcggcgacagcaagaacagctgcaagccctgcagattcgagacccagtag

SEQ ID NO: 83117 - DNA, 2721 bp, Artificial Sequence
  Description of Artificial Sequence: Synthetic coding sequence
atgcagcacatcttcgccttcttctgcaccggcttcctgggcgccgtggtgggcgccaacttccccaacaacatccagatcggcggcctgttccccaaccagcagagccaggagcacgccgccttcagattcgccctgagccagctgaccgagccccccaagctgctgccccagatcgacatcgtgaacatcagcgacagcttcgagatgacctacagattctgcagccagttcagcaagggcgtgtacgccatcttcggcttctacgagagaagaaccgtgaacatgctgaccagcttctgcggcgccctgcacgtgtgcttcatcacccccagcttccccgtggacaccagcaaccagttcgtgctgcagctgagacccgagctgcaggacgccctgatcagcatcatcgaccactacaagtggcagaagttcgtgtacatctacgacgccgacagaggcctgagcgtgctgcagaaggtgctggacaccgccgccgagaagaactggcaggtgaccgccgtgaacatcctgaccaccaccgaggagggctacagaatgctgttccaggacctggagaagaagaaggagagactggtggtggtggactgcgagagcgagagactgaacgccatcctgggccagatcatcaagctggagaagaacggcatcggctaccactacatcctggccaacctgggcttcatggacatcgacctgaacaagttcaaggagagcggcgccaacgtgaccggcttccagctggtgaactacaccgacaccatccccgccaagatcatgcagcagtggaagaacagcgacgccagagaccacaccagagtggactggaagagacccaagtacaccagcgccctgacctacgacggcgtgaaggtgatggccgaggccttccagagcctgagaagacagagaatcgacatcagcagaagaggcaacgccggcgactgcctggccaaccccgccgtgccctggggccagggcatcgacatccagagagccctgcagcaggtgagattcgagggcctgaccggcaacgtgcagttcaacgagaagggcagaagaaccaactacaccctgcacgtgatcgagatgaagcacgacggcatcagaaagatcggctactggaacgaggacgacaagttcgtgcccgccgccaccgacgcccaggccggcggcgacaacagcagcgtgcagaacagaacctacatcgtgaccaccatcctggaggacccctacgtgatgctgaagaagaacgccaaccagttcgagggcaacgacagatacgagggctactgcgtggagctggccgccgagatcgccaagcacgtgggctacagctacagactggagatcgtgagcgacggcaagtacggcgccagagaccccgacaccaaggcctggaacggcatggtgggcgagctggtgtacggcagagccgacgtggccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacagcgaggagttcgaggagggcagagaccagaccaccagcgaccagagcaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggaggccggcagcaccaaggagttcttcagaagaagcaagatcgccgtgttcgagaagatgtggacctacatgaagagcgccgagcccagcgtgttcgtgagaaccaccgaggagggcatgatcagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcgccctgagaaaccccgtgaacctggccgtgctgaagctgaacgagcagggcctgctggacaagctgaagaacaagtggtggtacgacaagggcgagtgcggcagcggcggcggcgacagcaaggacaagaccagcgccctgagcctgagcaacgtggccggcgtgttctacatcctgatcggcggcctgggcctggccatgctggtggccctgatcgagttctgctacaagagcagaagcgagagcaagagaatgaagggcttctgcctgatcccccagcagagcatcaacgaggccatcagaaccagcaccctgcccagaaacagcggcgccggcgccagcagcggcggcagcggcgagaacggcagagtggtgagccacgacttccccaagagcatgcagagcatcccctgcatgagccacagcagcggcatgcccctgggcgccaccggcctgtag

SEQ ID NO: 83118 - DNA, 2721 bp, Artificial Sequence
  Description of Artificial Sequence: Synthetic coding sequence
atgcagcacatcttcgccttcttctgcaccggcttcctgggcgccgtggtgggcgccaacttccccaacaacatccagatcggcggcctgttccccaaccagcagagccaggagcacgccgccttcagattcgccctgagccagctgaccgagccccccaagctgctgccccagatcgacatcgtgaacatcagcgacagcttcgagatgacctacagattctgcagccagttcagcaagggcgtgtacgccatcttcggcttctacgagagaagaaccgtgaacatgctgaccagcttctgcggcgccctgcacgtgtgcttcatcacccccagcttccccgtggacaccagcaaccagttcgtgctgcagctgagacccgagctgcaggacgccctgatcagcatcatcgaccactacaagtggcagaagttcgtgtacatctacgacgccgacagaggcctgagcgtgctgcagaaggtgctggacaccgccgccgagaagaactggcaggtgaccgccgtgaacatcctgaccaccaccgaggagggctacagaatgctgttccaggacctggagaagaagaaggagagactggtggtggtggactgcgagagcgagagactgaacgccatcctgggccagatcatcaagctggagaagaacggcatcggctaccactacatcctggccaacctgggcttcatggacatcgacctgaacaagttcaaggagagcggcgccaacgtgaccggcttccagctggtgaactacaccgacaccatccccgccaagatcatgcagcagtggaagaacagcgacgccagagaccacaccagagtggactggaagagacccaagtacaccagcgccctgacctacgacggcgtgaaggtgatggccgaggccttccagagcctgagaagacagagaatcgacatcagcagaagaggcaacgccggcgactgcctggccaaccccgccgtgccctggggccagggcatcgacatccagagagccctgcagcaggtgagattcgagggcctgaccggcaacgtgcagttcaacgagaagggcagaagaaccaactacaccctgcacgtgatcgagatgaagcacgacggcatcagaaagatcggctactggaacgaggacgacaagttcgtgcccgccgccaccgacgcccaggccggcggcgacaacagcagcgtgcagaacagaacctacatcgtgaccaccatcctggaggacccctacgtgatgctgaagaagaacgccaaccagttcgagggcaacgacagatacgagggctactgcgtggagctggccgccgagatcgccaagcacgtgggctacagctacagactggagatcgtgagcgacggcaagtacggcgccagagaccccgacaccaaggcctggaacggcatggtgggcgagctggtgtacggcagagccgacgtggccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacagcgaggagttcgaggagggcagagaccagaccaccagcgaccagagcaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggaggccggcagcaccaaggagttcttcagaagaagcaagatcgccgtgttcgagaagatgtggacctacatgaagagcgccgagcccagcgtgttcgtgagaaccaccgaggagggcatgatcagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcgccctgagaggccccgtgaacctggccgtgctgaagctgagcgagcagggcgtgctggacaagctgaagagcaagtggtggtacgacaagggcgagtgcggcagcaaggacagcggcagcaaggacaagaccagcgccctgagcctgagcaacgtggccggcgtgttctacatcctgatcggcggcctgggcctggccatgctggtggccctgatcgagttctgctacaagagcagaagcgagagcaagagaatgaagggcttctgcctgatcccccagcagagcatcaacgaggccatcagaaccagcaccctgcccagaaacagcggcgccggcgccagcagcggcggcagcggcgagaacggcagagtggtgagccacgacttccccaagagcatgcagagcatcccctgcatgagccacagcagcggcatgcccctgggcgccaccggcctgtag

SEQ ID NO: 83119 - DNA, 2751 bp, Artificial Sequence
  Description of Artificial Sequence: Synthetic coding sequence
atgtgctgcagcacccacctgttccagcccctgcagctggccggcggcctggagtggccctggagcaacctgctgtgcttcctgacccccgtgaagctgcaccccgaggtgtggggcctgttccccaaccagcagagccaggagcacgccgccttcagattcgccctgagccagctgaccgagccccccaagctgctgccccagatcgacatcgtgaacatcagcgacagcttcgagatgacctacagattctgcagccagttcagcaagggcgtgtacgccatcttcggcttctacgagagaagaaccgtgaacatgctgaccagcttctgcggcgccctgcacgtgtgcttcatcacccccagcttccccgtggacaccagcaaccagttcgtgctgcagctgagacccgagctgcaggacgccctgatcagcatcatcgaccactacaagtggcagaagttcgtgtacatctacgacgccgacagaggcctgagcgtgctgcagaaggtgctggacaccgccgccgagaagaactggcaggtgaccgccgtgaacatcctgaccaccaccgaggagggctacagaatgctgttccaggacctggagaagaagaaggagagactggtggtggtggactgcgagagcgagagactgaacgccatcctgggccagatcatcaagctggagaagaacggcatcggctaccactacatcctggccaacctgggcttcatggacatcgacctgaacaagttcaaggagagcggcgccaacgtgaccggcttccagctggtgaactacaccgacaccatccccgccaagatcatgcagcagtggaagaacagcgacgccagagaccacaccagagtggactggaagagacccaagtacaccagcgccctgacctacgacggcgtgaaggtgatggccgaggccttccagagcctgagaagacagagaatcgacatcagcagaagaggcaacgccggcgactgcctggccaaccccgccgtgccctggggccagggcatcgacatccagagagccctgcagcaggtgagattcgagggcctgaccggcaacgtgcagttcaacgagaagggcagaagaaccaactacaccctgcacgtgatcgagatgaagcacgacggcatcagaaagatcggctactggaacgaggacgacaagttcgtgcccgccgccaccgacgcccaggccggcggcgacaacagcagcgtgcagaacagaacctacatcgtgaccaccatcctggaggacccctacgtgatgctgaagaagaacgccaaccagttcgagggcaacgacagatacgagggctactgcgtggagctggccgccgagatcgccaagcacgtgggctacagctacagactggagatcgtgagcgacggcaagtacggcgccagagaccccgacaccaaggcctggaacggcatggtgggcgagctggtgtacggcagagccgacgtggccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacagcgaggagttcgaggagggcagagaccagaccaccagcgaccagagcaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggaggccggcagcaccaaggagttcttcagaagaagcaagatcgccgtgttcgagaagatgtggacctacatgaagagcgccgagcccagcgtgttcgtgagaaccaccgaggagggcatgatcagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcgccctgagaggccccgtgaacctggccgtgctgaagctgagcgagcagggcgtgctggacaagctgaagagcaagtggtggtacgacaagggcgagtgcggcagcaaggacagcggcagcaaggacaagaccagcgccctgagcctgagcaacgtggccggcgtgttctacatcctgatcggcggcctgggcctggccatgctggtggccctgatcgagttctgctacaagagcagaagcgagagcaagagaatgaagggcttctgcctgatcccccagcagagcatcaacgaggccatcagaaccagcaccctgcccagaaacagcggcgccggcgccagcagcggcggcagcggcgagaacggcagagtggtgagccacgacttccccaagagcatgcagagcatcccctgcatgagccacagcagcggcatgcccctgggcgccaccggcctgtag

SEQ ID NO: 83120 - DNA, 2481 bp, Artificial Sequence
  Description of Artificial Sequence: Synthetic coding sequence
atgcagcacatcttcgccttcttctgcaccggcttcctgggcgccgtggtgggcgccaacttccccaacaacatccagatcggcggcctgttccccaaccagcagagccaggagcacgccgccttcagattcgccctgagccagctgaccgagccccccaagctgctgccccagatcgacatcgtgaacatcagcgacagcttcgagatgacctacagatgcctgagcgtgctgcagaaggtgctggacaccgccgccgagaagaactggcaggtgaccgccgtgaacatcctgaccaccaccgaggagggctacagaatgctgttccaggacctggagaagaagaaggagagactggtggtggtggactgcgagagcgagagactgaacgccatcctgggccagatcatcaagctggagaagaacggcatcggctaccactacatcctggccaacctgggcttcatggacatcgacctgaacaagttcaaggagagcggcgccaacgtgaccggcttccagctggtgaactacaccgacaccatccccgccaagatcatgcagcagtggaagaacagcgacgccagagaccacaccagagtggactggaagagacccaagtacaccagcgccctgacctacgacggcgtgaaggtgatggccgaggccttccagagcctgagaagacagagaatcgacatcagcagaagaggcaacgccggcgactgcctggccaaccccgccgtgccctggggccagggcatcgacatccagagagccctgcagcaggtgagattcgagggcctgaccggcaacgtgcagttcaacgagaagggcagaagaaccaactacaccctgcacgtgatcgagatgaagcacgacggcatcagaaagatcggctactggaacgaggacgacaagttcgtgcccgccgccaccgacgcccaggccggcggcgacaacagcagcgtgcagaacagaacctacatcgtgaccaccatcctggaggacccctacgtgatgctgaagaagaacgccaaccagttcgagggcaacgacagatacgagggctactgcgtggagctggccgccgagatcgccaagcacgtgggctacagctacagactggagatcgtgagcgacggcaagtacggcgccagagaccccgacaccaaggcctggaacggcatggtgggcgagctggtgtacggcagagccgacgtggccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacagcgaggagttcgaggagggcagagaccagaccaccagcgaccagagcaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggaggccggcagcaccaaggagttcttcagaagaagcaagatcgccgtgttcgagaagatgtggacctacatgaagagcgccgagcccagcgtgttcgtgagaaccaccgaggagggcatgatcagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcgccctgagaaaccccgtgaacctggccgtgctgaagctgaacgagcagggcctgctggacaagctgaagaacaagtggtggtacgacaagggcgagtgcggcagcggcggcggcgacagcaaggacaagaccagcgccctgagcctgagcaacgtggccggcgtgttctacatcctgatcggcggcctgggcctggccatgctggtggccctgatcgagttctgctacaagagcagaagcgagagcaagagaatgaagggcttctgcctgatcccccagcagagcatcaacgaggccatcagaaccagcaccctgcccagaaacagcggcgccggcgccagcagcggcggcagcggcgagaacggcagagtggtgagccacgacttccccaagagcatgcagagcatcccctgcatgagccacagcagcggcatgcccctgggcgccaccggcctgtag

SEQ ID NO: 83121 - DNA, 2751 bp, Artificial Sequence
  Description of Artificial Sequence: Synthetic coding sequence
atgtgctgcagcacccacctgttccagcccctgcagctggccggcggcctggagtggccctggagcaacctgctgtgcttcctgacccccgtgaagctgcaccccgaggtgtggggcctgttccccaaccagcagagccaggagcacgccgccttcagattcgccctgagccagctgaccgagccccccaagctgctgccccagatcgacatcgtgaacatcagcgacagcttcgagatgacctacagattctgcagccagttcagcaagggcgtgtacgccatcttcggcttctacgagagaagaaccgtgaacatgctgaccagcttctgcggcgccctgcacgtgtgcttcatcacccccagcttccccgtggacaccagcaaccagttcgtgctgcagctgagacccgagctgcaggacgccctgatcagcatcatcgaccactacaagtggcagaagttcgtgtacatctacgacgccgacagaggcctgagcgtgctgcagaaggtgctggacaccgccgccgagaagaactggcaggtgaccgccgtgaacatcctgaccaccaccgaggagggctacagaatgctgttccaggacctggagaagaagaaggagagactggtggtggtggactgcgagagcgagagactgaacgccatcctgggccagatcatcaagctggagaagaacggcatcggctaccactacatcctggccaacctgggcttcatggacatcgacctgaacaagttcaaggagagcggcgccaacgtgaccggcttccagctggtgaactacaccgacaccatccccgccaagatcatgcagcagtggaagaacagcgacgccagagaccacaccagagtggactggaagagacccaagtacaccagcgccctgacctacgacggcgtgaaggtgatggccgaggccttccagagcctgagaagacagagaatcgacatcagcagaagaggcaacgccggcgactgcctggccaaccccgccgtgccctggggccagggcatcgacatccagagagccctgcagcaggtgagattcgagggcctgaccggcaacgtgcagttcaacgagaagggcagaagaaccaactacaccctgcacgtgatcgagatgaagcacgacggcatcagaaagatcggctactggaacgaggacgacaagttcgtgcccgccgccaccgacgcccaggccggcggcgacaacagcagcgtgcagaacagaacctacatcgtgaccaccatcctggaggacccctacgtgatgctgaagaagaacgccaaccagttcgagggcaacgacagatacgagggctactgcgtggagctggccgccgagatcgccaagcacgtgggctacagctacagactggagatcgtgagcgacggcaagtacggcgccagagaccccgacaccaaggcctggaacggcatggtgggcgagctggtgtacggcagagccgacgtggccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacagcgaggagttcgaggagggcagagaccagaccaccagcgaccagagcaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggaggccggcagcaccaaggagttcttcagaagaagcaagatcgccgtgttcgagaagatgtggacctacatgaagagcgccgagcccagcgtgttcgtgagaaccaccgaggagggcatgatcagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcgccctgagaaaccccgtgaacctggccgtgctgaagctgaacgagcagggcctgctggacaagctgaagaacaagtggtggtacgacaagggcgagtgcggcagcggcggcggcgacagcaaggacaagaccagcgccctgagcctgagcaacgtggccggcgtgttctacatcctgatcggcggcctgggcctggccatgctggtggccctgatcgagttctgctacaagagcagaagcgagagcaagagaatgaagggcttctgcctgatcccccagcagagcatcaacgaggccatcagaaccagcaccctgcccagaaacagcggcgccggcgccagcagcggcggcagcggcgagaacggcagagtggtgagccacgacttccccaagagcatgcagagcatcccctgcatgagccacagcagcggcatgcccctgggcgccaccggcctgtag

SEQ ID NO: 83122 - DNA, 2151 bp, Artificial Sequence
  Description of Artificial Sequence: Synthetic coding sequence
atgcagcacatcttcgccttcttctgcaccggcttcctgggcgccgtggtgggcgccaacttccccaacaacatccagatcgtgtgcagccagttcagcaagggcgtgtacgccatcttcggcttctacgagagaagaaccgtgaacatgctgaccagcttctgcggcgccctgcacgtgtgcttcatcacccccagcttccccgtggacaccagcaaccagttcgtgctgcagctgagacccgagctgcaggacgccctgatcagcatcatcgaccactacaagtggcagaagttcgtgtacatctacgacgccgacagaggcctgagcgtgctgcagaaggtgctggacaccgccgccgagaagaactggcaggtgaccgccgtgaacatcctgaccaccaccgaggagggctacagaatgctgttccaggacctggagaagaagaaggagagactggtggtggtggactgcgagagcgagagactgaacgccatcctgggccagatcatcaagctggagaagaacggcatcggctaccactacatcctggccaacctgggcttcatggacatcgacctgaacaagttcaaggagagcggcgccaacgtgaccggcttccagctggtgaactacaccgacaccatccccgccaagatcatgcagcagtggaagaacagcgacgccagagaccacaccagagtggactggaagagacccaagtacaccagcgccctgacctacgacggcgtgaaggtgatggccgaggccttccagagcctgagaagacagagaatcgacatcagcagaagaggcaacgccggcgactgcctggccaaccccgccgtgccctggggccagggcatcgacatccagagagccctgcagcaggtgagattcgagggcctgaccggcaacgtgcagttcaacgagaagggcagaagaaccaactacaccctgcacgtgatcgagatgaagcacgacggcatcagaaagatcggctactggaacgaggacgacaagttcgtgcccgccgccaccgacgcccaggccggcggcgacaacagcagcgtgcagaacagaacctacatcgtgaccaccatcctggaggacccctacgtgatgctgaagaagaacgccaaccagttcgagggcaacgacagatacgagggctactgcgtggagctggccgccgagatcgccaagcacgtgggctacagctacagactggagatcgtgagcgacggcaagtacggcgccagagaccccgacaccaaggcctggaacggcatggtgggcgagctggtgtacggcagagccgacgtggccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacagcgaggagttcgaggagggcagagaccagaccaccagcgaccagagcaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggaggccggcagcaccaaggagttcttcagaagaagcaagatcgccgtgttcgagaagatgtggacctacatgaagagcgccgagcccagcgtgttcgtgagaaccaccgaggagggcatgatcagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcgccctgagaaccagacaggccctgtag

SEQ ID NO: 83123 - DNA, 2721 bp, Artificial Sequence; identical to SEQ ID NO: 83118
  Description of Artificial Sequence: Synthetic coding sequence

SEQ ID NO: 83124 - DNA, 2514 bp, Artificial Sequence
  Description of Artificial Sequence: Synthetic coding sequence
atgacctacagattctgcagccagttcagcaagggcgtgtacgccatcttcggcttctacgagagaagaaccgtgaacatgctgaccagcttctgcggcgccctgcacgtgtgcttcatcacccccagcttccccgtggacaccagcaaccagttcgtgctgcagctgagacccgagctgcaggacgccctgatcagcatcatcgaccactacaagtggcagaagttcgtgtacatctacgacgccgacagaggcctgagcgtgctgcagaaggtgctggacaccgccgccgagaagaactggcaggtgaccgccgtgaacatcctgaccaccaccgaggagggctacagaatgctgttccaggacctggagaagaagaaggagagactggtggtggtggactgcgagagcgagagactgaacgccatcctgggccagatcatcaagctggagaagaacggcatcggctaccactacatcctggccaacctgggcttcatggacatcgacctgaacaagttcaaggagagcggcgccaacgtgaccggcttccagctggtgaactacaccgacaccatccccgccaagatcatgcagcagtggaagaacagcgacgccagagaccacaccagagtggactggaagagacccaagtacaccagcgccctgacctacgacggcgtgaaggtgatggccgaggccttccagagcctgagaagacagagaatcgacatcagcagaagaggcaacgccggcgactgcctggccaaccccgccgtgccctggggccagggcatcgacatccagagagccctgcagcaggtgagattcgagggcctgaccggcaacgtgcagttcaacgagaagggcagaagaaccaactacaccctgcacgtgatcgagatgaagcacgacggcatcagaaagatcggctactggaacgaggacgacaagttcgtgcccgccgccaccgacgcccaggccggcggcgacaacagcagcgtgcagaacagaacctacatcgtgaccaccatcctggaggacccctacgtgatgctgaagaagaacgccaaccagttcgagggcaacgacagatacgagggctactgcgtggagctggccgccgagatcgccaagcacgtgggctacagctacagactggagatcgtgagcgacggcaagtacggcgccagagaccccgacaccaaggcctggaacggcatggtgggcgagctggtgtacggcagagccgacgtggccgtggcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacagcgaggagttcgaggagggcagagaccagaccaccagcgaccagagcaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctggccaagcagaccgagatcgcctacggcaccctggaggccggcagcaccaaggagttcttcagaagaagcaagatcgccgtgttcgagaagatgtggacctacatgaagagcgccgagcccagcgtgttcgtgagaaccaccgaggagggcatgatcagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcgccctgagaaaccccgtgaacctggccgtgctgaagctgaacgagcagggcctgctggacaagctgaagaacaagtggtggtacgacaagggcgagtgcggcagcggcggcggcgacagcaaggacaagaccagcgccctgagcctgagcaacgtggccggcgtgttctacatcctgatcggcggcctgggcctggccatgctggtggccctgatcgagttctgctacaagagcagaagcgagagcaagagaatgaagggcttctgcctgatcccccagcagagcatcaacgaggccatcagaaccagcaccctgcccagaaacagcggcgccggcgccagcagcggcggcagcggcgagaacggcagagtggtgagccacgacttccccaagagcatgcagagcatcccctgcatgagccacagcagcggcatgcccctgggcgccaccggcctgtag

SEQ ID NO: 83125 - DNA, 2652 bp, Artificial Sequence
  Description of Artificial Sequence: Synthetic coding sequence
atgcagaagatcatgcacatcagcgtgctgctgagccccgtgctgtggggcctgatcttcggcgtgagcagcaacagcatccagatcggcggcctgttccccagaggcgccgaccaggagtacagcgccttcagagtgggcatggtgcagttcagcaccagcgagttcagactgaccccccacatcgacaacctggaggtggccaacagcttcgccgtgaccaacgccttctgcagccagttcagcagaggcgtgtacgccatcttcggcttctacgacaagaagagcgtgaacaccatcaccagcttctgcggcaccctgcacgtgagcttcatcacccccagcttccccaccgacggcacccaccccttcgtgatccagatgagacccgacctgaagggcgccctgctgagcctgatcgagtactaccagtgggacaagttcgcctacctgtacgacagcgacagaggcctgagcaccctgcaggccgtgctggacagcgccgccgagaagaagtggcaggtgaccgccatcaacgtgggcaacatcaacaacgacaagaaggacgagatgtacagaagcctgttccaggacctggagctgaagaaggagagaagagtgatcctggactgcgagagagacaaggtgaacgacatcgtggaccaggtgatcaccatcggcaagcacgtgaagggctaccactacatcatcgccaacctgggcttcaccgacggcgacctgctgaagatccagttcggcggcgccaacgtgagcggcttccagatcgtggactacgacgacagcctggtgagcaagttcatcgagagatggagcaccctggaggagaaggagtaccccggcgcccacaccaccaccatcaagtacaccagcgccctgacctacgacgccgtgcaggtgatgaccgaggccttcagaaacctgagaaagcagagaatcgagatcagcagaagaggcaacgccggcgactgcctggccaaccccgccgtgccctggggccagggcgtggagatcgagagagccctgaagcaggtgcaggtggagggcctgagcggcaacatcaagttcgaccagaacggcaagagaatcaactacaccatcaacatcatggagctgaagaccaacggccccagaaagatcggctactggagcgaggtggacaagatggtggtgaccctgaccgagctgcccagcggcaacgacaccagcggcctggagaacaagaccgtggtggtgaccaccatcctggagagcccctacgtgatgatgaagaagaaccacgagatgctggagggcaacgagagatacgagggctactgcgtggacctggccgccgagatcgccaagcactgcggcttcaagtacaagctgaccatcgtgggcgacggcaagtacggcgccagagacgccgacaccaagatctggaacggcatggtgggcgagctggtgtacggcaaggccgacatcgccatcgcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacaccgaggagttcgaggacggcagagagacccagagcagcgagagcaccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctgagcaagcagaccgagatcgcctacggcaccctggacagcggcagcaccaaggagttcttcagaagaagcaagatcgccgtgttcgacaagatgtggacctacatgagaagcgccgagcccagcgtgttcgtgagaaccaccgccgagggcgtggccagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcagcctgagaaacgccgtgaacctggccgtgctgaagctgaacgagcagggcctgctggacaagctgaagaacaagtggtggtacgacaagggcgagtgcggcagcggcggcggcgacagcaaggagaagaccagcgccctgagcctgagcaacgtggccggcgtgttctacatcctggtgggcggcctgggcctggccatgctggtggccctgatcgagttctgctacaagagcagagccgaggccaagagaatgaaggtggccaagaacgcccagaacatcaaccccagcagcagccagaacagccagaacttcgccacctacaaggagggctacaacgtgtacggcatcgagagcgtgaagatctag

SEQ ID NO: 83126 - DNA, 2652 bp, Artificial Sequence
  Description of Artificial Sequence: Synthetic coding sequence
atgcagaagatcatgcacatcagcgtgctgctgagccccgtgctgtggggcctgatcttcggcgtgagcagcaacagcatccagatcggcggcctgttccccagaggcgccgaccaggagtacagcgccttcagagtgggcatggtgcagttcagcaccagcgagttcagactgaccccccacatcgacaacctggaggtggccaacagcttcgccgtgaccaacgccttctgcagccagttcagcagaggcgtgtacgccatcttcggcttctacgacaagaagagcgtgaacaccatcaccagcttctgcggcaccctgcacgtgagcttcatcacccccagcttccccaccgacggcacccaccccttcgtgatccagatgagacccgacctgaagggcgccctgctgagcctgatcgagtactaccagtgggacaagttcgcctacctgtacgacagcgacagaggcctgagcaccctgcaggccgtgctggacagcgccgccgagaagaagtggcaggtgaccgccatcaacgtgggcaacatcaacaacgacaagaaggacgagatgtacagaagcctgttccaggacctggagctgaagaaggagagaagagtgatcctggactgcgagagagacaaggtgaacgacatcgtggaccaggtgatcaccatcggcaagcacgtgaagggctaccactacatcatcgccaacctgggcttcaccgacggcgacctgctgaagatccagttcggcggcgccaacgtgagcggcttccagatcgtggactacgacgacagcctggtgagcaagttcatcgagagatggagcaccctggaggagaaggagtaccccggcgcccacaccaccaccatcaagtacaccagcgccctgacctacgacgccgtgcaggtgatgaccgaggccttcagaaacctgagaaagcagagaatcgagatcagcagaagaggcaacgccggcgactgcctggccaaccccgccgtgccctggggccagggcgtggagatcgagagagccctgaagcaggtgcaggtggagggcctgagcggcaacatcaagttcgaccagaacggcaagagaatcaactacaccatcaacatcatggagctgaagaccaacggccccagaaagatcggctactggagcgaggtggacaagatggtggtgaccctgaccgagctgcccagcggcaacgacaccagcggcctggagaacaagaccgtggtggtgaccaccatcctggagagcccctacgtgatgatgaagaagaaccacgagatgctggagggcaacgagagatacgagggctactgcgtggacctggccgccgagatcgccaagcactgcggcttcaagtacaagctgaccatcgtgggcgacggcaagtacggcgccagagacgccgacaccaagatctggaacggcatggtgggcgagctggtgtacggcaaggccgacatcgccatcgcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacaccgaggagttcgaggacggcagagagacccagagcagcgagagcaccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctgagcaagcagaccgagatcgcctacggcaccctggacagcggcagcaccaaggagttcttcagaagaagcaagatcgccgtgttcgacaagatgtggacctacatgagaagcgccgagcccagcgtgttcgtgagaaccaccgccgagggcgtggccagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcagcctgagaacccccgtgaacctggccgtgctgaagctgagcgagcagggcgtgctggacaagctgaagaacaagtggtggtacgacaagggcgagtgcggcgccaaggacagcggcagcaaggagaagaccagcgccctgagcctgagcaacgtggccggcgtgttctacatcctggtgggcggcctgggcctggccatgctggtggccctgatcgagttctgctacaagagcagagccgaggccaagagaatgaaggtggccaagaacgcccagaacatcaaccccagcagcagccagaacagccagaacttcgccacctacaaggagggctacaacgtgtacggcatcgagagcgtgaagatctag

SEQ ID NO: 83127 - DNA, 2193 bp, Artificial Sequence
  Description of Artificial Sequence: Synthetic coding sequence
atggtgcagttcagcaccagcgagttcagactgaccccccacatcgacaacctggaggtggccaacagcttcgccgtgaccaacgccttctgcagccagttcagcagaggcgtgtacgccatcttcggcttctacgacaagaagagcgtgaacaccatcaccagcttctgcggcaccctgcacgtgagcttcatcacccccagcttccccaccgacggcacccaccccttcgtgatccagatgagacccgacctgaagggcgccctgctgagcctgatcgagtactaccagtgggacaagttcgcctacctgtacgacagcgacagaggcctgagcaccctgcaggccgtgctggacagcgccgccgagaagaagtggcaggtgaccgccatcaacgtgggcaacatcaacaacgacaagaaggacgagatgtacagaagcctgttccaggacctggagctgaagaaggagagaagagtgatcctggactgcgagagagacaaggtgaacgacatcgtggaccaggtgatcaccatcggcaagcacgtgaagggctaccactacatcatcgccaacctgggcttcaccgacggcgacctgctgaagatccagttcggcggcgccaacgtgagcggcttccagatcgtggactacgacgacagcctggtgagcaagttcatcgagagatggagcaccctggaggagaaggagtaccccggcgcccacaccaccaccatcaagtacaccagcgccctgacctacgacgccgtgcaggtgatgaccgaggccttcagaaacctgagaaagcagagaatcgagatcagcagaagaggcaacgccggcgactgcctggccaaccccgccgtgccctggggccagggcgtggagatcgagagagccctgaagcaggtgcaggtggagggcctgagcggcaacatcaagttcgaccagaacggcaagagaatcaactacaccatcaacatcatggagctgaagaccaacggccccagaaagatcggctactggagcgaggtggacaagatggtggtgaccctgaccgagctgcccagcggcaacgacaccagcggcctggagaacaagaccgtggtggtgaccaccatcctggagagcccctacgtgatgatgaagaagaaccacgagatgctggagggcaacgagagatacgagggctactgcgtggacctggccgccgagatcgccaagcactgcggcttcaagtacaagctgaccatcgtgggcgacggcaagtacggcgccagagacgccgacaccaagatctggaacggcatggtgggcgagctggtgtacggcaaggccgacatcgccatcgcccccctgaccatcaccctggtgagagaggaggtgatcgacttcagcaagcccttcatgagcctgggcatcagcatcatgatcaagaagccccagaagagcaagcccggcgtgttcagcttcctggaccccctggcctacgagatctggatgtgcatcgtgttcgcctacatcggcgtgagcgtggtgctgttcctggtgagcagattcagcccctacgagtggcacaccgaggagttcgaggacggcagagagacccagagcagcgagagcaccaacgagttcggcatcttcaacagcctgtggttcagcctgggcgccttcatgcagcagggctgcgacatcagccccagaagcctgagcggcagaatcgtgggcggcgtgtggtggttcttcaccctgatcatcatcagcagctacaccgccaacctggccgccttcctgaccgtggagagaatggtgagccccatcgagagcgccgaggacctgagcaagcagaccgagatcgcctacggcaccctggacagcggcagcaccaaggagttcttcagaagaagcaagatcgccgtgttcgacaagatgtggacctacatgagaagcgccgagcccagcgtgttcgtgagaaccaccgccgagggcgtggccagagtgagaaagagcaagggcaagtacgcctacctgctggagagcaccatgaacgagtacatcgagcagagaaagccctgcgacaccatgaaggtgggcggcaacctggacagcaagggctacggcatcgccacccccaagggcagcagcctgagcggcgtgaccttcaagaccctgctgttcgtgtgctgcggctag

SEQ ID NO: 83128 - DNA, 297 bp, Artificial Sequence
  Description of Artificial Sequence: Synthetic coding sequence
atgaacgagtacatcgagcagagaaagccctgcgacaccatgaaggtgggcggcaacctggacagcaagggctacggcatcgccacccccaagggcagcagcctgagcggcgtgaccttcaagaccctgatctgcctgctgtggatcaacgccgtgaacctggccgtgctgaagctgaacgagcagggcctgctggacaagctgaagaacaagtggtggtacgacaagggcgagtgcggcagcggcggcggcgacagcaagaaccccagcaagagctgcagcatcgagacccagtag

SEQ ID NO: 83129 - DNA, 2511 bp, Artificial Sequence; identical to SEQ ID NO: 83096
  Description of Artificial Sequence: Synthetic coding sequence

SEQ ID NO: 83130 - DNA, 438 bp, Artificial Sequence
  Description of Artificial Sequence: Synthetic coding sequence
atggtgcagttcagcaccagcgagttcagactgaccccccacatcgacaacctggaggtggccaacagcttcgccgtgaccaacgccttctgcagccagttcagcagaggcgtgtacgccatcttcggcttctacgacaagaagagcgtgaacaccatcaccagcttctgcggcaccctgcacgtgagcttcatcacccccagcttccccaccgacggcacccaccccttcgtgatccagatgagacccgacctgaagggcgccctgctgagcctgatcgagtactaccagtgggacaagttcgcctacctgtacgacagcgacagaggcctgagcaccctgcaggccgtgctggacagcgccgccgagaagaagtggcaggtgaccgccatcaacgtgggcaacatcaacaacgacaagaaggacgagatgtactag

SEQ ID NO: 83131 - DNA, 174 bp, Artificial Sequence
  Description of Artificial Sequence: Synthetic coding sequence
atggtgcagttcagcaccagcgagttcagactgaccccccacatcgacaacctggaggtggccaacagcttcgccgtgaccaacgccttctgcagccagttcagcagaggcgtgtacgccatcttcggcttctacgacaagaagagcgtgaacaccatcaccagcttctgctag

SEQ ID NO: 83132 - DNA, 2511 bp, Artificial Sequence; identical to SEQ ID NO: 83096
  Description of Artificial Sequence: Synthetic coding sequence

SEQ ID NO: 83133 - DNA, 378 bp, Artificial Sequence
  Description of Artificial Sequence: Synthetic coding sequence
atgcagaagatcatgcacatcagcgtgctgctgagccccgtgctgtggggcctgatcttcggcgtgagcagcaacagcatccagatcggcggcctgttccccagaggcgccgaccaggagtacagcgccttcagagtgggcatggtgcagttcagcaccagcgagttcagactgaccccccacatcgacaacctggaggtggccaacagcttcgccgtgaccaacgccttctgcagccagttcagcagaggcgtgtacgccatcttcggcttctacgacaagaagagcgtgaacaccatcaccagcttctgcggcaccctgcacgtgagcttcatcacccccagcttccccaccgacggcacccaccccttcgtgtag

SEQ ID NO: 83134 - DNA, 147 bp, Artificial Sequence
  Description of Artificial Sequence: Synthetic coding sequence
atgcagaagatcatgcacatcagcgtgctgctgagccccgtgctgtggggcctgatcttcggcgtgagcagcaacagcatccagatcggcggcctgttccccagaggcgccgaccaggagtacagcgccttcagagtgggcatgtag

SEQ ID NO: 83135 - DNA, 3030 bp, Artificial Sequence
  Description of Artificial Sequence: Synthetic coding sequence
atggaggccctgaccctgtggctgctgccctggatctgccagtgcgtgagcgtgagagccgacagcatcatccacatcggcgccatcttcgaggagaacgccgccaaggacgacagagtgttccagctggccgtgagcgacctgagcctgaacgacgacatcctgcagagcgagaagatcacctacagcatcaaggtgatcgaggccaacaaccccttccaggccgtgcaggaggcctgcgacctgatgacccagggcatcctggccctggtgaccagcaccggctgcgccagcgccaacgccctgcagagcctgaccgacgccatgcacatcccccacctgttcgtgcagagaaaccccggcggcagccccagaaccgcctgccacctgaaccccagccccgacggcgaggcctacaccctggccagcagaccccccgtgagactgaacgacgtgatgctgagactggtgaccgagctgagatggcagaagttcgtgatgttctacgacagcgagtacgacatcagaggcctgcagagcttcctggaccaggccagcagactgggcctggacgtgagcctgcagaaggtggacaagaacatcagccacgtgttcaccagcctgttcaccaccatgaagaccgaggagctgaacagatacagagacaccctgagaagagccatcctgctgctgagcccccagggcgcccacagcttcatcaacgaggccgtggagaccaacctggccagcaaggacagccactgggtgttcgtgaacgaggagatcagcgaccccgagatcctggacctggtgcacagcgccctgggcagaatgaccgtggtgagacagatcttccccagcgccaaggacaaccagaagtgcaccagaaacaaccacagaatcagcagcctgctgtgcgacccccaggagggctacctgcagatgctgcagatcagcaacctgtacctgtacgacagcgtgctgatgctggccaacgccttccacagaaagctggaggacagaaagtggcacagcatggccagcctgaactgcatcagaaagagcaccaagccctggaacggcggcagaagcatgctggacaccatcaagaagggccacatcaccggcctgaccggcgtgatggagttcagagaggacagcagcaacccctacgtgcagttcgagatcctgggcaccacctacagcgagaccttcggcaaggacatgagaaagctggccacctgggacagcgagaagggcctgaacggcagcctgcaggagagacccatgggcagcagactgcagggcctgaccctgaaggtggtgaccgtgctggaggagcccttcgtgatggtggccgagaacatcctgggccagcccaagagatacaagggcttcagcatcgacgtgctggacgccctggccaaggccctgggcttcaagtacgagatctaccaggcccccgacggcagatacggccaccagctgcacaacaccagctggaacggcatgatcggcgagctgatcagcaagagagccgacctggccatcagcgccatcaccatcacccccgagagagagagcgtggtggacttcagcaagagatacatggactacagcgtgggcatcctgatcaagaagcccgaggagaagatcagcatcttcagcctgttcgcccccttcgacttcgccgtgtgggcctgcatcgccgccgccatccccgtggtgggcgtgctgatcttcgtgctgaacagaatccaggccgtgagagcccagagcgccgcccagcccagacccagcgccagcgccaccctgcacagcgccatctggatcgtgtacggcgccttcgtgcagcagggcggcgagagcagcgtgaacagcatggccatgagaatcgtgatgggcagctggtggctgttcaccctgatcgtgtgcagcagctacaccgccaacctggccgccttcctgaccgtgagcagaatggacaaccccatcagaaccttccaggacctgagcaagcaggtggagatgagctacggcaccgtgagagacagcgccgtgtacgagtacttcagagccaagggcaccaaccccctggagcaggacagcaccttcgccgagctgtggagaaccatcagcaagaacggcggcgccgacaactgcgtgagcagccccagcgagggcatcagaaaggccaagaagggcaactacgccttcctgtgggacgtggccgtggtggagtacgccgccctgaccgacgacgactgcagcgtgaccgtgatcggcaacagcatcagcagcaagggctacggcatcgccctgcagcacggcagcccctacagagacctgttcagccagagaatcctggagctgcaggacaccggcgacctggacgtgctgaagcagaagtggtggccccacatgggcagatgcgacctgaccagccacgccagcgcccaggccgacggcaagagcctgaagctgcacagcttcgccggcgtgttctgcatcctggccatcggcctgctgctggcctgcctggtggccgccctggagctgtggtggaacagcaacagatgccaccaggagacccccaaggaggacaaggaggtgaacctggagcaggtgcacagaagaatgaacagcctgatggacgaggacatcgcccacaagcagatcagccccgccagcatcgagctgagcgccctggagatgggcggcctggcccccacccagaccctggagcccaccagagagtaccagaacacccagctgagcgtgagcaccttcctgcccgagcagagcagccacggcaccagcagaaccctgagcagcggccccagcagcaacctgcccctgcccctgagcagcagcgccaccatgcccagcatgcagtgcaagcacagaagccccaacggcggcctgttcagacagagccccgtgaagacccccatccccatgagcttccagcccgtgcccggcggcgtgctgcccgaggccctggacaccagccacggcaccagcatctag

SEQ ID NO: 83136 - DNA, 1743 bp, Artificial Sequence
  Description of Artificial Sequence: Synthetic coding sequence
atgggcagcagactgcagggcctgaccctgaaggtggtgaccgtgctggaggagcccttcgtgatggtggccgagaacatcctgggccagcccaagagatacaagggcttcagcatcgacgtgctggacgccctggccaaggccctgggcttcaagtacgagatctaccaggcccccgacggcagatacggccaccagctgcacaacaccagctggaacggcatgatcggcgagctgatcagcaagagagccgacctggccatcagcgccatcaccatcacccccgagagagagagcgtggtggacttcagcaagagatacatggactacagcgtgggcatcctgatcaagaagcccgaggagaagatcagcatcttcagcctgttcgcccccttcgacttcgccgtgtgggcctgcatcgccgccgccatccccgtggtgggcgtgctgatcttcgtgctgaacagaatccaggccgtgagagcccagagcgccgcccagcccagacccagcgccagcgccaccctgcacagcgccatctggatcgtgtacggcgccttcgtgcagcagggcggcgagagcagcgtgaacagcatggccatgagaatcgtgatgggcagctggtggctgttcaccctgatcgtgtgcagcagctacaccgccaacctggccgccttcctgaccgtgagcagaatggacaaccccatcagaaccttccaggacctgagcaagcaggtggagatgagctacggcaccgtgagagacagcgccgtgtacgagtacttcagagccaagggcaccaaccccctggagcaggacagcaccttcgccgagctgtggagaaccatcagcaagaacggcggcgccgacaactgcgtgagcagccccagcgagggcatcagaaaggccaagaagggcaactacgccttcctgtgggacgtggccgtggtggagtacgccgccctgaccgacgacgactgcagcgtgaccgtgatcggcaacagcatcagcagcaagggctacggcatcgccctgcagcacggcagcccctacagagacctgttcagccagagaatcctggagctgcaggacaccggcgacctggacgtgctgaagcagaagtggtggccccacatgggcagatgcgacctgaccagccacgccagcgcccaggccgacggcaagagcctgaagctgcacagcttcgccggcgtgttctgcatcctggccatcggcctgctgctggcctgcctggtggccgccctggagctgtggtggaacagcaacagatgccaccaggagacccccaaggaggacaaggaggtgaacctggagcaggtgcacagaagaatgaacagcctgatggacgaggacatcgcccacaagcagatcagccccgccagcatcgagctgagcgccctggagatgggcggcctggcccccacccagaccctggagcccaccagagagtaccagaacacccagctgagcgtgagcaccttcctgcccgagcagagcagccacggcaccagcagaaccctgagcagcggccccagcagcaacctgcccctgcccctgagcagcagcgccaccatgcccagcatgcagtgcaagcacagaagccccaacggcggcctgttcagacagagccccgtgaagacccccatccccatgagcttccagcccgtgcccggcggcgtgctgcccgaggccctggacaccagccacggcaccagcatctag

SEQ ID NO: 83137 - DNA, 3024 bp, Artificial Sequence
  Description of Artificial Sequence: Synthetic coding sequence
atggaggtgttccccttcctgctggtgctgagcgtgtggtggagcagaacctgggacagcgccaacgccgacagcatcatccacatcggcgccatcttcgacgagagcgccaagaaggacgacgaggtgttcagaaccgccgtgggcgacctgaaccagaacgaggagatcctgcagaccgagaagatcaccttcagcgtgaccttcgtggacggcaacaaccccttccaggccgtgcaggaggcctgcgagctgatgaaccagggcatcctggccctggtgagcagcatcggctgcaccagcgccggcagcctgcagagcctggccgacgccatgcacatcccccacctgttcatccagagaagcaccgccggcacccccagaagcggctgcggcctgaccagaagcaacagaaacgacgactacaccctgagcgtgagaccccccgtgtacctgcacgacgtgatcctgagagtggtgaccgagtacgcctggcagaagttcatcatcttctacgacagcgagtacgacatcagaggcatccaggagttcctggacaaggtgagccagcagggcatggacgtggccctgcagaaggtggagaacaacatcaacaagatgatcaccaccctgttcgacaccatgagaatcgaggagctgaacagatacagagacaccctgagaagagccatcctggtgatgaaccccgccaccgccaagagcttcatcaccgaggtggtggagaccaacctggtggccttcgactgccactggatcatcatcaacgaggagatcaacgacgtggacgtgcaggagctggtgagaagaagcatcggcagactgaccatcatcagacagaccttccccgtgccccagaacatcagccagagatgcttcagaggcaaccacagaatcagcagcaccctgtgcgaccccaaggaccccttcgcccagaacatggagatcagcaacctgtacatctacgacaccgtgctgctgctggccaacgccttccacaagaagctggaggacagaaagtggcacagcatggccagcctgagctgcatcagaaagaacagcaagccctggcagggcggcagaagcatgctggagaccatcaagaagggcggcgtgagcggcctgaccggcgagctggagttcggcgagaacggcggcaaccccaacgtgcacttcgagatcctgggcaccaactacggcgaggagctgggcagaggcgtgagaaagctgggctgctggaaccccgtgaccggcctgaacggcagcctgaccgacaagaagctggagaacaacatgagaggcgtggtgctgagagtggtgaccgtgctggaggagcccttcgtgatggtgagcgagaacgtgctgggcaagcccaagaagtaccagggcttcagcatcgacgtgctggacgccctgagcaactacctgggcttcaactacgagatctacgtggcccccgaccacaagtacggcagcccccaggaggacggcacctggaacggcctggtgggcgagctggtgttcaagagagccgacatcggcatcagcgccctgaccatcacccccgacagagagaacgtggtggacttcaccaccagatacatggactacagcgtgggcgtgctgctgagaagagccgagaagaccgtggacatgttcgcctgcctggcccccttcgacctgagcctgtgggcctgcatcgccggcaccgtgctgctggtgggcctgctggtgtacctgctgaactggctgaacccccccagactgcagatgggcagcatgaccagcaccaccctgtacaacagcatgtggttcgtgtacggcagcttcgtgcagcagggcggcgaggtgccctacaccaccctggccaccagaatgatgatgggcgcctggtggctgttcgccctgatcgtgatcagcagctacaccgccaacctggccgccttcctgaccatcaccagaatcgagagcagcatccagagcctgcaggacctgagcaagcagaccgagatcccctacggcaccgtgctggacagcgccgtgtacgagcacgtgagaatgaagggcctgaaccccttcgagagagacagcatgtacagccagatgtggagaatgatcaacagaagcaacggcagcgagaacaacgtgctggagagccaggccggcatccagaaggtgaagtacggcaactacgccttcgtgtgggacgccgccgtgctggagtacgtggccatcaacgaccccgactgcagcttctacaccatcggcaacaccgtggccgacagaggctacggcatcgccctgcagcacggcagcccctacagagacgtgttcagccagagaatcctggagctgcagcagaacggcgacatggacatcctgaagcacaagtggtggcccaagaacggccagtgcgacctgtacagcagcgtggacaccaagcagaagggcggcgccctggacatcaagagcttcgccggcgtgttctgcatcctggccgccggcatcgtgctgagctgcttcatcgccatgctggagacctggtggaacaagagaaagggcagcagagtgcccagcaaggaggacgacaaggagatcgacctggagcacctgcacagaagagtgaacagcctgtgcaccgacgacgacagcccccacaagcagttcagcaccagcagcatcgacctgacccccctggacatcgacaccctgcccaccagacaggccctggagcagatcagcgacttcagaaacacccacatcaccaccaccaccttcatccccgagcagatccagaccctgagcagaaccctgagcgccaaggccgccagcggcttcaccttcggcaacgtgcccgagcacagaaccggccccttcagacacagagcccccaacggcggcttcttcagaagccccatcaagaccatgagcagcatcccctaccagcccacccccaccctgggcctgaacctgggcaacgaccccgacagaggcaccagcatctag

SEQ ID NO: 83138 - DNA, 2739 bp, Artificial Sequence
  Description of Artificial Sequence: Synthetic coding sequence
atggaggtgttccccttcctgctggtgctgagcgtgtggtggagcagaacctgggacagcgccaacgccgacagcatcatccacatcggcgccatcttcgacgagagcgccaagaaggacgacgaggtgttcagaaccgccgtgggcgacctgaaccagaacgaggagatcctgcagaccgagaagatcaccttcagcgtgaccttcgtggacggcaacaaccccttccaggccgtgcaggaggacatcagaggcatccaggagttcctggacaaggtgagccagcagggcatggacgtggccctgcagaaggtggagaacaacatcaacaagatgatcaccaccctgttcgacaccatgagaatcgaggagctgaacagatacagagacaccctgagaagagccatcctggtgatgaaccccgccaccgccaagagcttcatcaccgaggtggtggagaccaacctggtggccttcgactgccactggatcatcatcaacgaggagatcaacgacgtggacgtgcaggagctggtgagaagaagcatcggcagactgaccatcatcagacagaccttccccgtgccccagaacatcagccagagatgcttcagaggcaaccacagaatcagcagcaccctgtgcgaccccaaggaccccttcgcccagaacatggagatcagcaacctgtacatctacgacaccgtgctgctgctggccaacgccttccacaagaagctggaggacagaaagtggcacagcatggccagcctgagctgcatcagaaagaacagcaagccctggcagggcggcagaagcatgctggagaccatcaagaagggcggcgtgagcggcctgaccggcgagctggagttcggcgagaacggcggcaaccccaacgtgcacttcgagatcctgggcaccaactacggcgaggagctgggcagaggcgtgagaaagctgggctgctggaaccccgtgaccggcctgaacggcagcctgaccgacaagaagctggagaacaacatgagaggcgtggtgctgagagtggtgaccgtgctggaggagcccttcgtgatggtgagcgagaacgtgctgggcaagcccaagaagtaccagggcttcagcatcgacgtgctggacgccctgagcaactacctgggcttcaactacgagatctacgtggcccccgaccacaagtacggcagcccccaggaggacggcacctggaacggcctggtgggcgagctggtgttcaagagagccgacatcggcatcagcgccctgaccatcacccccgacagagagaacgtggtggacttcaccaccagatacatggactacagcgtgggcgtgctgctgagaagagccgagaagaccgtggacatgttcgcctgcctggcccccttcgacctgagcctgtgggcctgcatcgccggcaccgtgctgctggtgggcctgctggtgtacctgctgaactggctgaacccccccagactgcagatgggcagcatgaccagcaccaccctgtacaacagcatgtggttcgtgtacggcagcttcgtgcagcagggcggcgaggtgccctacaccaccctggccaccagaatgatgatgggcgcctggtggctgttcgccctgatcgtgatcagcagctacaccgccaacctggccgccttcctgaccatcaccagaatcgagagcagcatccagagcctgcaggacctgagcaagcagaccgagatcccctacggcaccgtgctggacagcgccgtgtacgagcacgtgagaatgaagggcctgaaccccttcgagagagacagcatgtacagccagatgtggagaatgatcaacagaagcaacggcagcgagaacaacgtgctggagagccaggccggcatccagaaggtgaagtacggcaactacgccttcgtgtgggacgccgccgtgctggagtacgtggccatcaacgaccccgactgcagcttctacaccatcggcaacaccgtggccgacagaggctacggcatcgccctgcagcacggcagcccctacagagacgtgttcagccagagaatcctggagctgcagcagaacggcgacatggacatcctgaagcacaagtggtggcccaagaacggccagtgcgacctgtacagcagcgtggacaccaagcagaagggcggcgccctggacatcaagagcttcgccggcgtgttctgcatcctggccgccggcatcgtgctgagctgcttcatcgccatgctggagacctggtggaacaagagaaagggcagcagagtgcccagcaaggaggacgacaaggagatcgacctggagcacctgcacagaagagtgaacagcctgtgcaccgacgacgacagcccccacaagcagttcagcaccagcagcatcgacctgacccccctggacatcgacaccctgcccaccagacaggccctggagcagatcagcgacttcagaaacacccacatcaccaccaccaccttcatccccgagcagatccagaccctgagcagaaccctgagcgccaaggccgccagcggcttcaccttcggcaacgtgcccgagcacagaaccggccccttcagacacagagcccccaacggcggcttcttcagaagccccatcaagaccatgagcagcatcccctaccagcccacccccaccctgggcctgaacctgggcaacgaccccgacagaggcaccagcatctag

SEQ ID NO: 83139 - DNA, 2763 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccaccgccagatgggacggcctgaccggccacatcaccttcaacaagaccaacggcctgagaaaggacttcgacctggacatcatcagcctgaaggaggagggcaccgagaaggccgccggcgaggtgagcaagcacctgtacaaggtgtggaagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcaggccttctgcttcttctacggcctgcagtgcaagcagacccaccccaccaacagcaccagcggcaccaccctgagcaccgacctggagtgcggcaagctgatcagagaggagagaggcatcagaaagcagagcagcgtgcacaccgtgtag

SEQ ID NO: 83140 - DNA, 2850 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccagatgggacggcctgaccggccacatcaccttcaacaagaccaacggcctgagaaaggacttcgacctggacatcatcagcctgaaggaggagggcaccgagaaggccgccggcgaggtgagcaagcacctgtacaaggtgtggaagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcagaagggcaagagcagcagaatcagattctacttcagaaacaaggtgagattccacggcagaaagaagcagagcctgggcgtggagaagtgcctgagcttcaacgccatcatggaggagctgggcatcagcctgaagaaccagaagaagatcaagaagaagagcagaaccaagggcaagagcagcttcaccagcatcctgacctgccaccagagaagaacccagagaaaggagaccgtggcctag

SEQ ID NO: 83141 - DNA, 2616 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccagatgggacggcctgaccggccacatcaccttcaacaagaccaacggcctgagaaaggacttcgacctggacatcatcagcctgaaggaggagggcaccgagaaggccgccggcgaggtgagcaagcacctgtacaaggtgtggaagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcagcactactag

SEQ ID NO: 83142 - DNA, 2718 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccagatgggacggcctgaccggccacatcaccttcaacaagaccaacggcctgagaaaggacttcgacctggacatcatcagcctgaaggaggagggcaccgagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcagtgcctgagcttcaacgccatcatggaggagctgggcatcagcctgaagaaccagaagaagatcaagaagaagagcagaaccaagggcaagagcagcttcaccagcatcctgacctgccaccagagaagaacccagagaaaggagaccgtggcctag

SEQ ID NO: 83143 - DNA, 2757 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccagatgggacggcctgaccggccacatcaccttcaacaagaccaacggcctgagaaaggacttcgacctggacatcatcagcctgaaggaggagggcaccgagaaggccgccggcgaggtgagcaagcacctgtacaaggtgtggaagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcaggccttctgcttcttctacggcctgcagtgcaagcagacccaccccaccaacagcaccagcggcaccaccctgagcaccgacctggagtgcggcaagctgatcagagaggagagaggcatcagaaagcagagcagcgtgcacaccgtgtag

SEQ ID NO: 83144 - DNA, 2712 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccagatgggacggcctgaccggccacatcaccttcaacaagaccaacggcctgagaaaggacttcgacctggacatcatcagcctgaaggaggagggcaccgagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcaggccttctgcttcttctacggcctgcagtgcaagcagacccaccccaccaacagcaccagcggcaccaccctgagcaccgacctggagtgcggcaagctgatcagagaggagagaggcatcagaaagcagagcagcgtgcacaccgtgtag

SEQ ID NO: 83145 - DNA, 2763 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccagatgggacggcctgaccggccacatcaccttcaacaagaccaacggcctgagaaaggacttcgacctggacatcatcagcctgaaggaggagggcaccgagaaggccgccggcgaggtgagcaagcacctgtacaaggtgtggaagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcagtgcctgagcttcaacgccatcatggaggagctgggcatcagcctgaagaaccagaagaagatcaagaagaagagcagaaccaagggcaagagcagcttcaccagcatcctgacctgccaccagagaagaacccagagaaaggagaccgtggcctag

SEQ ID NO: 83146 - DNA, 2805 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccagatgggacggcctgaccggccacatcaccttcaacaagaccaacggcctgagaaaggacttcgacctggacatcatcagcctgaaggaggagggcaccgagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcagaagggcaagagcagcagaatcagattctacttcagaaacaaggtgagattccacggcagaaagaagcagagcctgggcgtggagaagtgcctgagcttcaacgccatcatggaggagctgggcatcagcctgaagaaccagaagaagatcaagaagaagagcagaaccaagggcaagagcagcttcaccagcatcctgacctgccaccagagaagaacccagagaaaggagaccgtggcctag

SEQ ID NO: 83147 - DNA, 2769 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcggcggcatcttcgagaccgtggagaacgagcccgtgaacgtggaggagctggccttcaagttcgccgtgaccagcatcaacagaaacagaaccctgatgcccaacaccaccctgacctacgacatccagagaatcaacctgttcgacagcttcgaggccagcagaagagcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccaccgccagatgggacggcctgaccggccacatcaccttcaacaagaccaacggcctgagaaaggacttcgacctggacatcatcagcctgaaggaggagggcaccgagaaggccgccggcgaggtgagcaagcacctgtacaaggtgtggaagaagatcggcatctggaacagcaacagcggcctgaacatgaccgacagcaacaaggacaagagcagcaacatcaccgacagcctggccaacagaaccctgatcgtgaccaccatcctggaggagccctacgtgatgtacagaaagagcgacaagcccctgtacggcaacgacagattcgagggctactgcctggacctgctgaaggagctgagcaacatcctgggcttcatctacgacgtgaagctggtgcccgacggcaagtacggcgcccagaacgacaagggcgagtggaacggcatggtgaaggagctgatcgaccacagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcagtgcctgagcttcaacgccatcatggaggagctgggcatcagcctgaagaaccagaagaagatcaagaagaagagcagaaccaagggcaagagcagcttcaccagcatcctgacctgccaccagagaagaacccagagaaaggagaccgtggcctag

SEQ ID NO: 83148 - DNA, 2247 bp, Artificial Sequence
  Description of Artificial Sequence: Synthetic coding sequence
atggagcacggcaccctgctggcccagcccggcctgtggaccagagacaccagctgggccctgctgtacttcctgtgctacatcctgccccagaccgccccccaggtgctgagaatcgcctgcgaccagctggccctgggcgtggccgccctgttcggccccagccacagcagcagcgtgagcgccgtgcagagcatctgcaacgccctggaggtgccccacatccagaccagatggaagcaccccagcgtggacaacaaggacctgttctacatcaacctgtaccccgactacgccgccatcagcagagccatcctggacctggtgctgtactacaactggaagaccgtgaccgtggtgtacgaggacagcaccggcctgatcagactgcaggagctgatcaaggcccccagcagatacaacatcaagatcaagatcagacagctgcccagcggcaacaaggacgccaagcccctgctgaaggagatgaagaagggcaaggagttctacgtgatcttcgactgcagccacgagaccgccgccgagatcctgaagcagatcctgttcatgggcatgatgaccgagtactaccactacttcttcaccaccctggacctgttcgccctggacctggagctgtacagatacagcggcgtgaacatgaccggcttcagactgctgaacatcgacaacccccacgtgagcagcatcatcgagaagtggagcatggagagactgcaggccccccccagacccgagaccggcctgctggacggcatgatgaccaccgaggccgccctgatgtacgacgccgtgtacatggtggccatcgccagccacagagccagccagctgaccgtgagcagcctgcagtgccacagacacaagccctggagactgggccccagattcatgaacctgatcaaggaggccagatgggacggcctgaccggccacatcaccttcaacaagaccaacggcctgagaaaggacttcgacctggacatcatcagcctgaaggaggagggcaccgagaagatcggcatctggaacagcaacagcggcctgaacatgaccgacagcaacaaggacaagagcagcaacatcaccgacagcctggccaacagaaccctgatcgtgaccaccatcctgagagccgacctggccgtggcccccctgaccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacgtgctgctggcctgcctgggcgtgagctgcgtgctgttcgtgatcgccagattcaccccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgagagacggcagcaccatgaccttcttcaagaagagcaagatcagcacctacgagaagatgtgggccttcatgagcagcagacagcagaccgccctggtgagaaacagcgacgagggcatccagagagtgctgaccaccgactacgccctgctgatggagagcaccagcatcgagtacgtgacccagagaaactgcaacctgacccagatcggcggcctgatcgacagcaagggctacggcgtgggcacccccatcggcagcccctacagagacaagatcaccatcgccatcctgcagctgcaggaggagggcaagctgcacatgatgaaggagaagtggtggagaggcaacggctgccccgaggaggacaacaaggaggccagcgccctgggcgtggagaacatcggcggcatcttcatcgtgctggccgccggcctggtgctgagcgtgttcgtggccatcggcgagttcatctacaagagcagaaagaacaacgacatcgagcagtgcctgagcttcaacgccatcatggaggagctgggcatcagcctgaagaaccagtag

SEQ ID NO: 83149 - DNA, 2610 bp, Artificial Sequence
  Description of Artificial Sequence: Synthetic coding sequence
atgaagatcatcttccccatcctgagcaaccccgtgttcagaagaaccgtgaagctgctgctgtgcctgctgtggatcggctacagccagggcaccacccacgtgctgagattcggcggcatcttcgagtacgtggagagcggccccatgggcgccgaggagctggccttcagattcgccgtgaacaccatcaacagaaacagaaccctgctgcccaacaccaccctgacctacgacacccagaagatcaacctgtacgacagcttcgaggccagcaagaaggcctgcgaccagctgagcctgggcgtggccgccatcttcggccccagccacagcagcagcgccaacgccgtgcagagcatctgcaacgccctgggcgtgccccacatccagaccagatggaagcaccaggtgagcgacaacaaggacagcttctacgtgagcctgtaccccgacttcagcagcctgagcagagccatcctggacctggtgcagttcttcaagtggaagaccgtgaccgtggtgtacgacgacagcaccggcctgatcagactgcaggagctgatcaaggcccccagcagatacaacctgagactgaagatcagacagctgcccgccgacaccaaggacgccaagcccctgctgaaggagatgaagagaggcaaggagttccacgtgatcttcgactgcagccacgagatggccgccggcatcctgaagcaggccctggccatgggcatgatgaccgagtactaccactacatcttcaccaccctggacctgttcgccctggacgtggagccctacagatacagcggcgtgaacatgaccggcttcagaatcctgaacaccgagaacacccaggtgagcagcatcatcgagaagtggagcatggagagactgcaggccccccccaagcccgacagcggcctgctggacggcttcatgaccaccgacgccgccctgatgtacgacgccgtgcacgtggtgagcgtggccgtgcagcagttcccccagatgaccgtgagcagcctgcagtgcaacagacacaagccctggagattcggcaccagattcatgagcctgatcaaggaggcccactgggagggcctgaccggcagaatcaccttcaacaagaccaacggcctgagaaccgacttcgacctggacgtgatcagcctgaaggaggagggcctggagaagatcggcacctgggaccccgccagcggcctgaacatgaccgagagccagaagggcaagcccgccaacatcaccgacagcctgagcaacagaagcctgatcgtgaccaccatcctggaggagccctacgtgctgttcaagaagagcgacaagcccctgtacggcaacgacagattcgagggctactgcatcgacctgctgagagagctgagcaccatcctgggcttcacctacgagatcagactggtggaggacggcaagtacggcgcccaggacgacgccaacggccagtggaacggcatggtgagagagctgatcgaccacaaggccgacctggccgtggcccccctggccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacatcctgctggcctacctgggcgtgagctgcgtgctgttcgtgatcgccagattcagcccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtggaggacggcgccaccatgaccttcttcaagaagagcaagatcagcacctacgacaagatgtgggccttcatgagcagcagaagacagagcgtgctggtgaagagcaacgaggagggcatccagagagtgctgaccagcgactacgccttcctgatggagagcaccaccatcgagttcgtgacccagagaaactgcaacctgacccagatcggcggcctgatcgacagcaagggctacggcgtgggcacccccatgggcagcccctacagagacaagatcaccatcgccatcctgcagctgcaggaggagggcaagctgcacatgatgaaggagaagtggtggagaggcaacggctgccccgaggaggagagcaaggaggccagcgccctgggcgtgcagaacatcggcggcatcttcatcgtgctggccgccggcctggtgctgagcgtgttcgtggccgtgggcgagttcctgtacaagagcaagaagaacgcccagctggagaaggagagcagcatctggctggtgcccccctaccaccccgacaccgtgtag

SEQ ID NO: 83150 - DNA, 2580 bp, Artificial Sequence
  Description of Artificial Sequence: Synthetic coding sequence
atgggcgccgaggagctggccttcagattcgccgtgaacaccatcaacagaaacagaaccctgctgcccaacaccaccctgacctacgacacccagaagatcaacctgtacgacagcttcgaggccagcaagaaggcctgcgaccagctgagcctgggcgtggccgccatcttcggccccagccacagcagcagcgccaacgccgtgcagagcatctgcaacgccctgggcgtgccccacatccagaccagatggaagcaccaggtgagcgacaacaaggacagcttctacgtgagcctgtaccccgacttcagcagcctgagcagagccatcctggacctggtgcagttcttcaagtggaagaccgtgaccgtggtgtacgacgacagcaccggcctgatcagactgcaggagctgatcaaggcccccagcagatacaacctgagactgaagatcagacagctgcccgccgacaccaaggacgccaagcccctgctgaaggagatgaagagaggcaaggagttccacgtgatcttcgactgcagccacgagatggccgccggcatcctgaagcaggccctggccatgggcatgatgaccgagtactaccactacatcttcaccaccctggacctgttcgccctggacgtggagccctacagatacagcggcgtgaacatgaccggcttcagaatcctgaacaccgagaacacccaggtgagcagcatcatcgagaagtggagcatggagagactgcaggccccccccaagcccgacagcggcctgctggacggcttcatgaccaccgacgccgccctgatgtacgacgccgtgcacgtggtgagcgtggccgtgcagcagttcccccagatgaccgtgagcagcctgcagtgcaacagacacaagccctggagattcggcaccagattcatgagcctgatcaaggaggcccactgggagggcctgaccggcagaatcaccttcaacaagaccaacggcctgagaaccgacttcgacctggacgtgatcagcctgaaggaggagggcctggagaagatcggcacctgggaccccgccagcggcctgaacatgaccgagagccagaagggcaagcccgccaacatcaccgacagcctgagcaacagaagcctgatcgtgaccaccatcctggaggagccctacgtgctgttcaagaagagcgacaagcccctgtacggcaacgacagattcgagggctactgcatcgacctgctgagagagctgagcaccatcctgggcttcacctacgagatcagactggtggaggacggcaagtacggcgcccaggacgacgccaacggccagtggaacggcatggtgagagagctgatcgaccacaaggccgacctggccgtggcccccctggccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacatcctgctggcctacctgggcgtgagctgcgtgctgttcgtgatcgccagattcagcccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtggaggacggcgccaccatgaccttcttcaagaagagcaagatcagcacctacgacaagatgtgggccttcatgagcagcagaagacagagcgtgctggtgaagagcaacgaggagggcatccagagagtgctgaccagcgactacgccttcctgatggagagcaccaccatcgagttcgtgacccagagaaactgcaacctgacccagatcggcggcctgatcgacagcaagggctacggcgtgggcacccccatgggcagcccctacagagacaagatcaccatcgccatcctgcagctgcaggaggagggcaagctgcacatgatgaaggagaagtggtggagaggcaacggctgccccgaggaggagagcaaggaggccagcgccctgggcgtgcagaacatcggcggcatcttcatcgtgctggccgccggcctggtgctgagcgtgttcgtggccgtgggcgagttcctgtacaagagcaagaagaacgcccagctggagaagagaagcttctgcagcgccatggtggaggagctgagaatgagcctgaagtgccagagaagactgaagcacaagccccaggcccccgtgatcgtgaagaccgaggaggtgatcaacatgcacaccttcaacgacagaagactgcccggcaaggagaccatggcctag

SEQ ID NO: 83151 - DNA, 2499 bp, Artificial Sequence
  Description of Artificial Sequence: Synthetic coding sequence
atgaagatcatcttccccatcctgagcaaccccgtgttcagaagaaccgtgaagctgctgctgtgcctgctgtggatcggctacagccagggcaccacccacgtgctgagattcggcggcatcttcgagtacgtggagagcggccccatgggcgccgaggagctggccttcagattcgccgtgaacaccatcaacagaaacagaaccctgctgcccaacaccaccctgacctacgacacccagaagatcaacctgtacgacagcttcgaggccagcaagaaggcctgcgaccagctgagcctgggcgtggccgccatcttcggccccagccacagcagcagcgccaacgccgtgcagagcatctgcaacgccctgggcgtgccccacatccagaccagatggaagcaccaggtgagcgacaacaaggacagcttctacgtgagcctgtaccccgacttcagcagcctgagcagagccatcctggacctggtgcagttcttcaagtggaagaccgtgaccgtggtgtacgacgacagcaccggcctgatcagactgcaggagctgatcaaggcccccagcagatacaacctgagactgaagatcagacagctgcccgccgacaccaaggacgccaagcccctgctgaaggagatgaagagaggcaaggagttccacgtgatcttcgactgcagccacgagatggccgccggcatcctgaagcaggccctggccatgggcatgatgaccgagtactaccactacatcttcaccaccctggacctgttcgccctggacgtggagccctacagatacagcggcgtgaacatgaccggcttcagaatcctgaacaccgagaacacccaggtgagcagcatcatcgagaagtggagcatggagagactgcaggccccccccaagcccgacagcggcctgctggacggcttcatgaccaccgacgccgccctgatgtacgacgccgtgcacgtggtgagcgtggccgtgcagcagttcccccagatgaccgtgagcagcctgcagtgcaacagacacaagccctggagattcggcaccagattcatgagcctgatcaaggaggcccactgggagggcctgaccggcagaatcaccttcaacaagaccaacggcctgagaaccgacttcgacctggacgtgatcagcctgaaggaggagggcctggagaagatcggcacctgggaccccgccagcggcctgaacatgaccgagagccagaagggcaagcccgccaacatcaccgacagcctgagcaacagaagcctgatcgtgaccaccatcctggaggagccctacgtgctgttcaagaagagcgacaagcccctgtacggcaacgacagattcgagggctactgcatcgacctgctgagagagctgagcaccatcctgggcttcacctacgagatcagactggtggaggacggcaagtacggcgcccaggacgacgccaacggccagtggaacggcatggtgagagagctgatcgaccacaaggccgacctggccgtggcccccctggccatcacctacgtgagagagaaggtgatcgacttcagcaagcccttcatgaccctgggcatcagcatcctgtacagaaagcccaacggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtggaggacggcgccaccatgaccttcttcaagaagagcaagatcagcacctacgacaagatgtgggccttcatgagcagcagaagacagagcgtgctggtgaagagcaacgaggagggcatccagagagtgctgaccagcgactacgccttcctgatggagagcaccaccatcgagttcgtgacccagagaaactgcaacctgacccagatcggcggcctgatcgacagcaagggctacggcgtgggcacccccatgggcagcccctacagagacaagatcaccatcgccatcctgcagctgcaggaggagggcaagctgcacatgatgaaggagaagtggtggagaggcaacggctgccccgaggaggagagcaaggaggccagcgccctgggcgtgcagaacatcggcggcatcttcatcgtgctggccgccggcctggtgctgagcgtgttcgtggccgtgggcgagttcctgtacaagagcaagaagaacgcccagctggagaagagaagcttctgcagcgccatggtggaggagctgagaatgagcctgaagtgccagagaagactgaagcacaagccccaggcccccgtgatcgtgaagaccgaggaggtgatcaacatgcacaccttcaacgacagaagactgcccggcaaggagaccatggcctag

SEQ ID NO: 83152 - DNA, 2679 bp, Artificial Sequence
  Description of Artificial Sequence: Synthetic coding sequence
atgaagatcatcttccccatcctgagcaaccccgtgttcagaagaaccgtgaagctgctgctgtgcctgctgtggatcggctacagccagggcaccacccacgtgctgagattcggcggcatcttcgagtacgtggagagcggccccatgggcgccgaggagctggccttcagattcgccgtgaacaccatcaacagaaacagaaccctgctgcccaacaccaccctgacctacgacacccagaagatcaacctgtacgacagcttcgaggccagcaagaaggcctgcgaccagctgagcctgggcgtggccgccatcttcggccccagccacagcagcagcgccaacgccgtgcagagcatctgcaacgccctgggcgtgccccacatccagaccagatggaagcaccaggtgagcgacaacaaggacagcttctacgtgagcctgtaccccgacttcagcagcctgagcagagccatcctggacctggtgcagttcttcaagtggaagaccgtgaccgtggtgtacgacgacagcaccggcctgatcagactgcaggagctgatcaaggcccccagcagatacaacctgagactgaagatcagacagctgcccgccgacaccaaggacgccaagcccctgctgaaggagatgaagagaggcaaggagttccacgtgatcttcgactgcagccacgagatggccgccggcatcctgaagcaggccctggccatgggcatgatgaccgagtactaccactacatcttcaccaccctggacctgttcgccctggacgtggagccctacagatacagcggcgtgaacatgaccggcttcagaatcctgaacaccgagaacacccaggtgagcagcatcatcgagaagtggagcatggagagactgcaggccccccccaagcccgacagcggcctgctggacggcttcatgaccaccgacgccgccctgatgtacgacgccgtgcacgtggtgagcgtggccgtgcagcagttcccccagatgaccgtgagcagcctgcagtgcaacagacacaagccctggagattcggcaccagattcatgagcctgatcaaggaggcccactgggagggcctgaccggcagaatcaccttcaacaagaccaacggcctgagaaccgacttcgacctggacgtgatcagcctgaaggaggagggcctggagaagatcggcacctgggaccccgccagcggcctgaacatgaccgagagccagaagggcaagcccgccaacatcaccgacagcctgagcaacagaagcctgatcgtgaccaccatcctggaggagccctacgtgctgttcaagaagagcgacaagcccctgtacggcaacgacagattcgagggctactgcatcgacctgctgagagagctgagcaccatcctgggcttcacctacgagatcagactggtggaggacggcaagtacggcgcccaggacgacgccaacggccagtggaacggcatggtgagagagctgatcgaccacaaggccgacctggccgtggcccccctggccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacatcctgctggcctacctgggcgtgagctgcgtgctgttcgtgatcgccagattcagcccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtggaggacggcgccaccatgaccttcttcaagaagagcaagatcagcacctacgacaagatgtgggccttcatgagcagcagaagacagagcgtgctggtgaagagcaacgaggagggcatccagagagtgctgaccagcgactacgccttcctgatggagagcaccaccatcgagttcgtgacccagagaaactgcaacctgacccagatcggcggcctgatcgacagcaagggctacggcgtgggcacccccatgggcagcccctacagagacaagatcaccatcgccatcctgcagctgcaggaggagggcaagctgcacatgatgaaggagaagtggtggagaggcaacggctgccccgaggaggagagcaaggaggccagcgccctgggcgtgcagaacatcggcggcatcttcatcgtgctggccgccggcctggtgctgagcgtgttcgtggccgtgggcgagttcctgtacaagagcaagaagaacgcccagctggagaagagagccaagaccaagctgccccaggactacgtgttcctgcccatcctggagagcgtgagcatcagcaccgtgctgagcagcagccccagcagcagcagcctgagcagctgcagctag

SEQ ID NO: 83153 - DNA, 1755 bp, Artificial Sequence
  Description of Artificial Sequence: Synthetic coding sequence
atgaagatcatcttccccatcctgagcaaccccgtgttcagaagaaccgtgaagctgctgctgtgcctgctgtggatcggctacagccagggcaccacccacgtgctgagattcggcggcatcttcgagtacgtggagagcggccccatgggcgccgaggagctggccttcagattcgccgtgaacaccatcaacagaaacagaaccctgctgcccaacaccaccctgacctacgacacccagaagatcaacctgtacgacagcttcgaggccagcaagaaggcctgcgaccagctgagcctgggcgtggccgccatcttcggccccagccacagcagcagcgccaacgccgtgcagagcatctgcaacgccctgggcgtgccccacatccagaccagatggaagcaccaggtgagcgacaacaaggacagcttctacgtgagcctgtaccccgacttcagcagcctgagcagagccatcctggacctggtgcagttcttcaagtggaagaccgtgaccgtggtgtacgacgacagcaccggcctgatcagactgcaggagctgatcaaggcccccagcagatacaacctgagactgaagatcagacagctgcccgccgacaccaaggacgccaagcccctgctgaaggagatgaagagaggcaaggagttccacgtgatcttcgactgcagccacgagatggccgccggcatcctgaagcaggccctggccatgggcatgatgaccgagtactaccactacatcttcaccaccctggacctgttcgccctggacgtggagccctacagatacagcggcgtgaacatgaccggcttcagaatcctgaacaccgagaacacccaggtgagcagcatcatcgagaagtggagcatggagagactgcaggccccccccaagcccgacagcggcctgctggacggcttcatgaccaccgacgccgccctgatgtacgacgccgtgcacgtggtgagcgtggccgtgcagcagttcccccagatgaccgtgagcagcctgcagtgcaacagacacaagccctggagattcggcaccagattcatgagcctgatcaaggaggcccactgggagggcctgaccggcagaatcaccttcaacaagaccaacggcctgagaaccgacttcgacctggacgtgatcagcctgaaggaggagggcctggagaagatcggcacctgggaccccgccagcggcctgaacatgaccgagagccagaagggcaagcccgccaacatcaccgacagcctgagcaacagaagcctgatcgtgaccaccatcctggaggagccctacgtgctgttcaagaagagcgacaagcccctgtacggcaacgacagattcgagggctactgcatcgacctgctgagagagctgagcaccatcctgggcttcacctacgagatcagactggtggaggacggcaagtacggcgcccaggacgacgccaacggccagtggaacggcatggtgagagagctgatcgaccacaaggccgacctggccgtggcccccctggccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacatcctgctggcctacctgggcgtgagctgcgtgctgttcgtgatcgccagattctag

SEQ ID NO: 83154 - DNA, 2610 bp, Artificial Sequence; identical to SEQ ID NO: 83149
  Description of Artificial Sequence: Synthetic coding sequence

SEQ ID NO: 83155 - DNA, 2727 bp, Artificial Sequence
  Description of Artificial Sequence: Synthetic coding sequence
atgaagatcatcttccccatcctgagcaaccccgtgttcagaagaaccgtgaagctgctgctgtgcctgctgtggatcggctacagccagggcaccacccacgtgctgagattcggcggcatcttcgagtacgtggagagcggccccatgggcgccgaggagctggccttcagattcgccgtgaacaccatcaacagaaacagaaccctgctgcccaacaccaccctgacctacgacacccagaagatcaacctgtacgacagcttcgaggccagcaagaaggcctgcgaccagctgagcctgggcgtggccgccatcttcggccccagccacagcagcagcgccaacgccgtgcagagcatctgcaacgccctgggcgtgccccacatccagaccagatggaagcaccaggtgagcgacaacaaggacagcttctacgtgagcctgtaccccgacttcagcagcctgagcagagccatcctggacctggtgcagttcttcaagtggaagaccgtgaccgtggtgtacgacgacagcaccggcctgatcagactgcaggagctgatcaaggcccccagcagatacaacctgagactgaagatcagacagctgcccgccgacaccaaggacgccaagcccctgctgaaggagatgaagagaggcaaggagttccacgtgatcttcgactgcagccacgagatggccgccggcatcctgaagcaggccctggccatgggcatgatgaccgagtactaccactacatcttcaccaccctggacctgttcgccctggacgtggagccctacagatacagcggcgtgaacatgaccggcttcagaatcctgaacaccgagaacacccaggtgagcagcatcatcgagaagtggagcatggagagactgcaggccccccccaagcccgacagcggcctgctggacggcttcatgaccaccgacgccgccctgatgtacgacgccgtgcacgtggtgagcgtggccgtgcagcagttcccccagatgaccgtgagcagcctgcagtgcaacagacacaagccctggagattcggcaccagattcatgagcctgatcaaggaggcccactgggagggcctgaccggcagaatcaccttcaacaagaccaacggcctgagaaccgacttcgacctggacgtgatcagcctgaaggaggagggcctggagaagatcggcacctgggaccccgccagcggcctgaacatgaccgagagccagaagggcaagcccgccaacatcaccgacagcctgagcaacagaagcctgatcgtgaccaccatcctggaggagccctacgtgctgttcaagaagagcgacaagcccctgtacggcaacgacagattcgagggctactgcatcgacctgctgagagagctgagcaccatcctgggcttcacctacgagatcagactggtggaggacggcaagtacggcgcccaggacgacgccaacggccagtggaacggcatggtgagagagctgatcgaccacaaggccgacctggccgtggcccccctggccatcacctacgtgagagagaaggtgatcgacttcagcaagcccttcatgaccctgggcatcagcatcctgtacagaaagcccaacggcaccaaccccggcgtgttcagcttcctgaaccccctgagccccgacatctggatgtacatcctgctggcctacctgggcgtgagctgcgtgctgttcgtgatcgccagattcagcccctacgagtggtacaacccccacccctgcaaccccgacagcgacgtggtggagaacaacttcaccctgctgaacagcttctggttcggcgtgggcgccctgatgcagcagggcagcgagctgatgcccaaggccctgagcaccagaatcgtgggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtggaggacggcgccaccatgaccttcttcaagaagagcaagatcagcacctacgacaagatgtgggccttcatgagcagcagaagacagagcgtgctggtgaagagcaacgaggagggcatccagagagtgctgaccagcgactacgccttcctgatggagagcaccaccatcgagttcgtgacccagagaaactgcaacctgacccagatcggcggcctgatcgacagcaagggctacggcgtgggcacccccatgggcagcccctacagagacaagatcaccatcgccatcctgcagctgcaggaggagggcaagctgcacatgatgaaggagaagtggtggagaggcaacggctgccccgaggaggagagcaaggaggccagcgccctgggcgtgcagaacatcggcggcatcttcatcgtgctggccgccggcctggtgctgagcgtgttcgtggccgtgggcgagttcctgtacaagagcaagaagaacgcccagctggagaagagaagcttctgcagcgccatggtggaggagctgagaatgagcctgaagtgccagagaagactgaagcacaagccccaggcccccgtgatcgtgaagaccgaggaggtgatcaacatgcacaccttcaacgacagaagactgcccggcaaggagaccatggcctag

SEQ ID NO: 83156 - DNA, 1935 bp, Artificial Sequence
  Description of Artificial Sequence: Synthetic coding sequence
ggcggcatcttcgagtacgtggagagcggccccatgggcgccgaggagctggccttcagattcgccgtgaacaccatcaacagaaacagaaccctgctgcccaacaccaccctgacctacgacacccagaagatcaacctgtacgacagcttcgaggccagcaagaaggcctgcgaccagctgagcctgggcgtggccgccatcttcggccccagccacagcagcagcgccaacgccgtgcagagcatctgcaacgccctgggcgtgccccacatccagaccagatggaagcaccaggtgagcgacaacaaggacagcttctacgtgagcctgtaccccgacttcagcagcctgagcagagccatcctggacctggtgcagttcttcaagtggaagaccgtgaccgtggtgtacgacgacagcaccggcctgatcagactgcaggagctgatcaaggcccccagcagatacaacctgagactgaagatcagacagctgcccgccgacaccaaggacgccaagcccctgctgaaggagatgaagagaggcaaggagttccacgtgatcttcgactgcagccacgagatggccgccggcatcctgaagcaggccctggccatgggcatgatgaccgagtactaccactacatcttcaccaccctggacctgttcgccctggacgtggagccctacagatacagcggcgtgaacatgaccggcttcagaatcctgaacaccgagaacacccaggtgagcagcatcatcgagaagtggagcatggagagactgcaggccccccccaagcccgacagcggcctgctggacggcttcatgaccaccgacgccgccctgatgtacgacgccgtgcacgtggtgagcgtggccgtgcagcagttcccccagatgaccgtgagcagcctgcagtgcaacagacacaagccctggagattcggcaccagattcatgagcctgatcaaggaggcccactgggagggcctgaccggcagaatcaccttcaacaagaccaacggcctgagaaccgacttcgacctggacgtgatcagcctgaaggaggagggcctggagaagatcggcacctgggaccccgccagcggcctgaacatgaccgagagccagaagggcaagcccgccaacatcaccgacagcctgagcaacagaagcctgatcgtgaccaccatcctggaggagccctacgtgctgttcaagaagagcgacaagcccctgtacggcaacgacagattcgagggctactgcatcgacctgctgagagagctgagcaccatcctgggcttcacctacgagatcagactggtggaggacggcaagtacggcgcccaggacgacgccaacggccagtggaacggcatggtgagagagctgatcgaccacaagagcaagatcagcacctacgacaagatgtgggccttcatgagcagcagaagacagagcgtgctggtgaagagcaacgaggagggcatccagagagtgctgaccagcgactacgccttcctgatggagagcaccaccatcgagttcgtgacccagagaaactgcaacctgacccagatcggcggcctgatcgacagcaagggctacggcgtgggcacccccatgggcagcccctacagagacaagatcaccatcgccatcctgcagctgcaggaggagggcaagctgcacatgatgaaggagaagtggtggagaggcaacggctgccccgaggaggagagcaaggaggccagcgccctgggcgtgcagaacatcggcggcatcttcatcgtgctggccgccggcctggtgctgagcgtgttcgtggccgtgggcgagttcctgtacaagagcaagaagaacgcccagctggagaaggagagcagcatctggctggtgcccccctaccaccccgacaccgtgtag

SEQ ID NO: 83157 - DNA, 2760 bp, Artificial Sequence
  Description of Artificial Sequence: Synthetic coding sequence
atgaccgccccctggagaagactgagaagcctggtgtgggagtactgggccggcctgctggtgtgcgccttctggatccccgacagcagaggcatgccccacgtgatcagaatcggcggcatcttcgagtacgccgacggccccaacgcccaggtgatgaacgccgaggagcacgccttcagattcagcgccaacatcatcaacagaaacagaaccctgctgcccaacaccaccctgacctacgacatccagagaatccacttccacgacagcttcgaggccaccaagaaggcctgcgaccagctggccctgggcgtggtggccatcttcggccccagccagggcagctgcaccaacgccgtgcagagcatctgcaacgccctggaggtgccccacatccagctgagatggaagcaccaccccctggacaacaaggacaccttctacgtgaacctgtaccccgactacgccagcctgagccacgccatcctggacctggtgcagtacctgaagtggagaagcgccaccgtggtgtacgacgacagcaccggcctgatcagactgcaggagctgatcatggcccccagcagatacaacatcagactgaagatcagacagctgcccatcgacagcgacgacagcagacccctgctgaaggagatgaagagaggcagagagttcagaatcatcttcgactgcagccacaccatggccgcccagatcctgaagcaggccatggccatgggcatgatgaccgagtactaccacttcatcttcaccaccctggacctgtacgccctggacctggagccctacagatacagcggcgtgaacctgaccggcttcagaatcctgaacgtggacaacccccacgtgagcgccatcgtggagaagtggagcatggagagactgcaggccgcccccagaagcgagagcggcctgctggacggcgtgatgatgaccgacgccgccctgctgtacgacgccgtgcacatcgtgagcgtgtgctaccagagagccccccagatgaccgtgaacagcctgcagtgccacagacacaaggcctggagattcggcggcagattcatgaacttcatcaaggaggcccagtgggagggcctgaccggcagaatcgtgttcaacaagaccagcggcctgagaaccgacttcgacctggacatcatcagcctgaaggaggacggcctggagaaggtgggcgtgtggagccccgccgacggcctgaacatcaccgaggtggccaagggcagaggccccaacgtgaccgacagcctgaccaacagaagcctgatcgtgaccaccgtgctggaggagcccttcgtgatgttcagaaagagcgacagaaccctgtacggcaacgacagattcgagggctactgcatcgacctgctgaaggagctggcccacatcctgggcttcagctacgagatcagactggtggaggacggcaagtacggcgcccaggacgacaagggccagtggaacggcatggtgaaggagctgatcgaccacaaggccgacctggccgtggcccccctgaccatcacccacgtgagagagaaggccatcgacttcagcaagcccttcatgaccctgggcgtgagcatcctgtacagaaagcccaacggcaccaaccccagcgtgttcagcttcctgaaccccctgagccccgacatctggatgtacgtgctgctggcctacctgggcgtgagctgcgtgctgttcgtgatcgccagattcagcccctacgagtggtacgacgcccacccctgcaaccccggcagcgaggtggtggagaacaacttcaccctgctgaacagcttctggttcggcatgggcagcctgatgcagcagggcagcgagctgatgcccaaggccctgagcaccagaatcatcggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgaaggacggcgccaccatgaccttcttcaagaagagcaagatcagcaccttcgagaagatgtgggccttcatgagcagcaagcccagcgccctggtgaagaacaacgaggagggcatccagagagccctgaccgccgactacgccctgctgatggagagcaccaccatcgagtacgtgacccagagaaactgcaacctgacccagatcggcggcctgatcgacagcaagggctacggcatcggcacccccatgggcagcccctacagagacaagatcaccatcgccatcctgcagctgcaggaggaggacaagctgcacatcatgaaggagaagtggtggagaggcagcggctgccccgaggaggagaacaaggaggccagcgccctgggcatccagaagatcggcggcatcttcatcgtgctggccgccggcctggtgctgagcgtgctggtggccgtgggcgagttcgtgtacaagctgagaaagaccgccgagagagagcagagaagcttctgcagcaccgtggccgacgagatcagattcagcctgacctgccagagaagagtgaagcacaagccccagccccccatgatggtgaagaccgacgccgtgatcaacatgcacaccttcaacgacagaagactgcccggcaaggacagcatggcctgcagcaccagcctggcccccgtgttcccctag

SEQ ID NO: 83158 - DNA, 2619 bp, Artificial Sequence
  Description of Artificial Sequence: Synthetic coding sequence
atgaccgccccctggagaagactgagaagcctggtgtgggagtactgggccggcctgctggtgtgcgccttctggatccccgacagcagaggcatgccccacgtgatcagaatcggcggcatcttcgagtacgccgacggccccaacgcccaggtgatgaacgccgaggagcacgccttcagattcagcgccaacatcatcaacagaaacagaaccctgctgcccaacaccaccctgacctacgacatccagagaatccacttccacgacagcttcgaggccaccaagaaggcctgcgaccagctggccctgggcgtggtggccatcttcggccccagccagggcagctgcaccaacgccgtgcagagcatctgcaacgccctggaggtgccccacatccagctgagatggaagcaccaccccctggacaacaaggacaccttctacgtgaacctgtaccccgactacgccagcctgagccacgccatcctggacctggtgcagtacctgaagtggagaagcgccaccgtggtgtacgacgacagcaccggcctgatcagactgcaggagctgatcatggcccccagcagatacaacatcagactgaagatcagacagctgcccatcgacagcgacgacagcagacccctgctgaaggagatgaagagaggcagagagttcagaatcatcttcgactgcagccacaccatggccgcccagatcctgaagcaggccatggccatgggcatgatgaccgagtactaccacttcatcttcaccaccctggacctgtacgccctggacctggagccctacagatacagcggcgtgaacctgaccggcttcagaatcctgaacgtggacaacccccacgtgagcgccatcgtggagaagtggagcatggagagactgcaggccgcccccagaagcgagagcggcctgctggacggcgtgatgatgaccgacgccgccctgctgtacgacgccgtgcacatcgtgagcgtgtgctaccagagagccccccagatgaccgtgaacagcctgcagtgccacagacacaaggcctggagattcggcggcagattcatgaacttcatcaaggaggcccagtgggagggcctgaccggcagaatcgtgttcaacaagaccagcggcctgagaaccgacttcgacctggacatcatcagcctgaaggaggacggcctggagaaggtgggcgtgtggagccccgccgacggcctgaacatcaccgaggtggccaagggcagaggccccaacgtgaccgacagcctgaccaacagaagcctgatcgtgaccaccgtgctggaggagcccttcgtgatgttcagaaagagcgacagaaccctgtacggcaacgacagattcgagggctactgcatcgacctgctgaaggagctggcccacatcctgggcttcagctacgagatcagactggtggaggacggcaagtacggcgcccaggacgacaagggccagtggaacggcatggtgaaggagctgatcgaccacaaggccgacctggccgtggcccccctgaccatcacccacgtgagagagaaggccatcgacttcagcaagcccttcatgaccctgggcgtgagcatcctgtacagaaagcccaacggcaccaaccccagcgtgttcagcttcctgaaccccctgagccccgacatctggatgtacgtgctgctggcctacctgggcgtgagctgcgtgctgttcgtgatcgccagattcagcccctacgagtggtacgacgcccacccctgcaaccccggcagcgaggtggtggagaacaacttcaccctgctgaacagcttctggttcggcatgggcagcctgatgcagcagggcagcgagctgatgcccaaggccctgagcaccagaatcatcggcggcatctggtggttcttcaccctgatcatcatcagcagctacaccgccaacctggccgccttcctgaccgtggagagaatggagagccccatcgacagcgccgacgacctggccaagcagaccaagatcgagtacggcgccgtgaaggacggcgccaccatgaccttcttcaagaagagcaagatcagcaccttcgagaagatgtgggccttcatgagcagcaagcccagcgccctggtgaagaacaacgaggagggcatccagagagccctgaccgccgactacgccctgctgatggagagcaccaccatcgagtacgtgacccagagaaactgcaacctgacccagatcggcggcctgatcgacagcaagggctacggcatcggcacccccatgggcagcccctacagagacaagatcaccatcgccatcctgcagctgcaggaggaggacaagctgcacatcatgaaggagaagtggtggagaggcagcggctgccccgaggaggagaacaaggaggccagcgccctgggcatccagaagatcggcggcatcttcatcgtgctggccgccggcctggtgctgagcgtgctggtggccgtgggcgagttcgtgtacaagctgagaaagaccgccgagagagagcaggtgagcctgagagcctggagcctgcacagaatgggcaacggcgacagcagatag

SEQ ID NO: 83159 - DNA, 2871 bp, Artificial Sequence
  Description of Artificial Sequence: Synthetic coding sequence
atgcccagagtgagcgcccccctggtgctgctgcccgcctggctggtgatggtggcctgcagcccccacagcctgagaatcgccgccatcctggacgaccccatggagtgcagcagaggcgagagactgagcatcaccctggccaagaacagaatcaacagagcccccgagagactgggcaaggccaaggtggaggtggacatcttcgagctgctgagagacagcgagtacgagaccgccgagaccatgtgccagatcctgcccaagggcgtggtggccgtgctgggccccagcagcagccccgccagcagcagcatcatcagcaacatctgcggcgagaaggaggtgccccacttcaaggtggcccccgaggagttcgtgaagttccagttccagagattcaccaccctgaacctgcaccccagcaacaccgacatcagcgtggccgtggccggcatcctgaacttcttcaactgcaccaccgcctgcctgatctgcgccaaggccgagtgcctgctgaacctggagaagctgctgagacagttcctgatcagcaaggacaccctgagcgtgagaatgctggacgacaccagagaccccacccccctgctgaaggagatcagagacgacaagaccgccaccatcatcatccacgccaacgccagcatgagccacaccatcctgctgaaggccgccgagctgggcatggtgagcgcctactacacctacatcttcaccaacctggagttcagcctgcagagaatggacagcctggtggacgacagagtgaacatcctgggcttcagcatcttcaaccagagccacgccttcttccaggagttcgcccagagcctgaaccagagctggcaggagaactgcgaccacgtgcccttcaccggccccgccctgagcagcgccctgctgttcgacgccgtgtacgccgtggtgaccgccgtgcaggagctgaacagaagccaggagatcggcgtgaagcccctgagctgcggcagcgcccagatctggcagcacggcaccagcctgatgaactacctgagaatggtggagctggagggcctgaccggccacatcgagttcaacagcaagggccagagaagcaactacgccctgaagatcctgcagttcaccagaaacggcttcagacagatcggccagtggcacgtggccgagggcctgagcatggacagccacctgtacgccagcaacatcagcgacaccctgttcaacaccaccctggtggtgaccaccatcctggagaacccctacctgatgctgaagggcaaccaccaggagatggagggcaacgacagatacgagggcttctgcgtggacatgctgaaggagctggccgagatcctgagattcaactacaagatcagactggtgggcgacggcgtgtacggcgtgcccgaggccaacggcacctggaccggcatggtgggcgagctgatcgccagaaaggccgacctggccgtggccggcctgaccatcaccgccgagagagagaaggtgatcgacttcagcaagcccttcatgaccctgggcatcagcatcctgtacagagtgcacatgggcagaaagcccggctacttcagcttcctggaccccttcagccccggcgtgtggctgttcatgctgctggcctacctggccgtgagctgcgtgctgttcctggtggccagactgaccccctacgagtggtacagcccccacccctgcgcccagggcagatgcaacctgctggtgaaccagtacagcctgggcaacagcctgtggttccccgtgggcggcttcatgcagcagggcagcaccatcgcccccagagccctgagcaccagatgcgtgagcggcgtgtggtgggccttcaccctgatcatcatcagcagctacaccgccaacctggccgccttcctgaccgtgcagagaatggacgtgcccatcgagagcgtggacgacctggccgaccagaccgccatcgagtacggcaccatccacggcggcagcagcatgaccttcttccagaacagcagataccagacctaccagagaatgtggaactacatgtacagcaagcagcccagcgtgttcgtgaagagcaccgaggagggcatcgccagagtgctgaacagcaactacgccttcctgctggagagcaccatgaacgagtactacagacagagaaactgcaacctgacccagatcggcggcctgctggacaccaagggctacggcatcggcatgcccgtgggcagcgtgttcagagacgagttcgacctggccatcctgcagctgcaggagaacaacagactggagatcctgaagagaaagtggtgggagggcggcaagtgccccaaggaggaggaccacagagccaagggcctgggcatggagaacatcggcggcatcttcgtggtgctgatctgcggcctgatcgtggccatcttcatggccatgctggagttcctgtggaccctgagacacagcgaggccaccgaggtgagcgtgtgccaggagatggtgaccgagctgagaagcatcatcctgtgccaggacagcatccaccccagaagaagaagagccgccgtgcccccccccagaccccccatccccgaggagagaagacccagaggcaccgccaccctgagcaacggcaagctgtgcggcgccggcgagcccgaccagctggcccagagactggcccaggaggccgccctggtggccagaggctgcacccacatcagagtgtgccccgagtgcagaagattccagggcctgagagccagacccagccccgccagaagcgaggagagcctggagtgggagaagaccaccaacagcagcgagcccgagtag

SEQ ID NO: 83160 - DNA, 2871 bp, Artificial Sequence; identical to SEQ ID NO: 83159
  Description of Artificial Sequence: Synthetic coding sequence

SEQ ID NO: 83161 - DNA, 2943 bp, Artificial Sequence
  Description of Artificial Sequence: Synthetic coding sequence
atgcccgccgagctgctgctgctgctgatcgtggccttcgccagccccagctgccaggtgctgagcagcctgagaatggccgccatcctggacgaccagaccgtgtgcggcagaggcgagagactggccctggccctggccagagagcagatcaacggcatcatcgaggtgcccgccaaggccagagtggaggtggacatcttcgagctgcagagagacagccagtacgagaccaccgacaccatgtgccagatcctgcccaagggcgtggtgagcgtgctgggccccagcagcagccccgccagcgccagcaccgtgagccacatctgcggcgagaaggagatcccccacatcaaggtgggccccgaggagacccccagactgcagtacctgagattcgccagcgtgagcctgtaccccagcaacgaggacgtgagcctggccgtgagcagaatcctgaagagcttcaactaccccagcgccagcctgatctgcgccaaggccgagtgcctgctgagactggaggagctggtgagaggcttcctgatcagcaaggagaccctgagcgtgagaatgctggacgacagcagagaccccacccccctgctgaaggagatcagagacgacaaggtgagcaccatcatcatcgacgccaacgccagcatcagccacctgatcctgagaaaggccagcgagctgggcatgaccagcgccttctacaagtacatcctgaccaccatggacttccccatcctgcacctggacggcatcgtggaggacagcagcaacatcctgggcttcagcatgttcaacaccagccaccccttctaccccgagttcgtgagaagcctgaacatgagctggagagagaactgcgaggccagcacctacctgggccccgccctgagcgccgccctgatgttcgacgccgtgcacgtggtggtgagcgccgtgagagagctgaacagaagccaggagatcggcgtgaagcccctggcctgcaccagcgccaacatctggccccacggcaccagcctgatgaactacctgagaatggtggagtacgacggcctgaccggcagagtggagttcaacagcaagggccagagaaccaactacaccctgagaatcctggagaagagcagacagggccacagagagatcggcgtgtggtacagcaacagaaccctggccatgaacgccaccaccctggacatcaacctgagccagaccctggccaacaagaccctggtggtgaccaccatcctggagaacccctacgtgatgagaagacccaacttccaggccctgagcggcaacgagagattcgagggcttctgcgtggacatgctgagagagctggccgagctgctgagattcagatacagactgagactggtggaggacggcctgtacggcgcccccgagcccaacggcagctggaccggcatggtgggcgagctgatcaacagaaaggccgacctggccgtggccgccttcaccatcaccgccgagagagagaaggtgatcgacttcagcaagcccttcatgaccctgggcatcagcatcctgtacagagtgcacatgggcagaaagcccggctacttcagcttcctggaccccttcagccccgccgtgtggctgttcatgctgctggcctacctggccgtgagctgcgtgctgttcctggccgccagactgagcccctacgagtggtacaacccccacccctgcctgagagccagaccccacatcctggagaaccagtacaccctgggcaacagcctgtggttccccgtgggcggcttcatgcagcagggcagcgagatcatgcccagagccctgagcaccagatgcgtgagcggcgtgtggtgggccttcaccctgatcatcatcagcagctacaccgccaacctggccgccttcctgaccgtgcagagaatggaggtgcccgtggagagcgccgacgacctggccgaccagaccaacatcgagtacggcaccatccacgccggcagcaccatgaccttcttccagaacagcagataccagacctaccagagaatgtggaactacatgcagagcaagcagcccagcgtgttcgtgaagagcaccgaggagggcatcgccagagtgctgaacagcagatacgccttcctgctggagagcaccatgaacgagtaccacagaagactgaactgcaacctgacccagatcggcggcctgctggacaccaagggctacggcatcggcatgcccctgggcagccccttcagagacgagatcaccctggccatcctgcagctgcaggagaacaacagactggagatcctgaagagaaagtggtgggagggcggcagatgccccaaggaggaggaccacagagccaagggcctgggcatggagaacatcggcggcatcttcatcgtgctgatctgcggcctgatcatcgccgtgttcgtggccgtgatggagttcatctggagcaccagaagaagcgccgagagcgaggaggtgagcgtgtgccaggagatgctgcaggagctgagacacgccgtgagctgcagaaagaccagcagaagcagaagaagaagaagacccggcggccccagcagagccctgctgagcctgagagccgtgagagagatgagactgagcaacggcaagctgtacagcgccggcgccggcggcgacgccggcagcgcccacggcggcccccagagactgctggacgaccccggcccccccagcggcgccagacccgccgcccccaccccctgcacccacgtgagagtgtgccaggagtgcagaagaatccaggccctgagagccagcggcgccggcgccccccccagaggcctgggcgtgcccgccgaggccaccagcccccccagacccagacccggccccgccggccccagagagctggccgagcacgagtag

SEQ ID NO: 83162 - DNA, 2946 bp, Artificial Sequence
  Description of Artificial Sequence: Synthetic coding sequence
atgcccgccgagctgctgctgctgctgatcgtggccttcgccagccccagctgccaggtgctgagcagcctgagaatggccgccatcctggacgaccagaccgtgtgcggcagaggcgagagactggccctggccctggccagagagcagatcaacggcatcatcgaggtgcccgccaaggccagagtggaggtggacatcttcgagctgcagagagacagccagtacgagaccaccgacaccatgtgccagatcctgcccaagggcgtggtgagcgtgctgggccccagcagcagccccgccagcgccagcaccgtgagccacatctgcggcgagaaggagatcccccacatcaaggtgggccccgaggagacccccagactgcagtacctgagattcgccagcgtgagcctgtaccccagcaacgaggacgtgagcctggccgtgagcagaatcctgaagagcttcaactaccccagcgccagcctgatctgcgccaaggccgagtgcctgctgagactggaggagctggtgagaggcttcctgatcagcaaggagaccctgagcgtgagaatgctggacgacagcagagaccccacccccctgctgaaggagatcagagacgacaaggtgagcaccatcatcatcgacgccaacgccagcatcagccacctgatcctgagaaaggccagcgagctgggcatgaccagcgccttctacaagtacatcctgaccaccatggacttccccatcctgcacctggacggcatcgtggaggacagcagcaacatcctgggcttcagcatgttcaacaccagccaccccttctaccccgagttcgtgagaagcctgaacatgagctggagagagaactgcgaggccagcacctacctgggccccgccctgagcgccgccctgatgttcgacgccgtgcacgtggtggtgagcgccgtgagagagctgaacagaagccaggagatcggcgtgaagcccctggcctgcaccagcgccaacatctggccccacggcaccagcctgatgaactacctgagaatggtggagtacgacggcctgaccggcagagtggagttcaacagcaagggccagagaaccaactacaccctgagaatcctggagaagagcagacagggccacagagagatcggcgtgtggtacagcaacagaaccctggccatgaacgccaccaccctggacatcaacctgagccagaccctggccaacaagaccctggtggtgaccaccatcctggagaacccctacgtgatgagaagacccaacttccaggccctgagcggcaacgagagattcgagggcttctgcgtggacatgctgagagagctggccgagctgctgagattcagatacagactgagactggtggaggacggcctgtacggcgcccccgagcccaacggcagctggaccggcatggtgggcgagctgatcaacagaaaggccgacctggccgtggccgccttcaccatcaccgccgagagagagaaggtgatcgacttcagcaagcccttcatgaccctgggcatcagcatcctgtacagagtgcacatgggcagaaagcccggctacttcagcttcctggaccccttcagccccgccgtgtggctgttcatgctgctggcctacctggccgtgagctgcgtgctgttcctggccgccagactgagcccctacgagtggtacaacccccacccctgcctgagagccagaccccacatcctggagaaccagtacaccctgggcaacagcctgtggttccccgtgggcggcttcatgcagcagggcagcgagatcatgcccagagccctgagcaccagatgcgtgagcggcgtgtggtgggccttcaccctgatcatcatcagcagctacaccgccaacctggccgccttcctgaccgtgcagagaatggaggtgcccgtggagagcgccgacgacctggccgaccagaccaacatcgagtacggcaccatccacgccggcagcaccatgaccttcttccagaacagcagataccagacctaccagagaatgtggaactacatgcagagcaagcagcccagcgtgttcgtgaagagcaccgaggagggcatcgccagagtgctgaacagcagatacgccttcctgctggagagcaccatgaacgagtaccacagaagactgaactgcaacctgacccagatcggcggcctgctggacaccaagggctacggcatcggcatgcccctgggcagccccttcagagacgagatcaccctggccatcctgcagctgcaggagaacaacagactggagatcctgaagagaaagtggtgggagggcggcagatgccccaaggaggaggaccacagagccaagggcctgggcatggagaacatcggcggcatcttcatcgtgctgatctgcggcctgatcatcgccgtgttcgtggccgtgatggagttcatctggagcaccagaagaagcgccgagagcgaggagacccccgccctgcaccccgccgcctgccagtgcagcgccctgggccccagaacccccctgaaggagcccagcatgctgctggtgaaggtgcccagcaccagagtgcaggtggccttcagcagaaccagcctgagacaggtgtgccccttcctgctgcagcaccagctgagcagcctgtactggatccaggccaccaacgtgcagatctgctgccacttcagcagcctgaagcccagccccgacctgaccttcccccccagccacagacccctgagcagcctgctgttcaccgccctggccgccgtgggcggcctgcccgacgccagcagcttcttcttcccccccatcagcagctgcccccccctgcagagcggcatcggcccctgccacagcaccgaggccaccctggtgaccagcaacttccacgtgtag

SEQ ID NO: 83163 - DNA, 1077 bp, Artificial Sequence
  Description of Artificial Sequence: Synthetic coding sequence
tgatgggccttcaccctgatcatcatcagcagctacaccgccaacctggccgccttcctgaccgtgcagagaatggaggtgcccgtggagagcgccgacgacctggccgaccagaccaacatcgagtacggcaccatccacgccggcagcaccatgaccttcttccagaacagcagataccagacctaccagagaatgtggaactacatgcagagcaagcagcccagcgtgttcgtgaagagcaccgaggagggcatcgccagagtgctgaacagcagatacgccttcctgctggagagcaccatgaacgagtaccacagaagactgaactgcaacctgacccagatcggcggcctgctggacaccaagggctacggcatcggcatgcccctgggcagccccttcagagacgagatcaccctggccatcctgcagctgcaggagaacaacagactggagatcctgaagagaaagtggtgggagggcggcagatgccccaaggaggaggaccacagagccaagggcctgggcatggagaacatcggcggcatcttcatcgtgctgatctgcggcctgatcatcgccgtgttcgtggccgtgatggagttcatctggagcaccagaagaagcgccgagagcgaggagacccccgccctgcaccccgccgcctgccagtgcagcgccctgggccccagaacccccctgaaggagcccagcatgctgctggtgaaggtgcccagcaccagagtgcaggtggccttcagcagaaccagcctgagacaggtgtgccccttcctgctgcagcaccagctgagcagcctgtactggatccaggccaccaacgtgcagatctgctgccacttcagcagcctgaagcccagccccgacctgaccttcccccccagccacagacccctgagcagcctgctgttcaccgccctggccgccgtgggcggcctgcccgacgccagcagcttcttcttcccccccatcagcagctgcccccccctgcagagcggcatcggcccctgccacagcaccgaggccaccctggtgaccagcaacttccacgtgtag

SEQ ID NO: 83164 - DNA, 2769 bp, Artificial Sequence
  Description of Artificial Sequence: Synthetic coding sequence
atgagcaccatgagactgctgaccctggccctgctgttcagctgcagcgtggccagagccgcctgcgaccccaagatcgtgaacatcggcgccgtgctgagcaccagaaagcacgagcagatgttcagagaggccgtgaaccaggccaacaagagacacggcagctggaagatccagctgaacgccaccagcgtgacccacaagcccaacgccatccagatggccctgagcgtgtgcgaggacctgatcagcagccaggtgtacgccatcctggtgagccacccccccacccccaacgaccacttcacccccacccccgtgagctacaccgccggcttctacagaatccccgtgctgggcctgaccaccagaatgagcatctacagcgacaagagcatccacctgagcttcctgagaaccgtgcccccctacagccaccagagcagcgtgtggttcgagatgatgagagtgtacagctggaaccacatcatcctgctggtgagcgacgaccacgagggcagagccgcccagaagagactggagaccctgctggaggagagagagagcaaggccgagaaggtgctgcagttcgaccccggcaccaagaacgtgaccgccctgctgatggaggccaaggagctggaggccagagtgatcatcctgagcgccagcgaggacgacgccgccaccgtgtacagagccgccgccatgctgaacatgaccggcagcggctacgtgtggctggtgggcgagagagagatcagcggcaacgccctgagatacgcccccgacggcatcctgggcctgcagctgatcaacggcaagaacgagagcgcccacatcagcgacgccgtgggcgtggtggcccaggccgtgcacgagctgctggagaaggagaacatcaccgacccccccagaggctgcgtgggcaacaccaacatctggaagaccggccccctgttcaagagagtgctgatgagcagcaagtacgccgacggcgtgaccggcagagtggagttcaacgaggacggcgacagaaagttcgccaactacagcatcatgaacctgcagaacagaaagctggtgcaggtgggcatctacaacggcacccacgtgatccccaacgacagaaagatcatctggcccggcggcgagaccgagaagcccagaggctaccagatgagcaccagactgaagatcgtgaccatccaccaggagcccttcgtgtacgtgaagcccaccctgagcgacggcacctgcaaggaggagttcaccgtgaacggcgaccccgtgaagaaggtgatctgcaccggccccaacgacaccagccccggcagccccagacacaccgtgccccagtgctgctacggcttctgcatcgacctgctgatcaagctggccagaaccatgaacttcacctacgaggtgcacctggtggccgacggcaagttcggcacccaggagagagtgaacaacagcaacaagaaggagtggaacggcatgatgggcgagctgctgagcggccaggccgacatgatcgtggcccccctgaccatcaacaacgagagagcccagtacatcgagttcagcaagcccttcaagtaccagggcctgaccatcctggtgaagaaggagatccccagaagcaccctggacagcttcatgcagcccttccagagcaccctgtggctgctggtgggcctgagcgtgcacgtggtggccgtgatgctgtacctgctggacagattcagccccttcggcagattcaaggtgaacagcgaggaggaggaggaggacgccctgaccctgagcagcgccatgtggttcagctggggcgtgctgctgaacagcggcatcggcgagggcgcccccagaagcttcagcgccagaatcctgggcatggtgtgggccggcttcgccatgatcatcgtggccagctacaccgccaacctggccgccttcctggtgctggacagacccgaggagagaatcaccggcatcaacgaccccagactgagaaaccccagcgacaagttcatctacgccaccgtgaagcagagcagcgtggacatctacttcagaagacaggtggagctgagcaccatgtacagacacatggagaagcacaactacgagagcgccgccgaggccatccaggccgtgagagacaacaagctgcacgccttcatctgggacagcgccgtgctggagttcgaggccagccagaagtgcgacctggtgaccaccggcgagctgttcttcagaagcggcttcggcatcggcatgagaaaggacagcccctggaagcagaacgtgagcctgagcatcctgaagagccacgagaacggcttcatggaggacctggacaagacctgggtgagataccaggagtgcgacagcagaagcaacgcccccgccaccctgaccttcgagaacatggccggcgtgttcatgctggtggccggcggcatcgtggccggcatcttcctgatcttcatcgagatcgcctacaagagacacaaggacgccagaagaaagcagatgcagctggccttcgccgccgtgaacgtgtggagaaagaacctgcaggacagaaagagcggcagagccgagcccgaccccaagaagaaggccaccttcagagccatcaccagcaccctggccagcagcttcaagagaagaagaagcagcaaggacacccagtaccaccccaccgacatcaccggccccctgaacctgagcgaccccagcgtgagcaccgtggtgtag

SEQ ID NO: 83165 - DNA, 2730 bp, Artificial Sequence
  Description of Artificial Sequence: Synthetic coding sequence
atgagcaccatgagactgctgaccctggccctgctgttcagctgcagcgtggccagagccgcctgcgaccccaagatcgtgaacatcggcgccgtgctgagcaccagaaagcacgagcagatgttcagagaggccgtgaaccaggccaacaagagacacggcagctggaagatccagctgaacgccaccagcgtgacccacaagcccaacgccatccagatggccctgagcgtgtgcgaggacctgatcagcagccaggtgtacgccatcctggtgagccacccccccacccccaacgaccacttcacccccacccccgtgagctacaccgccggcttctacagaatccccgtgctgggcctgaccaccagaatgagcatctacagcgacaagagcatccacctgagcttcctgagaaccgtgcccccctacagccaccagagcagcgtgtggttcgagatgatgagagtgtacagctggaaccacatcatcctgctggtgagcgacgaccacgagggcagagccgcccagaagagactggagaccctgctggaggagagagagagcaaggccgagaaggtgctgcagttcgaccccggcaccaagaacgtgaccgccctgctgatggaggccaaggagctggaggccagagtgatcatcctgagcgccagcgaggacgacgccgccaccgtgtacagagccgccgccatgctgaacatgaccggcagcggctacgtgtggctggtgggcgagagagagatcagcggcaacgccctgagatacgcccccgacggcatcctgggcctgcagctgatcaacggcaagaacgagagcgcccacatcagcgacgccgtgggcgtggtggcccaggccgtgcacgagctgctggagaaggagaacatcaccgacccccccagaggctgcgtgggcaacaccaacatctggaagaccggccccctgttcaagagagtgctgatgagcagcaagtacgccgacggcgtgaccggcagagtggagttcaacgaggacggcgacagaaagttcgccaactacagcatcatgaacctgcagaacagaaagctggtgcaggtgggcatctacaacggcacccacgtgatccccaacgacagaaagatcatctggcccggcggcgagaccgagaagcccagaggctaccagatgagcaccagactgaagatcgtgaccatccaccaggagcccttcgtgtacgtgaagcccaccctgagcgacggcacctgcaaggaggagttcaccgtgaacggcgaccccgtgaagaaggtgatctgcaccggccccaacgacaccagccccggcagccccagacacaccgtgccccagtgctgctacggcttctgcatcgacctgctgatcaagctggccagaaccatgaacttcacctacgaggtgcacctggtggccgacggcaagttcggcacccaggagagagtgaacaacagcaacaagaaggagtggaacggcatgatgggcgagctgctgagcggccaggccgacatgatcgtggcccccctgaccatcaacaacgagagagcccagtacatcgagttcagcaagcccttcaagtaccagggcctgaccatcctggtgaagaaggagatccccagaagcaccctggacagcttcatgcagcccttccagagcaccctgtggctgctggtgggcctgagcgtgcacgtggtggccgtgatgctgtacctgctggacagattcagccccttcggcagattcaaggtgaacagcgaggaggaggaggaggacgccctgaccctgagcagcgccatgtggttcagctggggcgtgctgctgaacagcggcatcggcgagggcgcccccagaagcttcagcgccagaatcctgggcatggtgtgggccggcttcgccatgatcatcgtggccagctacaccgccaacctggccgccttcctggtgctggacagacccgaggagagaatcaccggcatcaacgaccccagactgagaaaccccagcgacaagttcatctacgccaccgtgaagcagagcagcgtggacatctacttcagaagacaggtggagctgagcaccatgtacagacacatggagaagcacaactacgagagcgccgccgaggccatccaggccgtgagagacaacaagctgcacgccttcatctgggacagcgccgtgctggagttcgaggccagccagaagtgcgacctggtgaccaccggcgagctgttcttcagaagcggcttcggcatcggcatgagaaaggacagcccctggaagcagaacgtgagcctgagcatcctgaagagccacgagaacggcttcatggaggacctggacaagacctgggtgagataccaggagtgcgacagcagaagcaacgcccccgccaccctgaccttcgagaacatggccggcgtgttcatgctggtggccggcggcatcgtggccggcatcttcctgatcttcatcgagatcgcctacaagagacacaaggacgccagaagaaagcagatgcagctggccttcgccgccgtgaacgtgtggagaaagaacctgcaggtgggccaggccaccctgagaggcctggtgcccagagccagacccggccacggccccccccccagccccaaggccgtggccctggccctggccctggtgggcagaaccggcgccagaagccacggccagggccagtggtag

SEQ ID NO: 83166 - DNA, 2832 bp, Artificial Sequence
  Description of Artificial Sequence: Synthetic coding sequence
atgagcaccatgagactgctgaccctggccctgctgttcagctgcagcgtggccagagccgcctgcgaccccaagatcgtgaacatcggcgccgtgctgagcaccagaaagcacgagcagatgttcagagaggccgtgaaccaggccaacaagagacacggcagctggaagatccagctgaacgccaccagcgtgacccacaagcccaacgccatccagatggccctgagcgtgtgcgaggacctgatcagcagccaggtgtacgccatcctggtgagccacccccccacccccaacgaccacttcacccccacccccgtgagctacaccgccggcttctacagaatccccgtgctgggcctgaccaccagaatgagcatctacagcgacaagagcatccacctgagcttcctgagaaccgtgcccccctacagccaccagagcagcgtgtggttcgagatgatgagagtgtacagctggaaccacatcatcctgctggtgagcgacgaccacgagggcagagccgcccagaagagactggagaccctgctggaggagagagagagcaagagcaagaagagaaactacgagaacctggaccagctgagctacgacaacaagagaggccccaaggccgagaaggtgctgcagttcgaccccggcaccaagaacgtgaccgccctgctgatggaggccaaggagctggaggccagagtgatcatcctgagcgccagcgaggacgacgccgccaccgtgtacagagccgccgccatgctgaacatgaccggcagcggctacgtgtggctggtgggcgagagagagatcagcggcaacgccctgagatacgcccccgacggcatcctgggcctgcagctgatcaacggcaagaacgagagcgcccacatcagcgacgccgtgggcgtggtggcccaggccgtgcacgagctgctggagaaggagaacatcaccgacccccccagaggctgcgtgggcaacaccaacatctggaagaccggccccctgttcaagagagtgctgatgagcagcaagtacgccgacggcgtgaccggcagagtggagttcaacgaggacggcgacagaaagttcgccaactacagcatcatgaacctgcagaacagaaagctggtgcaggtgggcatctacaacggcacccacgtgatccccaacgacagaaagatcatctggcccggcggcgagaccgagaagcccagaggctaccagatgagcaccagactgaagatcgtgaccatccaccaggagcccttcgtgtacgtgaagcccaccctgagcgacggcacctgcaaggaggagttcaccgtgaacggcgaccccgtgaagaaggtgatctgcaccggccccaacgacaccagccccggcagccccagacacaccgtgccccagtgctgctacggcttctgcatcgacctgctgatcaagctggccagaaccatgaacttcacctacgaggtgcacctggtggccgacggcaagttcggcacccaggagagagtgaacaacagcaacaagaaggagtggaacggcatgatgggcgagctgctgagcggccaggccgacatgatcgtggcccccctgaccatcaacaacgagagagcccagtacatcgagttcagcaagcccttcaagtaccagggcctgaccatcctggtgaagaaggagatccccagaagcaccctggacagcttcatgcagcccttccagagcaccctgtggctgctggtgggcctgagcgtgcacgtggtggccgtgatgctgtacctgctggacagattcagccccttcggcagattcaaggtgaacagcgaggaggaggaggaggacgccctgaccctgagcagcgccatgtggttcagctggggcgtgctgctgaacagcggcatcggcgagggcgcccccagaagcttcagcgccagaatcctgggcatggtgtgggccggcttcgccatgatcatcgtggccagctacaccgccaacctggccgccttcctggtgctggacagacccgaggagagaatcaccggcatcaacgaccccagactgagaaaccccagcgacaagttcatctacgccaccgtgaagcagagcagcgtggacatctacttcagaagacaggtggagctgagcaccatgtacagacacatggagaagcacaactacgagagcgccgccgaggccatccaggccgtgagagacaacaagctgcacgccttcatctgggacagcgccgtgctggagttcgaggccagccagaagtgcgacctggtgaccaccggcgagctgttcttcagaagcggcttcggcatcggcatgagaaaggacagcccctggaagcagaacgtgagcctgagcatcctgaagagccacgagaacggcttcatggaggacctggacaagacctgggtgagataccaggagtgcgacagcagaagcaacgcccccgccaccctgaccttcgagaacatggccggcgtgttcatgctggtggccggcggcatcgtggccggcatcttcctgatcttcatcgagatcgcctacaagagacacaaggacgccagaagaaagcagatgcagctggccttcgccgccgtgaacgtgtggagaaagaacctgcaggacagaaagagcggcagagccgagcccgaccccaagaagaaggccaccttcagagccatcaccagcaccctggccagcagcttcaagagaagaagaagcagcaaggacacccagtaccaccccaccgacatcaccggccccctgaacctgagcgaccccagcgtgagcaccgtggtgtag

SEQ ID NO: 83167 - DNA, 2769 bp, Artificial Sequence
  Description of Artificial Sequence: Synthetic coding sequence
atgagcaccatgagactgctgaccctggccctgctgttcagctgcagcgtggccagagccgcctgcgaccccaagatcgtgaacatcggcgccgtgctgagcaccagaaagcacgagcagatgttcagagaggccgtgaaccaggccaacaagagacacggcagctggaagatccagctgaacgccaccagcgtgacccacaagcccaacgccatccagatggccctgagcgtgtgcgaggacctgatcagcagccaggtgtacgccatcctggtgagccacccccccacccccaacgaccacttcacccccacccccgtgagctacaccgccggcttctacagaatccccgtgctgggcctgaccaccagaatgagcatctacagcgacaagagcatccacctgagcttcctgagaaccgtgcccccctacagccaccagagcagcgtgtggttcgagatgatgagagtgtacagctggaaccacatcatcctgctggtgagcgacgaccacgagggcagagccgcccagaagagactggagaccctgctggaggagagagagagcaagagcaagaagagaaactacgagaacctggaccagctgagctacgacaacaagagaggccccaaggccgagaaggtgctgcagttcgaccccggcaccaagaacgtgaccgccctgctgatggaggccaaggagctggaggccagagtgatcatcctgagcgccagcgaggacgacgccgccaccgtgtacagagccgccgccatgctgaacatgaccggcagcggctacgtgtggctggtgggcgagagagagatcagcggcaacgccctgagatacgcccccgacggcatcctgggcctgcagctgatcaacggcaagaacgagagcgcccacatcagcgacgccgtgggcgtggtggcccaggccgtgcacgagctgctggagaaggagaacatcaccgacccccccagaggctgcgtgggcaacaccaacatctggaagaccggccccctgttcaagagagtgctgatgagcagcaagtacgccgacggcgtgaccggcagagtggagttcaacgaggacggcgacagaaagttcgccaactacagcatcatgaacctgcagaacagaaagctggtgcaggtgggcatctacaacggcacccacgtgatccccaacgacagaaagatcatctggcccggcggcgagaccgagaagcccagaggctaccagatgagcaccagactgaagatcgtgaccatccaccaggagcccttcgtgtacgtgaagcccaccctgagcgacggcacctgcaaggaggagttcaccgtgaacggcgaccccgtgaagaaggtgatctgcaccggccccaacgacaccagccccggcagccccagacacaccgtgccccagtgctgctacggcttctgcatcgacctgctgatcaagctggccagaaccatgaacttcacctacgaggtgcacctggtggccgacggcaagttcggcacccaggagagagtgaacaacagcaacaagaaggagtggaacggcatgatgggcgagctgctgagcggccaggccgacatgatcgtggcccccctgaccatcaacaacgagagagcccagtacatcgagttcagcaagcccttcaagtaccagggcctgaccatcctggtgaagaaggagatccccagaagcaccctggacagcttcatgcagcccttccagagcaccctgtggctgctggtgggcctgagcgtgcacgtggtggccgtgatgctgtacctgctggacagattcagccccttcggcagattcaaggtgaacagcgaggaggaggaggaggacgccctgaccctgagcagcgccatgtggttcagctggggcgtgctgctgaacagcggcatcggcgagggcgcccccagaagcttcagcgccagaatcctgggcatggtgtgggccggcttcgccatgatcatcgtggccagctacaccgccaacctggccgccttcctggtgctggacagacccgaggagagaatcaccggcatcaacgaccccagactgagaaaccccagcgacaagttcatctacgccaccgtgaagcagagcagcgtggacatctacttcagaagacaggtggagctgagcaccatgtacagacacatggagaagcacaactacgagagcgccgccgaggccatccaggccgtgagagacaacaagctgcacgccttcatctgggacagcgccgtgctggagttcgaggccagccagaagtgcgacctggtgaccaccggcgagctgttcttcagaagcggcttcggcatcggcatgagaaaggacagcccctggaagcagaacgtgagcctgagcatcctgaagagccacgagaacggcttcatggaggacctggacaagacctgggtgagataccaggagtgcgacagcagaagcaacgcccccgccaccctgaccttcgagaacatggccggcgtgttcatgctggtggccggcggcatcgtggccggcatcttcctgatcttcatcgagatcgcctacaagagacacaaggacgccagaagaaagcagatgcagctggccttcgccgccgtgaacgtgtggagaaagaacctgcagagcaccggcggcggcagaggcgccctgcagaaccagaaggacaccgtgctgcccagaagagccatcgagagagaggagggccagctgcagctgtgcagcagacacagagagagctag

SEQ ID NO: 83168 - DNA, 2721 bp, Artificial Sequence
  Description of Artificial Sequence: Synthetic coding sequence
atgagcaccatgagactgctgaccctggccctgctgttcagctgcagcgtggccagagccgcctgcgaccccaagatcgtgaacatcggcgccgtgctgagcaccagaaagcacgagcagatgttcagagaggccgtgaaccaggccaacaagagacacggcagctggaagatccagctgaacgccaccagcgtgacccacaagcccaacgccatccagatggccctgagcgtgtgcgaggacctgatcagcagccaggtgtacgccatcctggtgagccacccccccacccccaacgaccacttcacccccacccccgtgagctacaccgccggcttctacagaatccccgtgctgggcctgaccaccagaatgagcatctacagcgacaagagcatccacctgagcttcctgagaaccgtgcccccctacagccaccagagcagcgtgtggttcgagatgatgagagtgtacagctggaaccacatcatcctgctggtgagcgacgaccacgagggcagagccgcccagaagagactggagaccctgctggaggagagagagagcaagagcaagaagagaaactacgagaacctggaccagctgagctacgacaacaagagaggccccaaggccgagaaggtgctgcagttcgaccccggcaccaagaacgtgaccgccctgctgatggaggccaaggagctggaggccagagtgatcatcctgagcgccagcgaggacgacgccgccaccgtgtacagagccgccgccatgctgaacatgaccggcagcggctacgtgtggctggtgggcgagagagagatcagcggcaacgccctgagatacgcccccgacggcatcctgggcctgcagctgatcaacggcaagaacgagagcgcccacatcagcgacgccgtgggcgtggtggcccaggccgtgcacgagctgctggagaaggagaacatcaccgacccccccagaggctgcgtgggcaacaccaacatctggaagaccggccccctgttcaagagagtgctgatgagcagcaagtacgccgacggcgtgaccggcagagtggagttcaacgaggacggcgacagaaagttcgccaactacagcatcatgaacctgcagaacagaaagctggtgcaggtgggcatctacaacggcacccacgtgatccccaacgacagaaagatcatctggcccggcggcgagaccgagaagcccagaggctaccagatgagcaccagactgaagatcgtgaccatccaccaggagcccttcgtgtacgtgaagcccaccctgagcgacggcacctgcaaggaggagttcaccgtgaacggcgaccccgtgaagaaggtgatctgcaccggccccaacgacaccagccccggcagccccagacacaccgtgccccagtgctgctacggcttctgcatcgacctgctgatcaagctggccagaaccatgaacttcacctacgaggtgcacctggtggccgacggcaagttcggcacccaggagagagtgaacaacagcaacaagaaggagtggaacggcatgatgggcgagctgctgagcggccaggccgacatgatcgtggcccccctgaccatcaacaacgagagagcccagtacatcgagttcagcaagcccttcaagtaccagggcctgaccatcctggtgaagaaggagatccccagaagcaccctggacagcttcatgcagcccttccagagcaccctgtggctgctggtgggcctgagcgtgcacgtggtggccgtgatgctgtacctgctggacagattcagccccttcggcagattcaaggtgaacagcgaggaggaggaggaggacgccctgaccctgagcagcgccatgtggttcagctggggcgtgctgctgaacagcggcatcggcgagggcgcccccagaagcttcagcgccagaatcctgggcatggtgtgggccggcttcgccatgatcatcgtggccagctacaccgccaacctggccgccttcctggtgctggacagacccgaggagagaatcaccggcatcaacgaccccagactgagaaaccccagcgacaagttcatctacgccaccgtgaagcagagcagcgtggacatctacttcagaagacaggtggagctgagcaccatgtacagacacatggagaagcacaactacgagagcgccgccgaggccatccaggccgtgagagacaacaagctgcacgccttcatctgggacagcgccgtgctggagttcgaggccagccagaagtgcgacctggtgaccaccggcgagctgttcttcagaagcggcttcggcatcggcatgagaaaggacagcccctggaagcagaacgtgagcctgagcatcctgaagagccacgagaacggcttcatggaggacctggacaagacctgggtgagataccaggagtgcgacagcagaagcaacgcccccgccaccctgaccttcgagaacatggccggcgtgttcatgctggtggccggcggcatcgtggccggcatcttcctgatcttcatcgagatcgcctacaagagacacaaggacgccagaagaaagcagatgcagctggccttcgccgccgtgaacgtgtggagaaagaacctgcagcagtaccaccccaccgacatcaccggccccctgaacctgagcgaccccagcgtgagcaccgtggtgtag

SEQ ID NO: 83169 - DNA, 2817 bp, Artificial Sequence
  Description of Artificial Sequence: Synthetic coding sequence
atgagcaccatgagactgctgaccctggccctgctgttcagctgcagcgtggccagagccgcctgcgaccccaagatcgtgaacatcggcgccgtgctgagcaccagaaagcacgagcagatgttcagagaggccgtgaaccaggccaacaagagacacggcagctggaagatccagctgaacgccaccagcgtgacccacaagcccaacgccatccagatggccctgagcgtgtgcgaggacctgatcagcagccaggtgtacgccatcctggtgagccacccccccacccccaacgaccacttcacccccacccccgtgagctacaccgccggcttctacagaatccccgtgctgggcctgaccaccagaatgagcatctacagcgacaagagcatccacctgagcttcctgagaaccgtgcccccctacagccaccagagcagcgtgtggttcgagatgatgagagtgtacagctggaaccacatcatcctgctggtgagcgacgaccacgagggcagagccgcccagaagagactggagaccctgctggaggagagagagagcaaggccgagaaggtgctgcagttcgaccccggcaccaagaacgtgaccgccctgctgatggaggccaaggagctggaggccagagtgatcatcctgagcgccagcgaggacgacgccgccaccgtgtacagagccgccgccatgctgaacatgaccggcagcggctacgtgtggctggtgggcgagagagagatcagcggcaacgccctgagatacgcccccgacggcatcctgggcctgcagctgatcaacggcaagaacgagagcgcccacatcagcgacgccgtgggcgtggtggcccaggccgtgcacgagctgctggagaaggagaacatcaccgacccccccagaggctgcgtgggcaacaccaacatctggaagaccggccccctgttcaagagagtgctgatgagcagcaagtacgccgacggcgtgaccggcagagtggagttcaacgaggacggcgacagaaagttcgccaactacagcatcatgaacctgcagaacagaaagctggtgcaggtgggcatctacaacggcacccacgtgatccccaacgacagaaagatcatctggcccggcggcgagaccgagaagcccagaggctaccagatgagcaccagactgaagatcgtgaccatccaccaggagcccttcgtgtacgtgaagcccaccctgagcgacggcacctgcaaggaggagttcaccgtgaacggcgaccccgtgaagaaggtgatctgcaccggccccaacgacaccagccccggcagccccagacacaccgtgccccagtgctgctacggcttctgcatcgacctgctgatcaagctggccagaaccatgaacttcacctacgaggtgcacctggtggccgacggcaagttcggcacccaggagagagtgaacaacagcaacaagaaggagtggaacggcatgatgggcgagctgctgagcggccaggccgacatgatcgtggcccccctgaccatcaacaacgagagagcccagtacatcgagttcagcaagcccttcaagtaccagggcctgaccatcctggtgaagaaggagatccccagaagcaccctggacagcttcatgcagcccttccagagcaccctgtggctgctggtgggcctgagcgtgcacgtggtggccgtgatgctgtacctgctggacagattcagccccttcggcagattcaaggtgaacagcgaggaggaggaggaggacgccctgaccctgagcagcgccatgtggttcagctggggcgtgctgctgaacagcggcatcggcgagggcgcccccagaagcttcagcgccagaatcctgggcatggtgtgggccggcttcgccatgatcatcgtggccagctacaccgccaacctggccgccttcctggtgctggacagacccgaggagagaatcaccggcatcaacgaccccagactgagaaaccccagcgacaagttcatctacgccaccgtgaagcagagcagcgtggacatctacttcagaagacaggtggagctgagcaccatgtacagacacatggagaagcacaactacgagagcgccgccgaggccatccaggccgtgagagacaacaagctgcacgccttcatctgggacagcgccgtgctggagttcgaggccagccagaagtgcgacctggtgaccaccggcgagctgttcttcagaagcggcttcggcatcggcatgagaaaggacagcccctggaagcagaacgtgagcctgagcatcctgaagagccacgagaacggcttcatggaggacctggacaagacctgggtgagataccaggagtgcgacagcagaagcaacgcccccgccaccctgaccttcgagaacatggccggcgtgttcatgctggtggccggcggcatcgtggccggcatcttcctgatcttcatcgagatcgcctacaagagacacaaggacgccagaagaaagcagatgcagctggccttcgccgccgtgaacgtgtggagaaagaacctgcaggacagaaagagcggcagagccgagcccgaccccaagaagaaggccaccttcagagccatcaccagcaccctggccagcagcttcaagagaagaagaagcagcaaggacaccagcaccggcggcggcagaggcgccctgcagaaccagaaggacaccgtgctgcccagaagagccatcgagagagaggagggccagctgcagctgtgcagcagacacagagagagctag

SEQ ID NO: 83170 - DNA, 4395 bp, Artificial Sequence
  Description of Artificial Sequence: Synthetic coding sequence
atgggcagagtgggctactggaccctgctggtgctgcccgccctgctggtgtggagaggccccgcccccagcgccgccgccgagaagggcccccccgccctgaacatcgccgtgatgctgggccacagccacgacgtgaccgagagagagctgagaaccctgtggggccccgagcaggccgccggcctgcccctggacgtgaacgtggtggccctgctgatgaacagaaccgaccccaagagcctgatcacccacgtgtgcgacctgatgagcggcgccagaatccacggcctggtgttcggcgacgacaccgaccaggaggccgtggcccagatgctggacttcatcagcagccacaccttcgtgcccatcctgggcatccacggcggcgccagcatgatcatggccgacaaggaccccaccagcaccttcttccagttcggcgccagcatccagcagcaggccaccgtgatgctgaagatcatgcaggactacgactggcacgtgttcagcctggtgaccaccatcttccccggctacagagagttcatcagcttcgtgaagaccaccgtggacaacagcttcgtgggctgggacatgcagaacgtgatcaccctggacaccagcttcgaggacgccaagacccaggtgcagctgaagaagatccacagcagcgtgatcctgctgtactgcagcaaggacgaggccgtgctgatcctgagcgaggccagaagcctgggcctgaccggctacgacttcttctggatcgtgcccagcctggtgagcggcaacaccgagctgatccccaaggagttccccagcggcctgatcagcgtgagctacgacgactgggactacagcctggaggccagagtgagagacggcatcggcatcctgaccaccgccgccagcagcatgctggagaagttcagctacatccccgaggccaaggccagctgctacggccagatggagagacccgaggtgcccatgcacaccctgcaccccttcatggtgaacgtgacctgggacggcaaggacctgagcttcaccgaggagggctaccaggtgcaccccagactggtggtgatcgtgctgaacaaggacagagagtgggagaaggtgggcaagtgggagaaccacaccctgagcctgagacacgccgtgtggcccagatacaagagcttcagcgactgcgagcccgacgacaaccacctgagcatcgtgaccctggaggaggcccccttcgtgatcgtggaggacatcgaccccctgaccgagacctgcgtgagaaacaccgtgccctgcagaaagttcgtgaagatcaacaacagcaccaacgagggcatgaacgtgaagaagtgctgcaagggcttctgcatcgacatcctgaagaagctgagcagaaccgtgaagttcacctacgacctgtacctggtgaccaacggcaagcacggcaagaaggtgaacaacgtgtggaacggcatgatcggcgaggtggtgtaccagagagccgtgatggccgtgggcagcctgaccatcaacgaggagagaagcgaggtggtggacttcagcgtgcccttcgtggagaccggcatcagcgtgatggtgagcagaagcaacggcaccgtgagccccagcgccttcctggagcccttcagcgccagcgtgtgggtgatgatgttcgtgatgctgctgatcgtgagcgccatcgccgtgttcgtgttcgagtacttcagccccgtgggctacaacagaaacctggccaagggcaaggccccccacggccccagcttcaccatcggcaaggccatctggctgctgtggggcctggtgttcaacaacagcgtgcccgtgcagaaccccaagggcaccaccagcaagatcatggtgagcgtgtgggccttcttcgccgtgatcttcctggccagctacaccgccaacctggccgccttcatgatccaggaggagttcgtggaccaggtgaccggcctgagcgacaagaagttccagagaccccacgactacagcccccccttcagattcggcaccgtgcccaacggcagcaccgagagaaacatcagaaacaactacccctacatgcaccagtacatgaccaagttcaaccagaagggcgtggaggacgccctggtgagcctgaagaccggcaagctggacgccttcatctacgacgccgccgtgctgaactacaaggccggcagagacgagggctgcaagctggtgaccatcggcagcggctacatcttcgccaccaccggctacggcatcgccctgcagaagggcagcccctggaagagacagatcgacctggccctgctgcagttcgtgggcgacggcgagatggaggagctggagaccctgtggctgaccggcatctgccacaacgagaagaacgaggtgatgagcagccagctggacatcgacaacatggccggcgtgttctacatgctggccgccgccatggccctgagcctgatcaccttcatctgggagcacctgttctactggaagctgagattctgcttcaccggcgtgtgcagcgacagacccggcctgctgttcagcatcagcagaggcatctacagctgcatccacggcgtgcacatcgaggagaagaagaagagccccgacttcaacctgaccggcagccagagcaacatgctgaagctgctgagaagcgccaagaacatcagcagcatgagcaacatgaacagcagcagaatggacagccccaagagagccgccgacttcatccagagaggcagcctgatcatggacatggtgagcgacaagggcaacctgatgtacagcgacaacagaagcttccagggcaaggagagcatcttcggcgacaacatgaacgagctgcagaccttcgtggccaacagacagaaggacaacctgaacaactacgtgttccagggccagcaccccctgaccctgaacgagagcaaccccaacaccgtggaggtggccgtgagcaccgagagcaaggccaacagcagacccagacagctgtggaagaagagcgtggacagcatcagacaggacagcctgagccagaaccccgtgagccagagagacgaggccaccgccgagaacagaacccacagcctgaagagccccagatacctgcccgaggagatggcccacagcgacatcagcgagaccagcaacagagccacctgccacagagagcccgacaacagcaagaaccacaagaccaaggacaacttcaagagaagcgtggccagcaagtaccccaaggactgcagcgaggtggagagaacctacctgaagaccaagagcagcagccccagagacaagatctacaccatcgacggcgagaaggagcccggcttccacctggaccccccccagttcgtggagaacgtgaccctgcccgagaacgtggacttccccgacccctaccaggaccccagcgagaacttcagaaagggcgacagcaccctgcccatgaacagaaaccccctgcacaacgaggagggcctgagcaacaacgaccagtacaagctgtacagcaagcacttcaccctgaaggacaagggcagcccccacagcgagaccagcgagagatacagacagaacagcacccactgcagaagctgcctgagcaacatgcccacctacagcggccacttcaccatgagaagccccttcaagtgcgacgcctgcctgagaatgggcaacctgtacgacatcgacgaggaccagatgctgcaggagaccggcaaccccgccaccggcgagcaggtgtaccagcaggactgggcccagaacaacgccctgcagctgcagaagaacaagctgagaatcagcagacagcacagctacgacaacatcgtggacaagcccagagagctggacctgagcagacccagcagaagcatcagcctgaaggacagagagagactgctggagggcaacttctacggcagcctgttcagcgtgcccagcagcaagctgagcggcaagaagagcagcctgttcccccagggcctggaggacagcaagagaagcaagagcctgctgcccgaccacaccagcgacaaccccttcctgcacagccacagagacgaccagagactggtgatcggcagatgccccagcgacccctacaagcacagcctgcccagccaggccgtgaacgacagctacctgagaagcagcctgagaagcaccgccagctactgcagcagagacagcagaggccacaacgacgtgtacatcagcgagcacgtgatgccctacgccgccaacaagaacaacatgtacagcacccccagagtgctgaacagctgcagcaacagaagagtgtacaagaagatgcccagcatcgagagcgacgtgtag

SEQ ID NO: 83171 - DNA, 4395 bp, Artificial Sequence; identical to SEQ ID NO: 83170
  Description of Artificial Sequence: Synthetic coding sequence

SEQ ID NO: 83172 - DNA, 4395 bp, Artificial Sequence; identical to SEQ ID NO: 83170
  Description of Artificial Sequence: Synthetic coding sequence

SEQ ID NO: 83173 - DNA, 3846 bp, Artificial Sequence
  Description of Artificial Sequence: Synthetic coding sequence
atgggcagagtgggctactggaccctgctggtgctgcccgccctgctggtgtggagaggccccgcccccagcgccgccgccgagaagggcccccccgccctgaacatcgccgtgatgctgggccacagccacgacgtgaccgagagagagctgagaaccctgtggggccccgagcaggccgccggcctgcccctggacgtgaacgtggtggccctgctgatgaacagaaccgaccccaagagcctgatcacccacgtgtgcgacctgatgagcggcgccagaatccacggcctggtgttcggcgacgacaccgaccaggaggccgtggcccagatgctggacttcatcagcagccacaccttcgtgcccatcctgggcatccacggcggcgccagcatgatcatggccgacaaggaccccaccagcaccttcttccagttcggcgccagcatccagcagcaggccaccgtgatgctgaagatcatgcaggactacgactggcacgtgttcagcctggtgaccaccatcttccccggctacagagagttcatcagcttcgtgaagaccaccgtggacaacagcttcgtgggctgggacatgcagaacgtgatcaccctggacaccagcttcgaggacgccaagacccaggtgcagctgaagaagatccacagcagcgtgatcctgctgtactgcagcaaggacgaggccgtgctgatcctgagcgaggccagaagcctgggcctgaccggctacgacttcttctggatcgtgcccagcctggtgagcggcaacaccgagctgatccccaaggagttccccagcggcctgatcagcgtgagctacgacgactgggactacagcctggaggccagagtgagagacggcatcggcatcctgaccaccgccgccagcagcatgctggagaagttcagctacatccccgaggccaaggccagctgctacggccagatggagagacccgaggtgcccatgcacaccctgcaccccttcatggtgaacgtgacctgggacggcaaggacctgagcttcaccgaggagggctaccaggtgcaccccagactggtggtgatcgtgctgaacaaggacagagagtgggagaaggtgggcaagtgggagaaccacaccctgagcctgagacacgccgtgtggcccagatacaagagcttcagcgactgcgagcccgacgacaaccacctgagcatcgtgaccctggaggaggcccccttcgtgatcgtggaggacatcgaccccctgaccgagacctgcgtgagaaacaccgtgccctgcagaaagttcgtgaagatcaacaacagcaccaacgagggcatgaacgtgaagaagtgctgcaagggcttctgcatcgacatcctgaagaagctgagcagaaccgtgaagttcacctacgacctgtacctggtgaccaacggcaagcacggcaagaaggtgaacaacgtgtggaacggcatgatcggcgaggtggtgtaccagagagccgtgatggccgtgggcagcctgaccatcaacgaggagagaagcgaggtggtggacttcagcgtgcccttcgtggagaccggcatcagcgtgatggtgagcagaagcaacggcaccgtgagccccagcgccttcctggagcccttcagcgccagcgtgtgggtgatgatgttcgtgatgctgctgatcgtgagcgccatcgccgtgttcgtgttcgagtacttcagccccgtgggctacaacagaaacctggccaagggcaaggccccccacggccccagcttcaccatcggcaaggccatctggctgctgtggggcctggtgttcaacaacagcgtgcccgtgcagaaccccaagggcaccaccagcaagatcatggtgagcgtgtgggccttcttcgccgtgatcttcctggccagctacaccgccaacctggccgccttcatgatccaggaggagttcgtggaccaggtgaccggcctgagcgacaagaagttccagagaccccacgactacagcccccccttcagattcggcaccgtgcccaacggcagcaccgagagaaacatcagaaacaactacccctacatgcaccagtacatgaccaagttcaaccagaagggcgtggaggacgccctggtgagcctgaagaccggcaagctggacgccttcatctacgacgccgccgtgctgaactacaaggccggcagagacgagggctgcaagctggtgaccatcggcagcggctacatcttcgccaccaccggctacggcatcgccctgcagaagggcagcccctggaagagacagatcgacctggccctgctgcagttcgtgggcgacggcgagatggaggagctggagaccctgtggctgaccggcatctgccacaacgagaagaacgaggtgatgagcagccagctggacatcgacaacatggccggcgtgttctacatgctggccgccgccatggccctgagcctgatcaccttcatctgggagcacctgttctactggaagctgagattctgcttcaccggcgtgtgcagcgacagacccggcctgctgttcagcatcagcagaggcatctacagctgcatccacggcgtgcacatcgaggagaagaagaagagccccgacttcaacctgaccggcagccagagcaacatgctgaagctgctgagaagcgccaagaacatcagcagcatgagcaacatgaacagcagcagaatggacagccccaagagagccgccgacttcatccagagaggcagcctgatcatggacatggtgagcgacaagggcaacctgatgtacagcgacaacagaagcttccagggcaaggagagcatcttcggcgacaacatgaacgagctgcagaccttcgtggccaacagacagaaggacaacctgaacaactacgtgttccagggccagcaccccctgaccctgaacgagagcaaccccaacaccgtggaggtggccgtgagcaccgagagcaaggccaacagcagacccagacagctgtggaagaagagcgtggacagcatcagacaggacagcctgagccagaaccccgtgagccagagagacgaggccaccgccgagaacagaacccacagcctgaagagccccagatacctgcccgaggagatggcccacagcgacatcagcgagaccagcaacagagccacctgccacagagagcccgacaacagcaagaaccacaagaccaaggacaacttcaagagaagcgtggccagcaagtaccccaaggactgcagcgaggtggagagaacctacctgaagaccaagagcagcagccccagagacaagatctacaccatcgacggcgagaaggagcccggcttccacctggaccccccccagttcgtggagaacgtgaccctgcccgagaacgtggacttccccgacccctaccaggaccccagcgagaacttcagaaagggcgacagcaccctgcccatgaacagaaaccccctgcacaacgaggagggcctgagcaacaacgaccagtacaagctgtacagcaagcacttcaccctgaaggacaagggcagcccccacagcgagaccagcgagagatacagacagaacagcacccactgcagaagctgcctgagcaacatgcccacctacagcggccacttcaccatgagaagccccttcaagtgcgacgcctgcctgagaatgggcaacctgtacgacatcgacgaggaccagatgctgcaggagaccggcatgaccaacgcctggctgctgggcgacgcccccagaaccctgaccaacaccagatgccaccccagaagatag

SEQ ID NO: 83174 - DNA, 3375 bp, Artificial Sequence
  Description of Artificial Sequence: Synthetic coding sequence
atgctgaagatcatgcaggactacgactggcacgtgttcagcctggtgaccaccatcttccccggctacagagagttcatcagcttcgtgaagaccaccgtggacaacagcttcgtgggctgggacatgcagaacgtgatcaccctggacaccagcttcgaggacgccaagacccaggtgcagctgaagaagatccacagcagcgtgatcctgctgtactgcagcaaggacgaggccgtgctgatcctgagcgaggccagaagcctgggcctgaccggctacgacttcttctggatcgtgcccagcctggtgagcggcaacaccgagctgatccccaaggagttccccagcggcctgatcagcgtgagctacgacgactgggactacagcctggaggccagagtgagagacggcatcggcatcctgaccaccgccgccagcagcatgctggagaagttcagctacatccccgaggccaaggccagctgctacggccagatggagagacccgaggtgcccatgcacaccctgcaccccttcatggtgaacgtgacctgggacggcaaggacctgagcttcaccgaggagggctaccaggtgcaccccagactggtggtgatcgtgctgaacaaggacagagagtgggagaaggtgggcaagtgggagaaccacaccctgagcctgagacacgccgtgtggcccagatacaagagcttcagcgactgcgagcccgacgacaaccacctgagcatcgtgaccctggaggaggcccccttcgtgatcgtggaggacatcgaccccctgaccgagacctgcgtgagaaacaccgtgccctgcagaaagttcgtgaagatcaacaacagcaccaacgagggcatgaacgtgaagaagtgctgcaagggcttctgcatcgacatcctgaagaagctgagcagaaccgtgaagttcacctacgacctgtacctggtgaccaacggcaagcacggcaagaaggtgaacaacgtgtggaacggcatgatcggcgaggtggtgtaccagagagccgtgatggccgtgggcagcctgaccatcaacgaggagagaagcgaggtggtggacttcagcgtgcccttcgtggagaccggcatcagcgtgatggtgagcagaagcaacggcaccgtgagccccagcgccttcctggagcccttcagcgccagcgtgtgggtgatgatgttcgtgatgctgctgatcgtgagcgccatcgccgtgttcgtgttcgagtacttcagccccgtgggctacaacagaaacctggccaagggcaaggccccccacggccccagcttcaccatcggcaaggccatctggctgctgtggggcctggtgttcaacaacagcgtgcccgtgcagaaccccaagggcaccaccagcaagatcatggtgagcgtgtgggccttcttcgccgtgatcttcctggccagctacaccgccaacctggccgccttcatgatccaggaggagttcgtggaccaggtgaccggcctgagcgacaagaagttccagagaccccacgactacagcccccccttcagattcggcaccgtgcccaacggcagcaccgagagaaacatcagaaacaactacccctacatgcaccagtacatgaccaagttcaaccagaagggcgtggaggacgccctggtgagcctgaagaccggcaagctggacgccttcatctacgacgccgccgtgctgaactacaaggccggcagagacgagggctgcaagctggtgaccatcggcagcggctacatcttcgccaccaccggctacggcatcgccctgcagaagggcagcccctggaagagacagatcgacctggccctgctgcagttcgtgggcgacggcgagatggaggagctggagaccctgtggctgaccggcatctgccacaacgagaagaacgaggtgatgagcagccagctggacatcgacaacatggccggcgtgttctacatgctggccgccgccatggccctgagcctgatcaccttcatctgggagcacctgttctactggaagctgagattctgcttcaccggcgtgtgcagcgacagacccggcctgctgttcagcatcagcagaggcatctacagctgcatccacggcgtgcacatcgaggagaagaagaagagccccgacttcaacctgaccggcagccagagcaacatgctgaagctgctgagaagcgccaagaacatcagcagcatgagcaacatgaacagcagcagaatggacagccccaagagagccgccgacttcatccagagaggcagcctgatcatggacatggtgagcgacaagggcaacctgatgtacagcgacaacagaagcttccagggcaaggagagcatcttcggcgacaacatgaacgagctgcagaccttcgtggccaacagacagaaggacaacctgaacaactacgtgttccagggccagcaccccctgaccctgaacgagagcaaccccaacaccgtggaggtggccgtgagcaccgagagcaaggccaacagcagacccagacagctgtggaagaagagcgtggacagcatcagacaggacagcctgagccagaaccccgtgagccagagagacgaggccaccgccgagaacagaacccacagcctgaagagccccagatacctgcccgaggagatggcccacagcgacatcagcgagaccagcaacagagccacctgccacagagagcccgacaacagcaagaaccacaagaccaaggacaacttcaagagaagcgtggccagcaagtaccccaaggactgcagcgaggtggagagaacctacctgaagaccaagagcagcagccccagagacaagatctacaccatcgacggcgagaaggagcccggcttccacctggaccccccccagttcgtggagaacgtgaccctgcccgagaacgtggacttccccgacccctaccaggaccccagcgagaacttcagaaagggcgacagcaccctgcccatgaacagaaaccccctgcacaacgaggagggcctgagcaacaacgaccagtacaagctgtacagcaagcacttcaccctgaaggacaagggcagcccccacagcgagaccagcgagagatacagacagaacagcacccactgcagaagctgcctgagcaacatgcccacctacagcggccacttcaccatgagaagccccttcaagtgcgacgcctgcctgagaatgggcaacctgtacgacatcgacgaggaccagatgctgcaggagaccggcatgaccaacgcctggctgctgggcgacgcccccagaaccctgaccaacaccagatgccaccccagaagatag

SEQ ID NO: 83175 - DNA, 4455 bp, Artificial Sequence
  Description of Artificial Sequence: Synthetic coding sequence
atgaagcccagagccgagtgctgcagccccaagttctggctggtgctggccgtgctggccgtgagcggcagcagagccagaagccagaagagcccccccagcatcggcatcgccgtgatcctggtgggcaccagcgacgaggtggccatcaaggacgcccacgagaaggacgacttccaccacctgagcgtggtgcccagagtggagctggtggccatgaacgagaccgaccccaagagcatcatcaccagaatctgcgacctgatgagcgacagaaagatccagggcgtggtgttcgccgacgacaccgaccaggaggccatcgcccagatcctggacttcatcagcgcccagaccctgacccccatcctgggcatccacggcggcagcagcatgatcatggccgacaaggacgagagcagcatgttcttccagttcggccccagcatcgagcagcaggccagcgtgatgctgaacatcatggaggagtacgactggtacatcttcagcatcgtgaccacctacttccccggctaccaggacttcgtgaacaagatcagaagcaccatcgagaacagcttcgtgggctgggagctggaggaggtgctgctgctggacatgagcctggacgacggcgacagcaagatccagaaccagctgaagaagctgcagagccccatcatcctgctgtactgcaccaaggaggaggccacctacatcttcgaggtggccaacagcgtgggcctgaccggctacggctacacctggatcgtgcccagcctggtggccggcgacaccgacaccgtgcccgccgagttccccaccggcctgatcagcgtgagctacgacgagtgggactacggcctgcccgccagagtgagagacggcatcgccatcatcaccaccgccgccagcgacatgctgagcgagcacagcttcatccccgagcccaagagcagctgctacaacacccacgagaagagaatctaccagagcaacatgctgaacagatacctgatcaacgtgaccttcgagggcagaaacctgagcttcagcgaggacggctaccagatgcaccccaagctggtgatcatcctgctgaacaaggagagaaagtgggagagagtgggcaagtggaaggacaagagcctgcagatgaagtactacgtgtggcccagaatgtgccccgagaccgaggagcaggaggacgaccacctgagcatcgtgaccctggaggaggcccccttcgtgatcgtggagagcgtggaccccctgagcggcacctgcatgagaaacaccgtgccctgccagaagagaatcgtgaccgagaacaagaccgacgaggagcccggctacatcaagaagtgctgcaagggcttctgcatcgacatcctgaagaagatcagcaagagcgtgaagttcacctacgacctgtacctggtgaccaacggcaagcacggcaagaagatcaacggcacctggaacggcatgatcggcgaggtggtgatgaagagagcctacatggccgtgggcagcctgaccatcaacgaggagagaagcgaggtggtggacttcagcgtgcccttcatcgagaccggcatcagcgtgatggtgagcagaagcaacggcaccgtgagccccagcgccttcctggagcccttcagcgccgacgtgtgggtgatgatgttcgtgatgctgctgatcgtgagcgccgtggccgtgttcgtgttcgagtacttcagccccgtgggctacaacagatgcctggccgacggcagagagcccggcggccccagcttcaccatcggcaaggccatctggctgctgtggggcctggtgttcaacaacagcgtgcccgtgcagaaccccaagggcaccaccagcaagatcatggtgagcgtgtgggccttcttcgccgtgatcttcctggccagctacaccgccaacctggccgccttcatgatccaggaggagtacgtggaccaggtgagcggcctgagcgacaagaagttccagagacccaacgacttcagcccccccttcagattcggcaccgtgcccaacggcagcaccgagagaaacatcagaaacaactacgccgagatgcacgcctacatgggcaagttcaaccagagaggcgtggacgacgccctgctgagcctgaagaccggcaagctggacgccttcatctacgacgccgccgtgctgaactacatggccggcagagacgagggctgcaagctggtgaccatcggcagcggcaaggtgttcgccagcaccggctacggcatcgccatccagaaggacagcggctggaagagacaggtggacctggccatcctgcagctgttcggcgacggcgagatggaggagctggaggccctgtggctgaccggcatctgccacaacgagaagaacgaggtgatgagcagccagctggacatcgacaacatggccggcgtgttctacatgctgggcgccgccatggccctgagcctgatcaccttcatctgcgagcacctgttctactggcagttcagacactgcttcatgggcgtgtgcagcggcaagcccggcatggtgttcagcatcagcagaggcatctacagctgcatccacggcgtggccatcgaggagagacagagcgtgatgaacagccccaccgccaccatgaacaacacccacagcaacatcctgagactgctgagaaccgccaagaacatggccaacctgagcggcgtgaacggcagcccccagagcgccctggacttcatcagaagagagagcagcgtgtacgacatcagcgagcacagaagaagcttcacccacagcgactgcaagagctacaacaaccccccctgcgaggagaacctgttcagcgactacatcagcgaggtggagagaaccttcggcaacctgcagctgaaggacagcaacgtgtaccaggaccactaccaccaccaccacagaccccacagcatcggcagcgccagcagcatcgacggcctgtacgactgcgacaacccccccttcaccacccagagcagaagcatcagcaagaagcccctggacatcggcctgcccagcagcaagcacagccagctgagcgacctgtacggcaagttcagcttcaagagcgacagatacagcggccacgacgacctgatcagaagcgacgtgagcgacatcagcacccacaccgtgacctacggcaacatcgagggcaacgccgccaagagaagaaagcagcagtacaaggacagcctgaagaagagacccgccagcgccaagagcagaagagagttcgacgagatcgagctggcctacagaagaagaccccccagaagccccgaccacaagagatacttcagagacaaggagggcctgagagacttctacctggaccagttcagaaccaaggagaacagcccccactgggagcacgtggacctgaccgacatctacaaggagagaagcgacgacttcaagagagacagcgtgagcggcggcggcccctgcaccaacagaagccacatcaagcacggcaccggcgacaagcacggcgtggtgagcggcgtgcccgccccctgggagaagaacctgaccaacgtggagtgggaggacagaagcggcggcaacttctgcagaagctgccccagcaagctgcacaactacagcaccaccgtgaccggccagaacagcggcagacaggcctgcatcagatgcgaggcctgcaagaaggccggcaacctgtacgacatcagcgaggacaacagcctgcaggagctggaccagcccgccgcccccgtggccgtgaccagcaacgccagcaccaccaagtacccccagagccccaccaacagcaaggcccagaagaagaacagaaacaagctgagaagacagcacagctacgacaccttcgtggacctgcagaaggaggaggccgccctggcccccagaagcgtgagcctgaaggacaagggcagattcatggacggcagcccctacgcccacatgttcgagatgagcgccggcgagagcaccttcgccaacaacaagagcagcgtgcccaccgccggccaccaccaccacaacaaccccggcggcggctacatgctgagcaagagcctgtaccccgacagagtgacccagaaccccttcatccccaccttcggcgacgaccagtgcctgctgcacggcagcaagagctacttcttcagacagcccaccgtggccggcgccagcaaggccagacccgacttcagagccctggtgaccaacaagcccgtggtgagcgccctgcacggcgccgtgcccgccagattccagaaggacatctgcatcggcaaccagagcaacccctgcgtgcccaacaacaagaaccccagagccttcaacggcagcagcaacggccacgtgtacgagaagctgagcagcatcgagagcgacgtgtag

SEQ ID NO: 83176 - DNA, 3702 bp, Artificial Sequence
  Description of Artificial Sequence: Synthetic coding sequence
atgggcggcgccctgggccccgccctgctgctgaccagcctgttcggcgcctgggccggcctgggccccggccagggcgagcagggcatgaccgtggccgtggtgttcagcagcagcggccccccccaggcccagttcagagccagactgaccccccagagcttcctggacctgcccctggagatccagcccctgaccgtgggcgtgaacaccaccaaccccagcagcctgctgacccagatctgcggcctgctgggcgccgcccacgtgcacggcatcgtgttcgaggacaacgtggacaccgaggccgtggcccagatcctggacttcatcagcagccagacccacgtgcccatcctgagcatcagcggcggcagcgccgtggtgctgacccccaaggagcccggcagcgccttcctgcagctgggcgtgagcctggagcagcagctgcaggtgctgttcaaggtgctggaggagtacgactggagcgccttcgccgtgatcaccagcctgcaccccggccacgccctgttcctggagggcgtgagagccgtggccgacgccagccacgtgagctggagactgctggacgtggtgaccctggagctgggccccggcggccccagagccagaacccagagactgctgagacagctggacgcccccgtgttcgtggcctactgcagcagagaggaggccgaggtgctgttcgccgaggccgcccaggccggcctggtgggccccggccacgtgtggctggtgcccaacctggccctgggcagcaccgacgccccccccgccaccttccccgtgggcctgatcagcgtggtgaccgagagctggagactgagcctgagacagaaggtgagagacggcgtggccatcctggccctgggcgcccacagctactggagacagcacggcaccctgcccgcccccgccggcgactgcagagtgcaccccggccccgtgagccccgccagagaggccttctacagacacctgctgaacgtgacctgggagggcagagacttcagcttcagccccggcggctacctggtgcagcccaccatggtggtgatcgccctgaacagacacagactgtgggagatggtgggcagatgggagcacggcgtgctgtacatgaagtaccccgtgtggcccagatacagcgccagcctgcagcccgtggtggacagcagacacctgaccgtggccaccctggaggagagacccttcgtgatcgtggagagccccgaccccggcaccggcggctgcgtgcccaacaccgtgccctgcagaagacagagcaaccacaccttcagcagcggcgacgtggccccctacaccaagctgtgctgcaagggcttctgcatcgacatcctgaagaagctggccagagtggtgaagttcagctacgacctgtacctggtgaccaacggcaagcacggcaagagagtgagaggcgtgtggaacggcatgatcggcgaggtgtactacaagagagccgacatggccatcggcagcctgaccatcaacgaggagagaagcgagatcgtggacttcagcgtgcccttcgtggagaccggcatcagcgtgatggtggccagaagcaacggcaccgtgagccccagcgccttcctggagccctacagccccgccgtgtgggtgatgatgttcgtgatgtgcctgaccgtggtggccatcaccgtgttcatgttcgagtacttcagccccgtgagctacaaccagaacctgaccagaggcaagaagagcggcggccccgccttcaccatcggcaagagcgtgtggctgctgtgggccctggtgttcaacaacagcgtgcccatcgagaaccccagaggcaccaccagcaagatcatggtgctggtgtgggccttcttcgccgtgatcttcctggccagctacaccgccaacctggccgccttcatgatccaggagcagtacatcgacaccgtgagcggcctgagcgacaagaagttccagagaccccaggaccagtacccccccttcagattcggcaccgtgcccaacggcagcaccgagagaaacatcagaagcaactacagagacatgcacacccacatggtgaagttcaaccagagaagcgtggaggacgccctgaccagcctgaagatgggcaagctggacgccttcatctacgacgccgccgtgctgaactacatggccggcaaggacgagggctgcaagctggtgaccatcggcagcggcaaggtgttcgccaccaccggctacggcatcgccatgcagaaggacagccactggaagagagccatcgacctggccctgctgcagttcctgggcgacggcgagacccagaagctggagaccgtgtggctgagcggcatctgccagaacgagaagaacgaggtgatgagcagcaagctggacatcgacaacatggccggcgtgttctacatgctgctggtggccatgggcctggccctgctggtgttcgcctgggagcacctggtgtactggaagctgagacacagcgtgcccaacagcagccagctggacttcctgctggccttcagcagaggcatctacagctgcttcagcggcgtgcagagcctggccagcccccccagacaggccagccccgacctgaccgccagcagcgcccaggccagcgtgctgaagatgctgcaggccgccagagacatggtgaccaccgccggcgtgagcagcagcctggacagagccaccagaaccatcgagaactggggcggcggcagaagagcccccccccccagcccctgccccacccccagaagcggccccagcccctgcctgcccacccccgaccccccccccgagcccagccccaccggctggggcccccccgacggcggcagagccgccctggtgagaagagccccccagccccccggcagaccccccacccccggcccccccctgagcgacgtgagcagagtgagcagaagacccgcctgggaggccagatggcccgtgagaaccggccactgcggcagacacctgagcgccagcgagagacccctgagccccgccagatgccactacagcagcttccccagagccgacagaagcggcagacccttcctgcccctgttccccgagctggaggacctgcccctgctgggccccgagcagctggccagaagagaggccctgctgcacgccgcctgggccagaggcagcagacccagacacgccagcctgcccagcagcgtggccgaggccttcgccagacccagcagcctgcccgccggctgcaccggccccgcctgcgccagacccgacggccacagcgcctgcagaagactggcccaggcccagagcatgtgcctgcccatctacagagaggcctgccaggagggcgagcaggccggcgcccccgcctggcagcacagacagcacgtgtgcctgcacgcccacgcccacctgcccttctgctggggcgccgtgtgcccccacctgcccccctgcgccagccacggcagctggctgagcggcgcctggggccccctgggccacagaggcagaaccctgggcctgggcaccggctacagagacagcggcggcctggacgagatcagcagagtggccagaggcacccagggcttccccggcccctgcacctggagaagaatcagcagcctggagagcgaggtgtag

SEQ ID NO: 83177 - DNA, 2724 bp, Artificial Sequence
  Description of Artificial Sequence: Synthetic coding sequence
agaggccagggcggcgacaccagaagcaagggcaccagacagcccgagccccccggcgccagcagagaccccgccagaagctgctgggacccccccgtggacatgggcggcgccctgggccccgccctgctgctgaccagcctgttcggcgcctgggccggcctgggccccggccagggcgagcagggcatgaccgtggccgtggtgttcagcagcagcggccccccccaggcccagttcagagccagactgaccccccagagcttcctggacctgcccctggagatccagcccctgaccgtgggcgtgaacaccaccaaccccagcagcctgctgacccagatctgcggcctgctgggcgccgcccacgtgcacggcatcgtgttcgaggacaacgtggacaccgaggccgtggcccagatcctggacttcatcagcagccagacccacgtgcccatcctgagcatcagcggcggcagcgccgtggtgctgacccccaaggagcccggcagcgccttcctgcagctgggcgtgagcctggagcagcagctgcaggtgctgttcaaggtgctggaggagtacgactggagcgccttcgccgtgatcaccagcctgcaccccggccacgccctgttcctggagggcgtgagagccgtggccgacgccagccacgtgagctggagactgctggacgtggtgaccctggagctgggccccggcggccccagagccagaacccagagactgctgagacagctggacgcccccgtgttcgtggcctactgcagcagagaggaggccgaggtgctgttcgccgaggccgcccaggccggcctggtgggccccggccacgtgtggctggtgcccaacctggccctgggcagcaccgacgccccccccgccaccttccccgtgggcctgatcagcgtggtgaccgagagctggagactgagcctgagacagaaggtgagagacggcgtggccatcctggccctgggcgcccacagctactggagacagcacggcaccctgcccgcccccgccggcgactgcagagtgcaccccggccccgtgagccccgccagagaggccttctacagacacctgctgaacgtgacctgggagggcagagacttcagcttcagccccggcggctacctggtgcagcccaccatggtggtgatcgccctgaacagacacagactgtgggagatggtgggcagatgggagcacggcgtgctgtacatgaagtaccccgtgtggcccagatacagcgccagcctgcagcccgtggtggacagcagacacctgaccgtggccaccctggaggagagacccttcgtgatcgtggagagccccgaccccggcaccggcggctgcgtgcccaacaccgtgccctgcagaagacagagcaaccacaccttcagcagcggcgacgtggccccctacaccaagctgtgctgcaagggcttctgcatcgacatcctgaagaagctggccagagtggtgaagttcagctacgacctgtacctggtgaccaacggcaagcacggcaagagagtgagaggcgtgtggaacggcatgatcggcgaggtgtactacaagagagccgacatggccatcggcagcctgaccatcaacgaggagagaagcgagatcgtggacttcagcgtgcccttcgtggagaccggcatcagcgtgatggtggccagaagcaacggcaccgtgagccccagcgccttcctggagccctacagccccgccgtgtgggtgatgatgttcgtgatgtgcctgaccgtggtggccatcaccgtgttcatgttcgagtacttcagccccgtgagctacaaccagaacctgaccagaggcaagaagagcggcggccccgccttcaccatcggcaagagcgtgtggctgctgtgggccctggtgttcaacaacagcgtgcccatcgagaaccccagaggcaccaccagcaagatcatggtgctggtgtgggccttcttcgccgtgatcttcctggccagctacaccgccaacctggccgccttcatgatccaggagcagtacatcgacaccgtgagcggcctgagcgacaagaagttccagagaccccaggaccagtacccccccttcagattcggcaccgtgcccaacggcagcaccgagagaaacatcagaagcaactacagagacatgcacacccacatggtgaagttcaaccagagaagcgtggaggacgccctgaccagcctgaagatgggcaagctggacgccttcatctacgacgccgccgtgctgaactacatggccggcaaggacgagggctgcaagctggtgaccatcggcagcggcaaggtgttcgccaccaccggctacggcatcgccatgcagaaggacagccactggaagagagccatcgacctggccctgctgcagttcctgggcgacggcgagacccagaagctggagaccgtgtggctgagcggcatctgccagaacgagaagaacgaggtgatgagcagcaagctggacatcgacaacatggccggcgtgttctacatgctgctggtggccatgggcctggccctgctggtgttcgcctgggagcacctggtgtactggaagctgagacacagcgtgcccaacagcagccagctggacttcctgctggccttcagcagagtgggcgcccaccccagcccccacagacccaagttctag

SEQ ID NO: 83178 - DNA, 4011 bp, Artificial Sequence
  Description of Artificial Sequence: Synthetic coding sequence
atgagaggcgccggcggccccagaggccccagaggccccgccaagatgctgctgctgctggccctggcctgcgccagccccttccccgaggaggcccccggccccggcggcgccggcggccccggcggcggcctgggcggcgccagacccctgaacgtggccctggtgttcagcggccccgcctacgccgccgaggccgccagactgggccccgccgtggccgccgccgtgagaagccccggcctggacgtgagacccgtggccctggtgctgaacggcagcgaccccagaagcctggtgctgcagctgtgcgacctgctgagcggcctgagagtgcacggcgtggtgttcgaggacgacagcagagcccccgccgtggcccccatcctggacttcctgagcgcccagaccagcctgcccatcgtggccgtgcacggcggcgccgccctggtgctgacccccaaggagaagggcagcaccttcctgcagctgggcagcagcaccgagcagcagctgcaggtgatcttcgaggtgctggaggagtacgactggaccagcttcgtggccgtgaccaccagagcccccggccacagagccttcctgagctacatcgaggtgctgaccgacggcagcctggtgggctgggagcacagaggcgccctgaccctggaccccggcgccggcgaggccgtgctgagcgcccagctgagaagcgtgagcgcccagatcagactgctgttctgcgccagagaggaggccgagcccgtgttcagagccgccgaggaggccggcctgaccggcagcggctacgtgtggttcatggtgggcccccagctggccggcggcggcggcagcggcgcccccggcgagccccccctgctgcccggcggcgcccccctgcccgccggcctgttcgccgtgagaagcgccggctggagagacgacctggccagaagagtggccgccggcgtggccgtggtggccagaggcgcccaggccctgctgagagactacggcttcctgcccgagctgggccacgactgcagagcccagaacagaacccacagaggcgagagcctgcacagatacttcatgaacatcacctgggacaacagagactacagcttcaacgaggacggcttcctggtgaaccccagcctggtggtgatcagcctgaccagagacagaacctgggaggtggtgggcagctgggagcagcagaccctgagactgaagtaccccctgtggagcagatacggcagattcctgcagcccgtggacgacacccagcacctgaccgtggccaccctggaggagagacccttcgtgatcgtggagcccgccgaccccatcagcggcacctgcatcagagacagcgtgccctgcagaagccagctgaacagaacccacagccccccccccgacgcccccagacccgagaagagatgctgcaagggcttctgcatcgacatcctgaagagactggcccacaccatcggcttcagctacgacctgtacctggtgaccaacggcaagcacggcaagaagatcgacggcgtgtggaacggcatgatcggcgaggtgttctaccagagagccgacatggccatcggcagcctgaccatcaacgaggagagaagcgagatcgtggacttcagcgtgcccttcgtggagaccggcatcagcgtgatggtggccagaagcaacggcaccgtgagccccagcgccttcctggagccctacagccccgccgtgtgggtgatgatgttcgtgatgtgcctgaccgtggtggccgtgaccgtgttcatcttcgagtacctgagccccgtgggctacaacagaagcctggccaccggcaagagacccggcggcagcaccttcaccatcggcaagagcatctggctgctgtgggccctggtgttcaacaacagcgtgcccgtggagaaccccagaggcaccaccagcaagatcatggtgctggtgtgggccttcttcgccgtgatcttcctggccagctacaccgccaacctggccgccttcatgatccaggaggagtacgtggacaccgtgagcggcctgagcgacagaaagttccagagaccccaggagcagtacccccccctgaagttcggcaccgtgcccaacggcagcaccgagaagaacatcagaagcaactaccccgacatgcacagctacatggtgagatacaaccagcccagagtggaggaggccctgacccagctgaaggccggcaagctggacgccttcatctacgacgccgccgtgctgaactacatggccagaaaggacgagggctgcaagctggtgaccatcggcagcggcaaggtgttcgccaccaccggctacggcatcgccctgcacaagggcagcagatggaagagacccatcgacctggccctgctgcagttcctgggcgacgacgagatcgagatgctggagagactgtggctgagcggcatctgccacaacgacaagatcgaggtgatgagcagcaagctggacatcgacaacatggccggcgtgttctacatgctgctggtggccatgggcctgagcctgctggtgttcgcctgggagcacctggtgtactggagactgagacactgcctgggccccacccacagaatggacttcctgctggccttcagcagaggcatgtacagctgctgcagcgccgaggccgcccccccccccgccaagccccccccccccccccagcccctgcccagccccgcctaccccgcccccagacccgcccccggccccgcccccttcgtgcccagagagagagccagcgtggacagatggagaagaaccaagggcgccggcccccccggcggcgccggcctggccgacggcttccacagatactacggccccatcgagccccagggcctgggcctgggcctgggcgaggccagagccgcccccagaggcgccgccggcagacccctgagcccccccgccgcccagcccccccagaagcccccccccagctacttcgccatcgtgagagacaaggagcccgccgagccccccgccggcgccttccccggcttccccagcccccccgccccccccgccgccgccgccaccgccgtgggcccccccctgtgcagactggccttcgaggacgagagcccccccgcccccgccagatggcccagaagcgaccccgagagccagcccctgctgggccccggcgccggcggcgccggcggcaccggcggcgccggcggcggcgcccccgccgccccccccccctgcagagccgccccccccccctgcccctacctggacctggagcccagccccagcgacagcgaggacagcgagagcctgggcggcgccagcctgggcggcctggagccctggtggttcgccgacttcccctacccctacgccgagagactgggccccccccccggcagatactggagcgtggacaagctgggcggctggagagccggcagctgggactacctgccccccagaagcggccccgccgcctggcactgcagacactgcgccagcctggagctgctgcccccccccagacacctgagctgcagccacgacggcctggacggcggctggtgggccccccccccccccccctgggccgccggccccctgcccagaagaagagccagatgcggctgccccagaagccacccccacagacccagagccagccacagaacccccgccgccgccgccccccaccaccacagacacagaagagccgccggcggctgggacctgcccccccccgcccccaccagcagaagcctggaggacctgagcagctgccccagagccgcccccgccagaagactgaccggccccagcagacacgccagaagatgcccccacgccgcccactggggcccccccctgcccaccgccagccacagaagacacagaggcggcgacctgggcaccagaagaggcagcgcccacttcagcagcctggagagcgaggtgtag

SEQ ID NO: 83179 - DNA, 1116 bp, Artificial Sequence
  Description of Artificial Sequence: Synthetic coding sequence
atgagccacgagaagagcttcctggtgagcggcgacaactaccccccccccaaccccggctaccccggcggcccccagccccccatgcccccctacgcccagcccccctaccccggcgccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagggcccctacccccagagccccttcccccccaacccctacggccagccccaggtgttccccggccaggaccccgacagcccccagcacggcaactaccaggaggagggcccccccagctactacgacaaccaggacttccccgccaccaactgggacgacaagagcatcagacaggccttcatcagaaaggtgttcctggtgctgaccctgcagctgagcgtgaccctgagcaccgtgagcgtgttcaccttcgtggccgaggtgaagggcttcgtgagagagaacgtgtggacctactacgtgagctacgccgtgttcttcatcagcctgatcgtgctgagctgctgcggcgacttcagaagaaagcacccctggaacctggtggccctgagcgtgctgaccgccagcctgagctacatggtgggcatgatcgccagcttctacaacaccgaggccgtgatcatggccgtgggcatcaccaccgccgtgtgcttcaccgtggtgatcttcagcatgcagaccagatacgacttcaccagctgcatgggcgtgctgctggtgagcatggtggtgctgttcatcttcgccatcctgtgcatcttcatcagaaacagaatcctggagatcgtgtacgccagcctgggcgccctgctgttcacctgcttcctggccgtggacacccagctgctgctgggcaacaagcagctgagcctgagccccgaggagtacgtgttcgccgccctgaacctgtacaccgacatcatcaacatcttcctgtacatcctgaccatcatcggcagagccaaggagtag

SEQ ID NO: 83180 - DNA, 1116 bp, Artificial Sequence; identical to SEQ ID NO: 83179
  Description of Artificial Sequence: Synthetic coding sequence

SEQ ID NO: 83181 - DNA, 825 bp, Artificial Sequence
  Description of Artificial Sequence: Synthetic coding sequence
atgagccacgagaagagcttcctggtgagcggcgacaactaccccccccccaaccccggctaccccggcggcccccagccccccatgcccccctacgcccagcccccctaccccggcgccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagggcccctacccccagagccccttcccccccaacccctacggccagccccaggtgttccccggccaggaccccgacagcccccagcacggcaactaccaggaggagggcccccccagctactacgacaaccaggacttccccgccaccaactgggacgacaagagcatcagacaggccttcatcagaaaggtgttcctggtgctgaccctgcagctgagcgtgaccctgagcaccgtgagcgtgttcaccttcgtggccgaggtgaagggcttcgtgagagagaacgtgtggacctactacgtgagctacgccgtgttcttcatcagcctgatcgtgctgagctgctgcggcgacttcagaagaaagcacccctggaacctggtggccctgagcgtgctgaccgccagcctgagctacatggtgggcatgatcgccagcttctacaacaccgaggccgtgatcatggccgtgggcatcaccaccgccgtgtgcttcaccgtggtgatcttcagcatgcagtag

SEQ ID NO: 83182 - DNA, 306 bp, Artificial Sequence
  Description of Artificial Sequence: Synthetic coding sequence
atgagccacgagaagagcttcctggtgagcggcgacaactaccccccccccaaccccggctaccccggcggcccccagccccccatgcccccctacgcccagcccccctaccccggcgccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagtag

SEQ ID NO: 83183 - DNA, 1059 bp, Artificial Sequence
  Description of Artificial Sequence: Synthetic coding sequence
atgagccacgagaagagcttcctggtgagcggcgacaactacccccccccctaccccggcgccccctacccccagccccccttccagcccagcccctacggccagcccggctacccccacggccccagcccctacccccagggcggctacccccagggcccctacccccagggcggctacccccagggcccctacccccaggagggctacccccagggcccctacccccagggcggctacccccagggcccctacccccagagccccttcccccccaacccctacggccagccccaggtgttccccggccaggaccccgacagcccccagcacggcaactaccaggaggagggcccccccagctactacgacaaccaggacttccccgccaccaactgggacgacaagagcatcagacaggccttcatcagaaaggtgttcctggtgctgaccctgcagctgagcgtgaccctgagcaccgtgagcgtgttcaccttcgtggccgaggtgaagggcttcgtgagagagaacgtgtggacctactacgtgagctacgccgtgttcttcatcagcctgatcgtgctgagctgctgcggcgacttcagaagaaagcacccctggaacctggtggccctgagcgtgctgaccgccagcctgagctacatggtgggcatgatcgccagcttctacaacaccgaggccgtgatcatggccgtgggcatcaccaccgccgtgtgcttcaccgtggtgatcttcagcatgcagaccagatacgacttcaccagctgcatgggcgtgctgctggtgagcatggtggtgctgttcatcttcgccatcctgtgcatcttcatcagaaacagaatcctggagatcgtgtacgccagcctgggcgccctgctgttcacctgcttcctggccgtggacacccagctgctgctgggcaacaagcagctgagcctgagccccgaggagtacgtgttcgccgccctgaacctgtacaccgacatcatcaacatcttcctgtacatcctgaccatcatcggcagagccaaggagtag

SEQ ID NO: 83184 - DNA, 3348 bp, Artificial Sequence
  Description of Artificial Sequence: Synthetic coding sequence
atgagaagactgagcctgtggtggctgctgagcagagtgtgcctgctgctgccccccccctgcgccctggtgctggccggcgtgcccagcagcagcagccacccccagccctgccagatcctgaagagaatcggccacgccgtgagagtgggcgccgtgcacctgcagccctggaccaccgcccccagagccgccagcagagcccccgacgacagcagagccggcgcccagagagacgagcccgagcccggcaccagaagaagccccgcccccagccccggcgccagatggctgggcagcaccctgcacggcagaggcccccccggcagcagaaagcccggcgagggcgccagagccgaggccctgtggcccagagacgccctgctgttcgccgtggacaacctgaacagagtggagggcctgctgccctacaacctgagcctggaggtggtgatggccatcgaggccggcctgggcgacctgcccctgctgcccttcagcagccccagcagcccctggagcagcgaccccttcagcttcctgcagagcgtgtgccacaccgtggtggtgcagggcgtgagcgccctgctggccttcccccagagccagggcgagatgatggagctggacctggtgagcctggtgctgcacatccccgtgatcagcatcgtgagacacgagttccccagagagagccagaaccccctgcacctgcagctgagcctggagaacagcctgagcagcgacgccgacgtgaccgtgagcatcctgaccatgaacaactggtacaacttcagcctgctgctgtgccaggaggactggaacatcaccgacttcctgctgctgacccagaacaacagcaagttccacctgggcagcatcatcaacatcaccgccaacctgcccagcacccaggacctgctgagcttcctgcagatccagctggagagcatcaagaacagcacccccaccgtggtgatgttcggctgcgacatggagagcatcagaagaatcttcgagatcaccacccagttcggcgtgatgccccccgagctgagatgggtgctgggcgacagccagaacgtggaggagctgagaaccgagggcctgcccctgggcctgatcgcccacggcaagaccacccagagcgtgttcgagcactacgtgcaggacgccatggagctggtggccagagccgtggccaccgccaccatgatccagcccgagctggccctgatccccagcaccatgaactgcatggaggtggagaccaccaacctgaccagcggccagtacctgagcagattcctggccaacaccaccttcagaggcctgagcggcagcatcagagtgaagggcagcaccatcgtgagcagcgagaacaacttcttcatctggaacctgcagcacgaccccatgggcaagcccatgtggaccagactgggcagctggcagggcggcaagatcgtgatggactacggcatctggcccgagcaggcccagagacacaagacccacttccagcaccccagcaagctgcacctgagagtggtgaccctgatcgagcaccccttcgtgttcaccagagaggtggacgacgagggcctgtgccccgccggccagctgtgcctggaccccatgaccaacgacagcagcaccctggacagcctgttcagcagcctgcacagcagcaacgacaccgtgcccatcaagttcaagaagtgctgctacggctactgcatcgacctgctggagaagatcgccgaggacatgaacttcgacttcgacctgtacatcgtgggcgacggcaagtacggcgcctggaagaacggccactggaccggcctggtgggcgacctgctgagaggcaccgcccacatggccgtgaccagcttcagcatcaacaccgccagaagccaggtgatcgacttcaccagccccttcttcagcaccagcctgggcatcctggtgagaaccagagacaccgccgcccccatcggcgccttcatgtggcccctgcactggaccatgtggctgggcatcttcgtggccctgcacatcaccgccgtgttcctgaccctgtacgagtggaagagccccttcggcctgacccccaagggcagaaacagaagcaaggtgttcagcttcagcagcgccctgaacatctgctacgccctgctgttcggcagaaccgtggccatcaagccccccaagtgctggaccggcagattcctgatgaacctgtgggccatcttctgcatgttctgcctgagcacctacaccgccaacctggccgccgtgatggtgggcgagaagatctacgaggagctgagcggcatccacgaccccaagctgcaccaccccagccagggcttcagattcggcaccgtgagagagagcagcgccgaggactacgtgagacagagcttccccgagatgcacgagtacatgagaagatacaacgtgcccgccacccccgacggcgtggagtacctgaagaacgaccccgagaagctggacgccttcatcatggacaaggccctgctggactacgaggtgagcatcgacgccgactgcaagctgctgaccgtgggcaagcccttcgccatcgagggctacggcatcggcctgccccccaacagccccctgaccgccaacatcagcgagctgatcagccagtacaagagccacggcttcatggacatgctgcacgacaagtggtacagagtggtgccctgcggcaagagaagcttcgccgtgaccgagaccctgcagatgggcatcaagcacttcagcggcctgttcgtgctgctgtgcatcggcttcggcctgagcatcctgaccaccatcggcgagcacatcgtgtacagactgctgctgcccagaatcaagaacaagagcaagctgcagtactggctgcacaccagccagagactgcacagagccatcaacaccagcttcatcgaggagaagcagcagcacttcaagaccaagagagtggagaagagaagcaacgtgggccccagacagctgaccgtgtggaacaccagcaacctgagccacgacaacagaagaaagtacatcttcagcgacgaggagggccagaaccagctgggcatcagaatccaccaggacatccccctgccccccagaagaagagagctgcccgccctgagaaccaccaacggcaaggccgacagcctgaacgtgagcagaaacagcgtgatgcaggagctgagcgagctggagaagcagatccaggtgatcagacaggagctgcagctggccgtgagcagaaagaccgagctggaggagtaccagagaaccagcagaacctgcgagagctag

SEQ ID NO: 83185 - DNA, 3585 bp, Artificial Sequence
  Description of Artificial Sequence: Synthetic coding sequence
atggtgggcctgctgctgttcttcttccccgccatcttcctggaggtgagcctgctgcccagaagccccggcagaaaggtgctgctggccggcgccagcagccagagaagcgtggccagaatggacggcgacgtgatcatcggcgccctgttcagcgtgcaccaccagccccccgccgagaaggtgcccgagagaaagtgcggcgagatcagagagcagtacggcatccagagagtggaggccatgttccacaccctggacaagatcaacgccgaccccgtgctgctgcccaacatcaccctgggcagcgagatcagagacagctgctggcacagcagcgtggccctggagcagagcatcgagttcatcagagacagcctgatcagcatcagagacgagaaggacggcatcaacagatgcctgcccgacggccagagcctgccccccggcagaaccaagaagcccatcgccggcgtgatcggccccggcagcagcagcgtggccatccaggtgcagaacctgctgcagctgttcgacatcccccagatcgcctacagcgccaccagcatcgacctgagcgacaagaccctgtacaagtacttcctgagagtggtgcccagcgacaccctgcaggccagagccatgctggacatcgtgaagagatacaactggacctacgtgagcgccgtgcacaccgagggcaactacggcgagagcggcatggacgccttcaaggagctggccgcccaggagggcctgtgcatcgcccacagcgacaagatctacagcaacgccggcgagaagagcttcgacagactgctgagaaagctgagagagagactgcccaaggccagagtggtggtgtgcttctgcgagggcatgaccgtgagaggcctgctgagcgccatgagaagactgggcgtggtgggcgagttcagcctgatcggcagcgacggctgggccgacagagacgaggtgatcgagggctacgaggtggaggccaacggcggcatcaccatcaagctgcagagccccgaggtgagaagcttcgacgactacttcctgaagctgagactggacaccaacaccagaaacccctggttccccgagttctggcagcacagattccagtgcagactgcccggccacctgctggagaaccccaacttcaagagaatctgcaccggcaacgagagcctggaggagaactacgtgcaggacagcaagatgggcttcgtgatcaacgccatctacgccatggcccacggcctgcagaacatgcaccacgccctgtgccccggccacgtgggcctgtgcgacgccatgaagcccatcgacggcagcaagctgctggacttcctgatcaagagcagcttcatcggcgtgagcggcgaggaggtgtggttcgacgagaagggcgacgcccccggcagatacgacatcatgaacctgcagtacaccgaggccaacagatacgactacgtgcacgtgggcacctggcacgagggcgtgctgaacatcgacgactacaagatccagatgaacaagagcggcgtggtgagaagcgtgtgcagcgagccctgcctgaagggccagatcaaggtgatcagaaagggcgaggtgagctgctgctggatctgcaccgcctgcaaggagaacgagtacgtgcaggacgagttcacctgcaaggcctgcgacctgggctggtggcccaacgccgacctgaccggctgcgagcccatccccgtgagatacctggagtggagcaacatcgagagcatcatcgccatcgccttcagctgcctgggcatcctggtgaccctgttcgtgaccctgatcttcgtgctgtacagagacacccccgtggtgaagagcagcagcagagagctgtgctacatcatcctggccggcatcttcctgggctacgtgtgccccttcaccctgatcgccaagcccaccaccaccagctgctacctgcagagactgctggtgggcctgagcagcgccatgtgctacagcgccctggtgaccaagaccaacagaatcgccagaatcctggccggcagcaagaagaagatctgcaccagaaagcccagattcatgagcgcctgggcccaggtgatcatcgccagcatcctgatcagcgtgcagctgaccctggtggtgaccctgatcatcatggagccccccatgcccatcctgagctaccccagcatcaaggaggtgtacctgatctgcaacaccagcaacctgggcgtggtggcccccctgggctacaacggcctgctgatcatgagctgcacctactacgccttcaagaccagaaacgtgcccgccaacttcaacgaggccaagtacatcgccttcaccatgtacaccacctgcatcatctggctggccttcgtgcccatctacttcggcagcaactacaagatcatcaccacctgcttcgccgtgagcctgagcgtgaccgtggccctgggctgcatgttcacccccaagatgtacatcatcatcgccaagcccgagagaaacgtgagaagcgccttcaccaccagcgacgtggtgagaatgcacgtgggcgacggcaagctgccctgcagaagcaacaccttcctgaacatcttcagaagaaagaaggccggcgccggcaacgccaacagcaacggcaagagcgtgagctggagcgagcccggcggcggccaggtgcccaagggccagcacatgtggcacagactgagcgtgcacgtgaagaccaacgagaccgcctgcaaccagaccgccgtgatcaagcccctgaccaagagctaccagggcagcggcaagagcctgaccttcagcgacaccagcaccaagaccctgtacaacgtggaggaggaggaggacgcccagcccatcagattcagcccccccggcagccccagcatggtggtgcacagaagagtgcccagcgccgccaccaccccccccctgcccagccacctgaccgccgaggagacccccctgttcctggccgagcccgccctgcccaagggcctgcccccccccctgcagcagcagcagcagccccccccccagcagaagagcctgatggaccagctgcagggcgtggtgagcaacttcagcaccgccatccccgacttccacgccgtgctggccggccccggcggccccggcaacggcctgagaagcctgtaccccccccccccccccccccagcacctgcagatgctgcccctgcagctgagcaccttcggcgaggagctggtgagcccccccgccgacgacgacgacgacagcgagagattcaagctgctgcaggagtacgtgtacgagcacgagagagagggcaacaccgaggaggacgagctggaggaggaggaggaggacctgcaggccgccagcaagctgacccccgacgacagccccgccctgaccccccccagccccttcagagacagcgtggccagcggcagcagcgtgcccagcagccccgtgagcgagagcgtgctgtgcaccccccccaacgtgagctacgccagcgtgatcctgagagactacaagcagagcagcagcaccctgtag

SEQ ID NO: 83186 - DNA, 3585 bp, Artificial Sequence; identical to SEQ ID NO: 83185
  Description of Artificial Sequence: Synthetic coding sequence

SEQ ID NO: 83187 - DNA, 2721 bp, Artificial Sequence
  Description of Artificial Sequence: Synthetic coding sequence
atggtgggcctgctgctgttcttcttccccgccatcttcctggaggtgagcctgctgcccagaagccccggcagaaaggtgctgctggccggcgccagcagccagagaagcgtggccagaatggacggcgacgtgatcatcggcgccctgttcagcgtgcaccaccagccccccgccgagaaggtgcccgagagaaagtgcggcgagatcagagagcagtacggcatccagagagtggaggccatgttccacaccctggacaagatcaacgccgaccccgtgctgctgcccaacatcaccctgggcagcgagatcagagacagctgctggcacagcagcgtggccctggagcagagcatcgagttcatcagagacagcctgatcagcatcagagacgagaaggacggcatcaacagatgcctgcccgacggccagagcctgccccccggcagaaccaagaagcccatcgccggcgtgatcggccccggcagcagcagcgtggccatccaggtgcagaacctgctgcagctgttcgacatcccccagatcgcctacagcgccaccagcatcgacctgagcgacaagaccctgtacaagtacttcctgagagtggtgcccagcgacaccctgcaggccagagccatgctggacatcgtgaagagatacaactggacctacgtgagcgccgtgcacaccgagggcaactacggcgagagcggcatggacgccttcaaggagctggccgcccaggagggcctgtgcatcgcccacagcgacaagatctacagcaacgccggcgagaagagcttcgacagactgctgagaaagctgagagagagactgcccaaggccagagtggtggtgtgcttctgcgagggcatgaccgtgagaggcctgctgagcgccatgagaagactgggcgtggtgggcgagttcagcctgatcggcagcgacggctgggccgacagagacgaggtgatcgagggctacgaggtggaggccaacggcggcatcaccatcaagctgcagagccccgaggtgagaagcttcgacgactacttcctgaagctgagactggacaccaacaccagaaacccctggttccccgagttctggcagcacagattccagtgcagactgcccggccacctgctggagaaccccaacttcaagagaatctgcaccggcaacgagagcctggaggagaactacgtgcaggacagcaagatgggcttcgtgatcaacgccatctacgccatggcccacggcctgcagaacatgcaccacgccctgtgccccggccacgtgggcctgtgcgacgccatgaagcccatcgacggcagcaagctgctggacttcctgatcaagagcagcttcatcggcgtgagcggcgaggaggtgtggttcgacgagaagggcgacgcccccggcagatacgacatcatgaacctgcagtacaccgaggccaacagatacgactacgtgcacgtgggcacctggcacgagggcgtgctgaacatcgacgactacaagatccagatgaacaagagcggcgtggtgagaagcgtgtgcagcgagccctgcctgaagggccagatcaaggtgatcagaaagggcgaggtgagctgctgctggatctgcaccgcctgcaaggagaacgagtacgtgcaggacgagttcacctgcaaggcctgcgacctgggctggtggcccaacgccgacctgaccggctgcgagcccatccccgtgagatacctggagtggagcaacatcgagagcatcatcgccatcgccttcagctgcctgggcatcctggtgaccctgttcgtgaccctgatcttcgtgctgtacagagacacccccgtggtgaagagcagcagcagagagctgtgctacatcatcctggccggcatcttcctgggctacgtgtgccccttcaccctgatcgccaagcccaccaccaccagctgctacctgcagagactgctggtgggcctgagcagcgccatgtgctacagcgccctggtgaccaagaccaacagaatcgccagaatcctggccggcagcaagaagaagatctgcaccagaaagcccagattcatgagcgcctgggcccaggtgatcatcgccagcatcctgatcagcgtgcagctgaccctggtggtgaccctgatcatcatggagccccccatgcccatcctgagctaccccagcatcaaggaggtgtacctgatctgcaacaccagcaacctgggcgtggtggcccccctgggctacaacggcctgctgatcatgagctgcacctactacgccttcaagaccagaaacgtgcccgccaacttcaacgaggccaagtacatcgccttcaccatgtacaccacctgcatcatctggctggccttcgtgcccatctacttcggcagcaactacaagatcatcaccacctgcttcgccgtgagcctgagcgtgaccgtggccctgggctgcatgttcacccccaagatgtacatcatcatcgccaagcccgagagaaacgtgagaagcgccttcaccaccagcgacgtggtgagaatgcacgtgggcgacggcaagctgccctgcagaagcaacaccttcctgaacatcttcagaagaaagaaggccggcgccggcaacgccaagaagagacagcccgagttcagccccaccagccagtgccccagcgcccacgtgcagctgtag

SEQ ID NO: 83188 - DNA, 2721 bp, Artificial Sequence; identical to SEQ ID NO: 83187
  Description of Artificial Sequence: Synthetic coding sequence

SEQ ID NO: 83189 - DNA, 2721 bp, Artificial Sequence; identical to SEQ ID NO: 83187
  Description of Artificial Sequence: Synthetic coding sequence

SEQ ID NO: 83190 - DNA, 2619 bp, Artificial Sequence
  Description of Artificial Sequence: Synthetic coding sequence
atgggcagcctgctggccctgctggccctgctgctgctgtggggcgccgtggccgagggccccgccaagaaggtgctgaccctggagggcgacctggtgctgggcggcctgttccccgtgcaccagaagggcggccccgccgaggactgcggccccgtgaacgagcacagaggcatccagagactggaggccatgctgttcgccctggacagaatcaacagagacccccacctgctgcccggcgtgagactgggcgcccacatcctggacagctgcagcaaggacacccacgccctggagcaggccctggacttcgtgagagccagcctgagcagaggcgccgacggcagcagacacatctgccccgacggcagctacgccacccacggcgacgcccccaccgccatcaccggcgtgatcggcggcagctacagcgacgtgagcatccaggtggccaacctgctgagactgttccagatcccccagatcagctacgccagcaccagcgccaagctgagcgacaagagcagatacgactacttcgccagaaccgtgccccccgacttcttccaggccaaggccatggccgagatcctgagattcttcaactggacctacgtgagcaccgtggccagcgagggcgactacggcgagaccggcatcgaggccttcgagctggaggccagagccagaaacatctgcgtggccaccagcgagaaggtgggcagagccatgagcagagccgccttcgagggcgtggtgagagccctgctgcagaagcccagcgccagagtggccgtgctgttcaccagaagcgaggacgccagagagctgctggccgccagccagagactgaacgccagcttcacctgggtggccagcgacggctggggcgccctggagagcgtggtggccggcagcgagggcgccgccgagggcgccatcaccatcgagctggccagctaccccatcagcgacttcgccagctacttccagagcctggacccctggaacaacagcagaaacccctggttcagagagttctgggagcagagattcagatgcagcttcagacagagagactgcgccgcccacagcctgagagccgtgcccttcgagcaggagagcaagatcatgttcgtggtgaacgccgtgtacgccatggcccacgccctgcacaacatgcacagagccctgtgccccaacaccaccagactgtgcgacgccatgagacccgtgaacggcagaagactgtacaaggacttcgtgctgaacgtgaagttcgacgcccccttcagacccgccgacacccacaacgaggtgagattcgacagattcggcgacggcatcggcagatacaacatcttcacctacctgagagccggcagcggcagatacagataccagaaggtgggctactgggccgagggcctgaccctggacaccagcctgatcccctgggccagccccagcgccggccccctgcccgccagcagatgcagcgagccctgcctgcagaacgaggtgaagagcgtgcagcccggcgaggtgtgctgctggctgtgcatcccctgccagccctacgagtacagactggacgagttcacctgcgccgactgcggcctgggctactggcccaacgccagcctgaccggctgcttcgagctgccccaggagtacatcagatggggcgacgcctgggccgtgggccccgtgaccatcgcctgcctgggcgccctggccaccctgttcgtgctgggcgtgttcgtgagacacaacgccacccccgtggtgaaggccagcggcagagagctgtgctacatcctgctgggcggcgtgttcctgtgctactgcatgaccttcatcttcatcgccaagcccagcaccgccgtgtgcaccctgagaagactgggcctgggcaccgccttcagcgtgtgctacagcgccctgctgaccaagaccaacagaatcgccagaatcttcggcggcgccagagagggcgcccagagacccagattcatcagccccgccagccaggtggccatctgcctggccctgatcagcggccagctgctgatcgtggtggcctggctggtggtggaggcccccggcaccggcaaggagaccgcccccgagagaagagaggtggtgaccctgagatgcaaccacagagacgccagcatgctgggcagcctggcctacaacgtgctgctgatcgccctgtgcaccctgtacgccttcaagaccagaaagtgccccgagaacttcaacgaggccaagttcatcggcttcaccatgtacaccacctgcatcatctggctggccttcctgcccatcttctacgtgaccagcagcgactacagagtgcagaccaccaccatgtgcgtgagcgtgagcctgagcggcagcgtggtgctgggctgcctgttcgcccccaagctgcacatcatcctgttccagccccagaagaacgtggtgagccacagagcccccaccagcagattcggcagcgccgccgccagagccagcagcagcctgggccagggcagcggcagccagttcgtgcccaccgtgtgcaacggcagagaggtggtggacagcaccaccagcagcctgtag

SEQ ID NO: 83191 - DNA, 213 bp, Artificial Sequence
  Description of Artificial Sequence: Synthetic coding sequence
atgggcagcctgctggccctgctggccctgctgctgctgtggggcgccgtggccgagggccccgccaagaaggtgctgaccctggagggcgacctggtgctgggcggcctgttccccgtgcaccagaagggcggccccgccgaggactgcggccccgtgaacgagcacagaggcatccagagactggaggccatgctgttcgccctggactag

SEQ ID NO: 83192 - DNA, 2640 bp, Artificial Sequence
  Description of Artificial Sequence: Synthetic coding sequence
atgaagatgctgaccagactgcaggtgctgaccctggccctgttcagcaagggcttcctgctgagcctgggcgaccacaacttcctgagaagagagatcaagatcgagggcgacctggtgctgggcggcctgttccccatcaacgagaagggcaccggcaccgaggagtgcggcagaatcaacgaggacagaggcatccagagactggaggccatgctgttcgccatcgacgagatcaacaaggacgactacctgctgcccggcgtgaagctgggcgtgcacatcctggacacctgcagcagagacacctacgccctggagcagagcctggagttcgtgagagccagcctgaccaaggtggacgaggccgagtacatgtgccccgacggcagctacgccatccaggagaacatccccctgctgatcgccggcgtgatcggcggcagctacagcagcgtgagcatccaggtggccaacctgctgagactgttccagatcccccagatcagctacgccagcaccagcgccaagctgagcgacaagagcagatacgactacttcgccagaaccgtgccccccgacttctaccaggccaaggccatggccgagatcctgagattcttcaactggacctacgtgagcaccgtggccagcgagggcgactacggcgagaccggcatcgaggccttcgagcaggaggccagactgagaaacatctgcatcgccaccgccgagaaggtgggcagaagcaacatcagaaagagctacgacagcgtgatcagagagctgctgcagaagcccaacgccagagtggtggtgctgttcatgagaagcgacgacagcagagagctgatcgccgccgccagcagagccaacgccagcttcacctgggtggccagcgacggctggggcgcccaggagagcatcatcaagggcagcgagcacgtggcctacggcgccatcaccctggagctggccagccagcccgtgagacagttcgacagatacttccagagcctgaacccctacaacaaccacagaaacccctggttcagagacttctgggagcagaagttccagtgcagcctgcagaacaagagaaaccacagaagagtgtgcgacaagcacctggccatcgacagcagcaactacgagcaggagagcaagatcatgttcgtggtgaacgccgtgtacgccatggcccacgccctgcacaagatgcagagaaccctgtgccccaacaccaccaagctgtgcgacgccatgaagatcctggacggcaagaagctgtacaaggactacctgctgaagatcaacttcaccgcccccttcaaccccaacaaggacgccgacagcatcgtgaagttcgacaccttcggcgacggcatgggcagatacaacgtgttcaacttccagaacgtgggcggcaagtacagctacctgaaggtgggccactgggccgagaccctgagcctggacgtgaacagcatccactggagcagaaacagcgtgcccaccagccagtgcagcgacccctgcgcccccaacgagatgaagaacatgcagcccggcgacgtgtgctgctggatctgcatcccctgcgagccctacgagtacctggccgacgagttcacctgcatggactgcggcagcggccagtggcccaccgccgacctgaccggctgctacgacctgcccgaggactacatcagatgggaggacgcctgggccatcggccccgtgaccatcgcctgcctgggcttcatgtgcacctgcatggtggtgaccgtgttcatcaagcacaacaacacccccctggtgaaggccagcggcagagagctgtgctacatcctgctgttcggcgtgggcctgagctactgcatgaccttcttcttcatcgccaagcccagccccgtgatctgcgccctgagaagactgggcctgggcagcagcttcgccatctgctacagcgccctgctgaccaagaccaactgcatcgccagaatcttcgacggcgtgaagaacggcgcccagagacccaagttcatcagccccagcagccaggtgttcatctgcctgggcctgatcctggtgcagatcgtgatggtgagcgtgtggctgatcctggaggcccccggcaccagaagatacaccctggccgagaagagagagaccgtgatcctgaagtgcaacgtgaaggacagcagcatgctgatcagcctgacctacgacgtgatcctggtgatcctgtgcaccgtgtacgccttcaagaccagaaagtgccccgagaacttcaacgaggccaagttcatcggcttcaccatgtacaccacctgcatcatctggctggccttcctgcccatcttctacgtgaccagcagcgactacagagtgcagaccaccaccatgtgcatcagcgtgagcctgagcggcttcgtggtgctgggctgcctgttcgcccccaaggtgcacatcatcctgttccagccccagaagaacgtggtgacccacagactgcacctgaacagattcagcgtgagcggcaccggcaccacctacagccagagcagcgccagcacctacgtgcccaccgtgtgcaacggcagagaggtgctggacagcaccaccagcagcctgtag

SEQ ID NO: 83193 - DNA, 1608 bp, Artificial Sequence
  Description of Artificial Sequence: Synthetic coding sequence
atgctgaccagactgcaggtgctgaccctggccctgttcagcaagggcttcctgctgagcctgggcgaccacaacttcctgagaagagagatcaagatcgagggcgacctggtgctgggcggcctgttccccatcaacgagaagggcaccggcaccgaggagtgcggcagaatcaacgaggacagaggcatccagagactggaggccatgctgttcgccatcgacgagatcaacaaggacgactacctgctgcccggcgtgaagctgggcgtgcacatcctggacacctgcagcagagacacctacgccctggagcagagcctggagttcgtgagagccagcctgaccaaggtggacgaggccgagtacatgtgccccgacggcagctacgccatccaggagaacatccccctgctgatcgccggcgtgatcggcggcagctacagcagcgtgagcatccaggtggccaacctgctgagactgttccagatcccccagatcagctacgccagcaccagcgccaagctgagcgacaagagcagatacgactacttcgccagaaccgtgccccccgacttctaccaggccaaggccatggccgagatcctgagattcttcaactggacctacgtgagcaccgtggccagcgagggcgactacggcgagaccggcatcgaggccttcgagcaggaggccagactgagaaacatctgcatcgccaccgccgagaaggtgggcagaagcaacatcagaaagagctacgacagcgtgatcagagagctgctgcagaagcccaacgccagagtggtggtgctgttcatgagaagcgacgacagcagagagctgatcgccgccgccagcagagccaacgccagcttcacctgggtggccagcgacggctggggcgcccaggagagcatcatcaagggcagcgagcacgtggcctacggcgccatcaccctggagctggccagccagcccgtgagacagttcgacagatacttccagagcctgaacccctacaacaaccacagaaacccctggttcagagacttctgggagcagaagttccagtgcagcctgcagaacaagagaaaccacagaagagtgtgcgacaagcacctggccatcgacagcagcaactacgagcaggagagcaagatcatgttcgtggtgaacgccgtgtacgccatggcccacgccctgcacaagatgcagagaaccctgtgccccaacaccaccaagctgtgcgacgccatgaagatcctggacggcaagaagctgtacaaggactacctgctgaagatcaacttcaccggcgccgacgacaaccacgtgcacctgtgccagcccgagtggctgtgcggcctgggcctgttcgtgtgcacccagggcagccaccaccccgtgagcacccccgaggagtgctgccacacccagaccgccccccagcaggtgcagtgccagtggaactgggaccacatcctgagcgtgctgtgcaagcacgtgtgcgccaacggcgtgcagtgggccggcagccccagactgcaccacctgatcagcgtgatcgtgaactgcagcagcgtgctggtgttcctggactgctag

SEQ ID NO: 83194 - DNA, 264 bp, Artificial Sequence
  Description of Artificial Sequence: Synthetic coding sequence
atgaagatgctgaccagactgcaggtgctgaccctggccctgttcagcaagggcttcctgctgagcctgggcgaccacaacttcctgagaagagagatcaagatcgagggcgacctggtgctgggcggcctgttccccatcaacgagaagggcaccggcaccgaggagtgcggcagaatcaacgaggacagaggcatccagagactggaggccatgctgttcgccatcgacgagatcaacaaggacgactacctgctgccctag

SEQ ID NO: 83195 - DNA, 1614 bp, Artificial Sequence
  Description of Artificial Sequence: Synthetic coding sequence
atgaagatgctgaccagactgcaggtgctgaccctggccctgttcagcaagggcttcctgctgagcctgggcgaccacaacttcctgagaagagagatcaagatcgagggcgacctggtgctgggcggcctgttccccatcaacgagaagggcaccggcaccgaggagtgcggcagaatcaacgaggacagaggcatccagagactggaggccatgctgttcgccatcgacgagatcaacaaggacgactacctgctgcccggcgtgaagctgggcgtgcacatcctggacacctgcagcagagacacctacgccctggagcagagcctggagttcgtgagagccagcctgaccaaggtggacgaggccgagtacatgtgccccgacggcagctacgccatccaggagaacatccccctgctgatcgccggcgtgatcggcggcagctacagcagcgtgagcatccaggtggccaacctgctgagactgttccagatcccccagatcagctacgccagcaccagcgccaagctgagcgacaagagcagatacgactacttcgccagaaccgtgccccccgacttctaccaggccaaggccatggccgagatcctgagattcttcaactggacctacgtgagcaccgtggccagcgagggcgactacggcgagaccggcatcgaggccttcgagcaggaggccagactgagaaacatctgcatcgccaccgccgagaaggtgggcagaagcaacatcagaaagagctacgacagcgtgatcagagagctgctgcagaagcccaacgccagagtggtggtgctgttcatgagaagcgacgacagcagagagctgatcgccgccgccagcagagccaacgccagcttcacctgggtggccagcgacggctggggcgcccaggagagcatcatcaagggcagcgagcacgtggcctacggcgccatcaccctggagctggccagccagcccgtgagacagttcgacagatacttccagagcctgaacccctacaacaaccacagaaacccctggttcagagacttctgggagcagaagttccagtgcagcctgcagaacaagagaaaccacagaagagtgtgcgacaagcacctggccatcgacagcagcaactacgagcaggagagcaagatcatgttcgtggtgaacgccgtgtacgccatggcccacgccctgcacaagatgcagagaaccctgtgccccaacaccaccaagctgtgcgacgccatgaagatcctggacggcaagaagctgtacaaggactacctgctgaagatcaacttcaccggcgccgacgacaaccacgtgcacctgtgccagcccgagtggctgtgcggcctgggcctgttcgtgtgcacccagggcagccaccaccccgtgagcacccccgaggagtgctgccacacccagaccgccccccagcaggtgcagtgccagtggaactgggaccacatcctgagcgtgctgtgcaagcacgtgtgcgccaacggcgtgcagtgggccggcagccccagactgcaccacctgatcagcgtgatcgtgaactgcagcagcgtgctggtgttcctggactgctag

SEQ ID NO: 83196 - DNA, 246 bp, Artificial Sequence
  Description of Artificial Sequence: Synthetic coding sequence
atgaagatgctgaccagactgcaggtgctgaccctggccctgttcagcaagggcttcctgctgagcctgggcgaccacaacttcctgagaagagagatcaagatcgagggcgacctggtgctgggcggcctgttccccatcaacgagaagggcaccggcaccgaggagtgcggcagaatcaacgaggacagaggcatccagagactggaggccatgctgttcgccatcgacgagatcaacaagtag

SEQ ID NO: 83197 - DNA, 2256 bp, Artificial Sequence
  Description of Artificial Sequence: Synthetic coding sequence
atgagccagagccccggcgccggcagccccccccccctgccccccagaagcgcccccgtgcccgccagaagctgcagatgcgaggtggccaacctgctgagactgttccagatcccccagatcagctacgccagcaccagcgccaagctgagcgacaagagcagatacgactacttcgccagaaccgtgccccccgacttctaccaggccaaggccatggccgagatcctgagattcttcaactggacctacgtgagcaccgtggccagcgagggcgactacggcgagaccggcatcgaggccttcgagcaggaggccagactgagaaacatctgcatcgccaccgccgagaaggtgggcagaagcaacatcagaaagagctacgacagcgtgatcagagagctgctgcagaagcccaacgccagagtggtggtgctgttcatgagaagcgacgacagcagagagctgatcgccgccgccagcagagccaacgccagcttcacctgggtggccagcgacggctggggcgcccaggagagcatcatcaagggcagcgagcacgtggcctacggcgccatcaccctggagctggccagccagcccgtgagacagttcgacagatacttccagagcctgaacccctacaacaaccacagaaacccctggttcagagacttctgggagcagaagttccagtgcagcctgcagaacaagagaaaccacagaagagtgtgcgacaagcacctggccatcgacagcagcaactacgagcaggagagcaagatcatgttcgtggtgaacgccgtgtacgccatggcccacgccctgcacaagatgcagagaaccctgtgccccaacaccaccaagctgtgcgacgccatgaagatcctggacggcaagaagctgtacaaggactacctgctgaagatcaacttcaccgcccccttcaaccccaacaaggacgccgacagcatcgtgaagttcgacaccttcggcgacggcatgggcagatacaacgtgttcaacttccagaacgtgggcggcaagtacagctacctgaaggtgggccactgggccgagaccctgagcctggacgtgaacagcatccactggagcagaaacagcgtgcccaccagccagtgcagcgacccctgcgcccccaacgagatgaagaacatgcagcccggcgacgtgtgctgctggatctgcatcccctgcgagccctacgagtacctggccgacgagttcacctgcatggactgcggcagcggccagtggcccaccgccgacctgaccggctgctacgacctgcccgaggactacatcagatgggaggacgcctgggccatcggccccgtgaccatcgcctgcctgggcttcatgtgcacctgcatggtggtgaccgtgttcatcaagcacaacaacacccccctggtgaaggccagcggcagagagctgtgctacatcctgctgttcggcgtgggcctgagctactgcatgaccttcttcttcatcgccaagcccagccccgtgatctgcgccctgagaagactgggcctgggcagcagcttcgccatctgctacagcgccctgctgaccaagaccaactgcatcgccagaatcttcgacggcgtgaagaacggcgcccagagacccaagttcatcagccccagcagccaggtgttcatctgcctgggcctgatcctggtgcagatcgtgatggtgagcgtgtggctgatcctggaggcccccggcaccagaagatacaccctggccgagaagagagagaccgtgatcctgaagtgcaacgtgaaggacagcagcatgctgatcagcctgacctacgacgtgatcctggtgatcctgtgcaccgtgtacgccttcaagaccagaaagtgccccgagaacttcaacgaggccaagttcatcggcttcaccatgtacaccacctgcatcatctggctggccttcctgcccatcttctacgtgaccagcagcgactacagagtgcagaccaccaccatgtgcatcagcgtgagcctgagcggcttcgtggtgctgggctgcctgttcgcccccaaggtgcacatcatcctgttccagccccagaagaacgtggtgacccacagactgcacctgaacagattcagcgtgagcggcaccggcaccacctacagccagagcagcgccagcacctacgtgcccaccgtgtgcaacggcagagaggtgctggacagcaccaccagcagcctgtag

SEQ ID NO: 83198 - DNA, 1416 bp, Artificial Sequence
  Description of Artificial Sequence: Synthetic coding sequence
atgagaagaaccaaccacgagcccgagcccggctgcagactgaccgccgccgccgccaccgccgtgagcagcagcagctgccaggagctgagcgtgagagcccccttcaaccccaacaaggacgccgacagcatcgtgaagttcgacaccttcggcgacggcatgggcagatacaacgtgttcaacttccagaacgtgggcggcaagtacagctacctgaaggtgggccactgggccgagaccctgagcctggacgtgaacagcatccactggagcagaaacagcgtgcccaccagccagtgcagcgacccctgcgcccccaacgagatgaagaacatgcagcccggcgacgtgtgctgctggatctgcatcccctgcgagccctacgagtacctggccgacgagttcacctgcatggactgcggcagcggccagtggcccaccgccgacctgaccggctgctacgacctgcccgaggactacatcagatgggaggacgcctgggccatcggccccgtgaccatcgcctgcctgggcttcatgtgcacctgcatggtggtgaccgtgttcatcaagcacaacaacacccccctggtgaaggccagcggcagagagctgtgctacatcctgctgttcggcgtgggcctgagctactgcatgaccttcttcttcatcgccaagcccagccccgtgatctgcgccctgagaagactgggcctgggcagcagcttcgccatctgctacagcgccctgctgaccaagaccaactgcatcgccagaatcttcgacggcgtgaagaacggcgcccagagacccaagttcatcagccccagcagccaggtgttcatctgcctgggcctgatcctggtgcagatcgtgatggtgagcgtgtggctgatcctggaggcccccggcaccagaagatacaccctggccgagaagagagagaccgtgatcctgaagtgcaacgtgaaggacagcagcatgctgatcagcctgacctacgacgtgatcctggtgatcctgtgcaccgtgtacgccttcaagaccagaaagtgccccgagaacttcaacgaggccaagttcatcggcttcaccatgtacaccacctgcatcatctggctggccttcctgcccatcttctacgtgaccagcagcgactacagagtgcagaccaccaccatgtgcatcagcgtgagcctgagcggcttcgtggtgctgggctgcctgttcgcccccaaggtgcacatcatcctgttccagccccagaagaacgtggtgacccacagactgcacctgaacagattcagcgtgagcggcaccggcaccacctacagccagagcagcgccagcacctacgtgcccaccgtgtgcaacggcagagaggtgctggacagcaccaccagcagcctgtag

SEQ ID NO: 83199 - DNA, 2391 bp, Artificial Sequence
  Description of Artificial Sequence: Synthetic coding sequence
atgcccgcctgggagcccggcgtggccgccagctgcggctggagagcccccccctgcagccccctgagactgtgcatcgccccccacccctgcaccccccccagcagccaccagggcaacctgacctgcagactgccccccagaagcttcggcttctgcagatgcgtgtgggtgagaaccagaggccccagcctgcccggcgagcaggtgagcctggccgcccacgagagcgagggcgccgccgcccagctgggcagcagccccgagatcgaccccagaagacccagatgcctgctgcccgagagcgcccagatcccccagatcagctacgccagcaccgcccccgacctgagcgacaacagcagatacgacttcttcagcagagtggtgcccagcgacacctaccaggcccaggccatggtggacatcgtgagagccctgaagtggaactacgtgagcaccgtggccagcgagggcagctacggcgagagcggcgtggaggccttcatccagaagagcagagaggacggcggcgtgtgcatcgcccagagcgtgaagatccccagagagcccaaggccggcgagttcgacaagatcatcagaagactgctggagaccagcaacgccagagccgtgatcatcttcgccaacgaggacgacatcagaagagtgctggaggccgccagaagagccaaccagaccggccacttcttctggatgggcagcgacagctggggcagcaagatcgcccccgtgctgcacctggaggaggtggccgagggcgccgtgaccatcctgcccaagagaatgagcgtgagagacagagagagaatcggccaggacagcgcctacgagcaggagggcaaggtgcagttcgtgatcgacgccgtgtacgccatgggccacgccctgcacgccatgcacagagacctgtgccccggcagagtgggcctgtgccccagaatggaccccgtggacggcacccagctgctgaagtacatcagaaacgtgaacttcagcggcatcgccggcaaccccgtgaccttcaacgagaacggcgacgcccccggcagatacgacatctaccagtaccagctgagaaacgacagcgccgagtacaaggtgatcggcagctggaccgaccacctgcacctgagaatcgagagaatgcactggcccggcagcggccagcagctgcccagaagcatctgcagcctgccctgccagcccggcgagagaaagaagaccgtgaagggcatgccctgctgctggcactgcgagccctgcaccggctaccagtaccaggtggacagatacacctgcaagacctgcccctacgacatgagacccaccgagaacagaaccggctgcagacccatccccatcatcaagctggagtggggcagcccctgggccgtgctgcccctgttcctggccgtggtgggcatcgccgccaccctgttcgtggtgatcaccttcgtgagatacaacgacacccccatcgtgaaggccagcggcagagagctgagctacgtgctgctggccggcatcttcctgtgctacgccaccaccttcctgatgatcgccgagcccgacctgggcacctgcagcctgagaagaatcttcctgggcctgggcatgagcatcagctacgccgccctgctgaccaagaccaacagaatctacagaatcttcgagcagggcaagagaagcgtgagcgcccccagattcatcagccccgccagccagctggccatcaccttcagcctgatcagcctgcagctgctgggcatctgcgtgtggttcgtggtggaccccagccacagcgtggtggacttccaggaccagagaaccctggaccccagattcgccagaggcgtgctgaagtgcgacatcagcgacctgagcctgatctgcctgctgggctacagcatgctgctgatggtgacctgcaccgtgtacgccatcaagaccagaggcgtgcccgagaccttcaacgaggccaagcccatcggcttcaccatgtacaccacctgcatcgtgtggctggccttcatccccatcttcttcggcaccagccagagcgccgacaagctgtacatccagaccaccaccctgaccgtgagcgtgagcctgagcgccagcgtgagcctgggcatgctgtacatgcccaaggtgtacatcatcctgttccaccccgagcagaacgtgcccaagagaaagagaagcctgaaggccgtggtgaccgccgccaccatgagcaacaagttcacccagaagggcaacttcagacccaacggcgaggccaagagcgagctgtgcgagaacctggaggcccccgccctggccaccaagcagacctacgtgacctacaccaaccacgccatctag

SEQ ID NO: 83200 - DNA, 2739 bp, Artificial Sequence
  Description of Artificial Sequence: Synthetic coding sequence
atgcccggcaagagaggcctgggctggtggtgggccagactgcccctgtgcctgctgctgagcctgtacggcccctggatgcccagcagcctgggcaagcccaagggccacccccacatgaacagcatcagaatcgacggcgacatcaccctgggcggcctgttccccgtgcacggcagaggcagcgagggcaagccctgcggcgagctgaagaaggagaagggcatccacagactggaggccatgctgttcgccctggacagaatcaacaacgaccccgacctgctgcccaacatcaccctgggcgccagaatcctggacacctgcagcagagacacccacgccctggagcagagcctgaccttcgtgcaggccctgatcgagaaggacggcaccgaggtgagatgcggcagcggcggcccccccatcatcaccaagcccgagagagtggtgggcgtgatcggcgccagcggcagcagcgtgagcatcatggtggccaacatcctgagactgttcaagatcccccagatcagctacgccagcaccgcccccgacctgagcgacaacagcagatacgacttcttcagcagagtggtgcccagcgacacctaccaggcccaggccatggtggacatcgtgagagccctgaagtggaactacgtgagcaccgtggccagcgagggcagctacggcgagagcggcgtggaggccttcatccagaagagcagagaggacggcggcgtgtgcatcgcccagagcgtgaagatccccagagagcccaaggccggcgagttcgacaagatcatcagaagactgctggagaccagcaacgccagagccgtgatcatcttcgccaacgaggacgacatcagaagagtgctggaggccgccagaagagccaaccagaccggccacttcttctggatgggcagcgacagctggggcagcaagatcgcccccgtgctgcacctggaggaggtggccgagggcgccgtgaccatcctgcccaagagaatgagcgtgagaggcttcgacagatacttcagcagcagaaccctggacaacaacagaagaaacatctggttcgccgagttctgggaggacaacttccactgcaagctgagcagacacgccctgaagaagggcagccacgtgaagaagtgcaccaacagagagagaatcggccaggacagcgcctacgagcaggagggcaaggtgcagttcgtgatcgacgccgtgtacgccatgggccacgccctgcacgccatgcacagagacctgtgccccggcagagtgggcctgtgccccagaatggaccccgtggacggcacccagctgctgaagtacatcagaaacgtgaacttcagcggcatcgccggcaaccccgtgaccttcaacgagaacggcgacgcccccggcagatacgacatctaccagtaccagctgagaaacgacagcgccgagtacaaggtgatcggcagctggaccgaccacctgcacctgagaatcgagagaatgcactggcccggcagcggccagcagctgcccagaagcatctgcagcctgccctgccagcccggcgagagaaagaagaccgtgaagggcatgccctgctgctggcactgcgagccctgcaccggctaccagtaccaggtggacagatacacctgcaagacctgcccctacgacatgagacccaccgagaacagaaccggctgcagacccatccccatcatcaagctggagtggggcagcccctgggccgtgctgcccctgttcctggccgtggtgggcatcgccgccaccctgttcgtggtgatcaccttcgtgagatacaacgacacccccatcgtgaaggccagcggcagagagctgagctacgtgctgctggccggcatcttcctgtgctacgccaccaccttcctgatgatcgccgagcccgacctgggcacctgcagcctgagaagaatcttcctgggcctgggcatgagcatcagctacgccgccctgctgaccaagaccaacagaatctacagaatcttcgagcagggcaagagaagcgtgagcgcccccagattcatcagccccgccagccagctggccatcaccttcagcctgatcagcctgcagctgctgggcatctgcgtgtggttcgtggtggaccccagccacagcgtggtggacttccaggaccagagaaccctggaccccagattcgccagaggcgtgctgaagtgcgacatcagcgacctgagcctgatctgcctgctgggctacagcatgctgctgatggtgacctgcaccgtgtacgccatcaagaccagaggcgtgcccgagaccttcaacgaggccaagcccatcggcttcaccatgtacaccacctgcatcgtgtggctggccttcatccccatcttcttcggcaccagccagagcgccgacaagctgtacatccagaccaccaccctgaccgtgagcgtgagcctgagcgccagcgtgagcctgggcatgctgtacatgcccaaggtgtacatcatcctgttccaccccgagcagaacgtgcccaagagaaagagaagcctgaaggccgtggtgaccgccgccaccatgagcaacaagttcacccagaagggcaacttcagacccaacggcgaggccaagagcgagctgtgcgagaacctggaggcccccgccctggccaccaagcagacctacgtgacctacaccaaccacgccatctag

SEQ ID NO: 83201 - DNA, 2319 bp, Artificial Sequence
  Description of Artificial Sequence: Synthetic coding sequence
atggtgcagaccctgcccaagctgttcccccacgacggcgccaagagaaagaagagaaccctgagaaccagcggcccctgcttcggcggcggcggccagatcccccagatcagctacgccagcaccgcccccgacctgagcgacaacagcagatacgacttcttcagcagagtggtgcccagcgacacctaccaggcccaggccatggtggacatcgtgagagccctgaagtggaactacgtgagcaccgtggccagcgagggcagctacggcgagagcggcgtggaggccttcatccagaagagcagagaggacggcggcgtgtgcatcgcccagagcgtgaagatccccagagagcccaaggccggcgagttcgacaagatcatcagaagactgctggagaccagcaacgccagagccgtgatcatcttcgccaacgaggacgacatcagaagagtgctggaggccgccagaagagccaaccagaccggccacttcttctggatgggcagcgacagctggggcagcaagatcgcccccgtgctgcacctggaggaggtggccgagggcgccgtgaccatcctgcccaagagaatgagcgtgagaggcttcgacagatacttcagcagcagaaccctggacaacaacagaagaaacatctggttcgccgagttctgggaggacaacttccactgcaagctgagcagacacgccctgaagaagggcagccacgtgaagaagtgcaccaacagagagagaatcggccaggacagcgcctacgagcaggagggcaaggtgcagttcgtgatcgacgccgtgtacgccatgggccacgccctgcacgccatgcacagagacctgtgccccggcagagtgggcctgtgccccagaatggaccccgtggacggcacccagctgctgaagtacatcagaaacgtgaacttcagcggcatcgccggcaaccccgtgaccttcaacgagaacggcgacgcccccggcagatacgacatctaccagtaccagctgagaaacgacagcgccgagtacaaggtgatcggcagctggaccgaccacctgcacctgagaatcgagagaatgcactggcccggcagcggccagcagctgcccagaagcatctgcagcctgccctgccagcccggcgagagaaagaagaccgtgaagggcatgccctgctgctggcactgcgagccctgcaccggctaccagtaccaggtggacagatacacctgcaagacctgcccctacgacatgagacccaccgagaacagaaccggctgcagacccatccccatcatcaagctggagtggggcagcccctgggccgtgctgcccctgttcctggccgtggtgggcatcgccgccaccctgttcgtggtgatcaccttcgtgagatacaacgacacccccatcgtgaaggccagcggcagagagctgagctacgtgctgctggccggcatcttcctgtgctacgccaccaccttcctgatgatcgccgagcccgacctgggcacctgcagcctgagaagaatcttcctgggcctgggcatgagcatcagctacgccgccctgctgaccaagaccaacagaatctacagaatcttcgagcagggcaagagaagcgtgagcgcccccagattcatcagccccgccagccagctggccatcaccttcagcctgatcagcctgcagctgctgggcatctgcgtgtggttcgtggtggaccccagccacagcgtggtggacttccaggaccagagaaccctggaccccagattcgccagaggcgtgctgaagtgcgacatcagcgacctgagcctgatctgcctgctgggctacagcatgctgctgatggtgacctgcaccgtgtacgccatcaagaccagaggcgtgcccgagaccttcaacgaggccaagcccatcggcttcaccatgtacaccacctgcatcgtgtggctggccttcatccccatcttcttcggcaccagccagagcgccgacaagctgtacatccagaccaccaccctgaccgtgagcgtgagcctgagcgccagcgtgagcctgggcatgctgtacatgcccaaggtgtacatcatcctgttccaccccgagcagaacgtgcccaagagaaagagaagcctgaaggccgtggtgaccgccgccaccatgagcaacaagttcacccagaagggcaacttcagacccaacggcgaggccaagagcgagctgtgcgagaacctggaggcccccgccctggccaccaagcagacctacgtgacctacaccaaccacgccatctag

SEQ ID NO: 83202 - DNA, 2340 bp, Artificial Sequence
  Description of Artificial Sequence: Synthetic coding sequence
atggccgtgcccctgggcgccccctgctgggccagcgccctgcccgcctgggccccccccggcctgccccacagaagcctgctgaccagactgctgagccagcacgtgaagcccgccaagatcccccagatcagctacgccagcaccgcccccgacctgagcgacaacagcagatacgacttcttcagcagagtggtgcccagcgacacctaccaggcccaggccatggtggacatcgtgagagccctgaagtggaactacgtgagcaccgtggccagcgagggcagctacggcgagagcggcgtggaggccttcatccagaagagcagagaggacggcggcgtgtgcatcgcccagagcgtgaagatccccagagagcccaaggccggcgagttcgacaagatcatcagaagactgctggagaccagcaacgccagagccgtgatcatcttcgccaacgaggacgacatcagaagagtgctggaggccgccagaagagccaaccagaccggccacttcttctggatgggcagcgacagctggggcagcaagatcgcccccgtgctgcacctggaggaggtggccgagggcgccgtgaccatcctgcccaagagaatgagcgtgagaggcttcgacagatacttcagcagcagaaccctggacaacaacagaagaaacatctggttcgccgagttctgggaggacaacttccactgcaagctgagcagacacgccctgaagaagggcagccacgtgaagaagtgcaccaacagagagagaatcggccaggacagcgcctacgagcaggagggcaaggtgcagttcgtgatcgacgccgtgtacgccatgggccacgccctgcacgccatgcacagagacctgtgccccggcagagtgggcctgtgccccagaatggaccccgtggacggcacccagctgctgaagtacatcagaaacgtgaacttcagcggcatcgccggcaaccccgtgaccttcaacgagaacggcgacgcccccggcagatacgacatctaccagtaccagctgagaaacgacagcgccgagtacaaggtgatcggcagctggaccgaccacctgcacctgagaatcgagagaatgcactggcccggcagcggccagcagctgcccagaagcatctgcagcctgccctgccagcccggcgagagaaagaagaccgtgaagggcatgccctgctgctggcactgcgagccctgcaccggctaccagtaccaggtggacagatacacctgcaagacctgcccctacgacatgagacccaccgagaacagaaccggctgcagacccatccccatcatcaagctggagtggggcagcccctgggccgtgctgcccctgttcctggccgtggtgggcatcgccgccaccctgttcgtggtgatcaccttcgtgagatacaacgacacccccatcgtgaaggccagcggcagagagctgagctacgtgctgctggccggcatcttcctgtgctacgccaccaccttcctgatgatcgccgagcccgacctgggcacctgcagcctgagaagaatcttcctgggcctgggcatgagcatcagctacgccgccctgctgaccaagaccaacagaatctacagaatcttcgagcagggcaagagaagcgtgagcgcccccagattcatcagccccgccagccagctggccatcaccttcagcctgatcagcctgcagctgctgggcatctgcgtgtggttcgtggtggaccccagccacagcgtggtggacttccaggaccagagaaccctggaccccagattcgccagaggcgtgctgaagtgcgacatcagcgacctgagcctgatctgcctgctgggctacagcatgctgctgatggtgacctgcaccgtgtacgccatcaagaccagaggcgtgcccgagaccttcaacgaggccaagcccatcggcttcaccatgtacaccacctgcatcgtgtggctggccttcatccccatcttcttcggcaccagccagagcgccgacaagctgtacatccagaccaccaccctgaccgtgagcgtgagcctgagcgccagcgtgagcctgggcatgctgtacatgcccaaggtgtacatcatcctgttccaccccgagcagaacgtgcccaagagaaagagaagcctgaaggccgtggtgaccgccgccaccatgagcaacaagttcacccagaagggcaacttcagacccaacggcgaggccaagagcgagctgtgcgagaacctggaggcccccgccctggccaccaagcagacctacgtgacctacaccaaccacgccatctag

SEQ ID NO: 83203 - DNA, 2739 bp, Artificial Sequence; identical to SEQ ID NO: 83200
  Description of Artificial Sequence: Synthetic coding sequence

SEQ ID NO: 83204 - DNA, 2232 bp, Artificial Sequence
  Description of Artificial Sequence: Synthetic coding sequence
atgagctgcaagatcccccagatcagctacgccagcaccgcccccgacctgagcgacaacagcagatacgacttcttcagcagagtggtgcccagcgacacctaccaggcccaggccatggtggacatcgtgagagccctgaagtggaactacgtgagcaccgtggccagcgagggcagctacggcgagagcggcgtggaggccttcatccagaagagcagagaggacggcggcgtgtgcatcgcccagagcgtgaagatccccagagagcccaaggccggcgagttcgacaagatcatcagaagactgctggagaccagcaacgccagagccgtgatcatcttcgccaacgaggacgacatcagaagagtgctggaggccgccagaagagccaaccagaccggccacttcttctggatgggcagcgacagctggggcagcaagatcgcccccgtgctgcacctggaggaggtggccgagggcgccgtgaccatcctgcccaagagaatgagcgtgagaggcttcgacagatacttcagcagcagaaccctggacaacaacagaagaaacatctggttcgccgagttctgggaggacaacttccactgcaagctgagcagacacgccctgaagaagggcagccacgtgaagaagtgcaccaacagagagagaatcggccaggacagcgcctacgagcaggagggcaaggtgcagttcgtgatcgacgccgtgtacgccatgggccacgccctgcacgccatgcacagagacctgtgccccggcagagtgggcctgtgccccagaatggaccccgtggacggcacccagctgctgaagtacatcagaaacgtgaacttcagcggcatcgccggcaaccccgtgaccttcaacgagaacggcgacgcccccggcagatacgacatctaccagtaccagctgagaaacgacagcgccgagtacaaggtgatcggcagctggaccgaccacctgcacctgagaatcgagagaatgcactggcccggcagcggccagcagctgcccagaagcatctgcagcctgccctgccagcccggcgagagaaagaagaccgtgaagggcatgccctgctgctggcactgcgagccctgcaccggctaccagtaccaggtggacagatacacctgcaagacctgcccctacgacatgagacccaccgagaacagaaccggctgcagacccatccccatcatcaagctggagtggggcagcccctgggccgtgctgcccctgttcctggccgtggtgggcatcgccgccaccctgttcgtggtgatcaccttcgtgagatacaacgacacccccatcgtgaaggccagcggcagagagctgagctacgtgctgctggccggcatcttcctgtgctacgccaccaccttcctgatgatcgccgagcccgacctgggcacctgcagcctgagaagaatcttcctgggcctgggcatgagcatcagctacgccgccctgctgaccaagaccaacagaatctacagaatcttcgagcagggcaagagaagcgtgagcgcccccagattcatcagccccgccagccagctggccatcaccttcagcctgatcagcctgcagctgctgggcatctgcgtgtggttcgtggtggaccccagccacagcgtggtggacttccaggaccagagaaccctggaccccagattcgccagaggcgtgctgaagtgcgacatcagcgacctgagcctgatctgcctgctgggctacagcatgctgctgatggtgacctgcaccgtgtacgccatcaagaccagaggcgtgcccgagaccttcaacgaggccaagcccatcggcttcaccatgtacaccacctgcatcgtgtggctggccttcatccccatcttcttcggcaccagccagagcgccgacaagctgtacatccagaccaccaccctgaccgtgagcgtgagcctgagcgccagcgtgagcctgggcatgctgtacatgcccaaggtgtacatcatcctgttccaccccgagcagaacgtgcccaagagaaagagaagcctgaaggccgtggtgaccgccgccaccatgagcaacaagttcacccagaagggcaacttcagacccaacggcgaggccaagagcgagctgtgcgagaacctggaggcccccgccctggccaccaagcagacctacgtgacctacaccaaccacgccatctag

SEQ ID NO: 83205 - DNA, 1776 bp, Artificial Sequence
  Description of Artificial Sequence: Synthetic coding sequence
atgggcagcgacagctggggcagcaagatcgcccccgtgctgcacctggaggaggtggccgagggcgccgtgaccatcctgcccaagagaatgagcgtgagaggcttcgacagatacttcagcagcagaaccctggacaacaacagaagaaacatctggttcgccgagttctgggaggacaacttccactgcaagctgagcagacacgccctgaagaagggcagccacgtgaagaagtgcaccaacagagagagaatcggccaggacagcgcctacgagcaggagggcaaggtgcagttcgtgatcgacgccgtgtacgccatgggccacgccctgcacgccatgcacagagacctgtgccccggcagagtgggcctgtgccccagaatggaccccgtggacggcacccagctgctgaagtacatcagaaacgtgaacttcagcggcatcgccggcaaccccgtgaccttcaacgagaacggcgacgcccccggcagatacgacatctaccagtaccagctgagaaacgacagcgccgagtacaaggtgatcggcagctggaccgaccacctgcacctgagaatcgagagaatgcactggcccggcagcggccagcagctgcccagaagcatctgcagcctgccctgccagcccggcgagagaaagaagaccgtgaagggcatgccctgctgctggcactgcgagccctgcaccggctaccagtaccaggtggacagatacacctgcaagacctgcccctacgacatgagacccaccgagaacagaaccggctgcagacccatccccatcatcaagctggagtggggcagcccctgggccgtgctgcccctgttcctggccgtggtgggcatcgccgccaccctgttcgtggtgatcaccttcgtgagatacaacgacacccccatcgtgaaggccagcggcagagagctgagctacgtgctgctggccggcatcttcctgtgctacgccaccaccttcctgatgatcgccgagcccgacctgggcacctgcagcctgagaagaatcttcctgggcctgggcatgagcatcagctacgccgccctgctgaccaagaccaacagaatctacagaatcttcgagcagggcaagagaagcgtgagcgcccccagattcatcagccccgccagccagctggccatcaccttcagcctgatcagcctgcagctgctgggcatctgcgtgtggttcgtggtggaccccagccacagcgtggtggacttccaggaccagagaaccctggaccccagattcgccagaggcgtgctgaagtgcgacatcagcgacctgagcctgatctgcctgctgggctacagcatgctgctgatggtgacctgcaccgtgtacgccatcaagaccagaggcgtgcccgagaccttcaacgaggccaagcccatcggcttcaccatgtacaccacctgcatcgtgtggctggccttcatccccatcttcttcggcaccagccagagcgccgacaagctgtacatccagaccaccaccctgaccgtgagcgtgagcctgagcgccagcgtgagcctgggcatgctgtacatgcccaaggtgtacatcatcctgttccaccccgagcagaacgtgcccaagagaaagagaagcctgaaggccgtggtgaccgccgccaccatgagcaacaagttcacccagaagggcaacttcagacccaacggcgaggccaagagcgagctgtgcgagaacctggaggcccccggcagcagctag

SEQ ID NO: 83206 - DNA, 2364 bp, Artificial Sequence
  Description of Artificial Sequence: Synthetic coding sequence
atggagcccgccggcgagagattccccgagcagagacaggtgctgatcctgctgctgctgctggaggtgaccctggccggctgggagcccagaagatacagcgtgatggaggagaccgagagaggcagcttcgtggccaacctggccaacgacctgggcctgggcgtgggcgagctggccgagagaggcgccagagtggtgagcgaggacaacgagcagggcctgcagctggacctgcagaccggccagctgatcctgaacgagaagctggacagagagaagctgtgcggccccaccgagccctgcatcatgcacttccaggtgctgctgaagaagcccctggaggtgttcagagccgagctgctggtgaccgacatcaacgaccacagccccgagttccccgagagagagatgaccctgaagatccccgagaccagcagcctgggcaccgtgttccccctgaagaaggccagagacctggacgtgggcagcaacaacgtgcagaactacaacatcagccccaacagccacttccacgtgagcaccagaaccagaggcgacggcagaaagtaccccgagctggtgctggacaccgagctggacagagaggagcaggccgagctgagactgaccctgaccgccgtggacggcggcagcccccccagaagcggcaccgtgcagatcctgatcctggtgctggacgccaacgacaacgcccccgagttcgtgcaggccctgtacgaggtgcaggtgcccgagaacagccccgtgggcagcctggtggtgaaggtgagcgccagagacctggacaccggcaccaacggcgagatcagctacagcctgtactacagcagccaggagatcgacaagcccttcgagctgagcagcctgagcggcgagatcagactgatcaagaagctggacttcgagaccatgagcagctacgacctggacatcgaggccagcgacggcggcggcctgagcggcaagtgcagcgtgagcgtgaaggtgctggacgtgaacgacaacttccccgagctgagcatcagcagcctgaccagccccatccccgagaacagccccgagaccgaggtggccctgttcagaatcagagacagagacagcggcgagaacggcaagatgatctgcagcatccaggacgacgtgcccttcaagctgaagcccagcgtggagaacttctacagactggtgaccgagggcgccctggacagagagaccagagccgagtacaacatcaccatcaccatcaccgacctgggcacccccagactgaagaccgagcagagcatcaccgtgctggtgagcgacgtgaacgacaacgcccccgccttcacccagaccagctacaccctgttcgtgagagagaacaacagccccgccctgcacatcggcagcgtgagcgccaccgacagagacagcggcaccaacgcccaggtgacctacagcctgctgccccccagagacccccacctgcccctgaccagcctggtgagcatcaacaccgacaacggccacctgttcgccctgcagagcctggactacgaggccctgcaggccttcgagttcagagtgggcgccaccgacagaggcttccccgccctgagcagcgaggccctggtgagagtgctggtgctggacgccaacgacaacagccccttcgtgctgtaccccctgcagaacggcagcgccccctgcaccgagctggtgcccagagccgccgagcccggctacctggtgaccaaggtggtggccgtggacggcgacagcggccagaacgcctggctgagctaccagctgctgaaggccaccgagcccggcctgttcggcgtgtgggcccacaacggcgaggtgagaaccgccagactgctgagcgagagagacgtggccaagcacagactggtggtgctggtgaaggacaacggcgagccccccagaagcgccaccgccaccctgcaggtgctgctggtggacggcttcagccagccctacctgcccctgcccgaggccgcccccgcccaggcccaggccgacagcctgaccgtgtacctggtggtggccctggccagcgtgagcagcctgttcctgttcagcgtgttcctgttcgtggccgtgagactgtgcagaagaagcagagccgccagcgtgggcagatgcagcgtgcccgagggccccttccccggccacctggtggacgtgagcggcaccggcaccctgagccagagctaccagtacgaggtgtgcctgaccggcggcagcgagagcaacgacttcaagttcctgaagcccatcttccccaacatcgtgagccaggacagcagaagaaagagcgagttcctggagtag

SEQ ID NO: 83207 - DNA, 3276 bp, Artificial Sequence
  Description of Artificial Sequence: Synthetic coding sequence
atgcagctggacggcctgcaggccctgtgctggggcagcctgttcagaacccagctggtgcccgtgtacgtggccgtgctgcccagcccccagccctgcatcccccccacctgcaccgccttcaccgagttcagcggccccctggccaagcaccacagcttccagcccttccaggtggccgcccccgccggccccagaagccccccccagcccttccacctgcccagcgtgagccaggtgcacgccacccacctgctgtgccccgtgagagtgctgggccccccctacccccccagcctggagctgctgaccagcatccacagccccgccgtgctgcccgccccccagatcccccagatcagctacgccagcaccgcccccgagctgagcgacagcaccagatacgacttcttcagcagagtggtgccccccgacagctaccaggcccaggccatggtggacatcgtgagagccctgggctggaactacgtgagcaccctggccagcgagggcaactacggcgagagcggcgtggaggccttcgtgcagatcagcagagaggccggcgagctgggcgcccccagacaccagggcgtgtacatcgtgtgggccagaggcccccagctgggccagaagcagaaggacggcggccccagaagcatgctgggcagaggctgcctggccggcgccccctgcggcagagacctgttcgtgctggacgacagcgccctgccccaggcctggagaagagtgcaggccagactgcacccctgcagacccttcagccagcccacccagagcagcgccgccgtggccagatggagcatcaagatccccagagagcccaagcccggcgagttcagcaaggtgatcagaagactgatggagacccccaacgccagaggcatcatcatcttcgccaacgaggacgacatcagccccgcccccaccagaagagtgctggaggccgccagacaggccaacctgaccggccacttcctgtgggtgggcagcgacagctggggcgccaagaccagccccatcctgagcctggaggacgtggccgtgggcgccatcaccatcctgcccaagagagccagcatcgacggcttcgaccagtacttcatgaccagaagcctggagaacaacagaagaaacatctggttcgccgagttctgggaggagaacttcaactgcaagctgaccagcagcggcacccagagcgacgacagcaccagaaagtgcaccggcgagagctgccccggctggaccggcgaggagagaatcggcagagacagcacctacgagcaggagggcaaggtgcagttcgtgatcgacgccgtgtacgccatcgcccacgccctgcacagcatgcaccaggccctgtgccccggccacaccggcctgtgccccgccatggagcccaccgacggcagaatgctgctgcagtacatcagatgccccctgcagtggctgaacagaatccccctgtgcgagtggcccagaagagtgagacccttcttctgccagtggaccctgggcctgctgagcagctgcggctacgtgaacaacgccgccgtgaacgtggccgtgcaggccttcctggccaccctgctgagcagcctgagcagcatctaccccggcgtggagctgctgggccacgtgttcaacctgctgagaagactgcacaccgtgttctgcagcggctgcagcctgttcccccccaccgtgcacaagggcagcgccggcacccccgtgatgttcaacgagaacggcgacgcccccggcagatacgacatcttccagtaccaggccaccaacggcagcgccagcagcggcggctaccaggccgtgggccagtgggccgagaccctgagactggacgtgagcgtgcagaccgagccccaggtgggcatgggccccggcagcagaagacagaccccccagcccgtgttctgcgccagccaggtggaggccctgcagtggagcggcgacccccacgaggtgcccagcagcctgtgcagcctgccctgcggccccggcgagagaaagaagatggtgaagggcgtgccctgctgctggcactgcgaggcctgcgacggctacagattccaggtggacgagttcacctgcgaggcctgccccggcgacatgagacccacccccaaccacaccggctgcagacccacccccgtggtgagactgagctggagcagcccctgggccgccccccccctgctgctggccgtgctgggcatcgtggccaccaccaccgtggtggccaccttcgtgagatacaacaacacccccatcgtgagagccagcggcagagagctgagctacgtgctgctgaccggcatcttcctgatctacgccatcaccttcctgatggtggccgagcccggcgccgccgtgtgcgccgccagaagactgttcctgggcctgggcaccaccctgagctacagcgccctgctgaccaagaccaacagaatctacagaatcttcgagcagggcaagagaagcgtgacccccccccccttcatcagccccaccagccagctggtgatcaccttcagcctgaccagcctgcagatcaacgccgtgttcagagtgaccctgttctacttcggcagcctgcagtggcactacctgagcagcctgcaggccctgcccagcggcgacctgagcgtgcagcacctgagcgccagcgtgagcctgggcatgctgtacagcaagagcaagacccccgtggacctggaggtgggcagcgagccctggggctacctgggcgacggcgtgctgcaggccgagcactggggcgagggcagaggcgactggccccacgtgaaggtgatggtggtggtgtaccagagcagcctggtgtactacatgaagcaggcccaggccggcagagtgaagaccgagctgctgaaggtggcccaccaccaggtggccaagagcgtgcccgaggagagccagatcgtggtgctgcacctggtgaccgccggctacgtggacatggccatcagaaccaccagagccagcctgcacctgatgcccctgaccctggtgcccggcgccgccgccgaggtgaacgagacccaggtggccgccagactgggccccggcagcaccgtgggcacctaccaggtggtggtggtgctgatgagaagcctgcagatcgacaagaccaccaaccagctgagcctggagacctgcttcagcggcatccagggcttcctggccagcgtgaacagcctggtgatggacaagtag

SEQ ID NO: 83208 - DNA, 2634 bp, Artificial Sequence
  Description of Artificial Sequence: Synthetic coding sequence
atggccagacccagaagagccagagagcccctgctggtggccctgctgcccctggcctggctggcccaggccggcctggccagagccgccggcagcgtgagactggccggcggcctgaccctgggcggcctgttccccgtgcacgccagaggcgccgccggcagagcctgcggccagctgaagaaggagcagggcgtgcacagactggaggccatgctgtacgccctggacagagtgaacgccgaccccgagctgctgcccggcgtgagactgggcgccagactgctggacacctgcagcagagacacctacgccctggagcaggccctgagcttcgtgcaggccctgatcagaggcagaggcgacggcgacgaggtgggcgtgagatgccccggcggcgtgccccccctgagacccgccccccccgagagagtggtggccgtggtgggcgccagcgccagcagcgtgagcatcatggtggccaacgtgctgagactgttcgccatcccccagatcagctacgccagcaccgcccccgagctgagcgacagcaccagatacgacttcttcagcagagtggtgccccccgacagctaccaggcccaggccatggtggacatcgtgagagccctgggctggaactacgtgagcaccctggccagcgagggcaactacggcgagagcggcgtggaggccttcgtgcagatcagcagagaggccggcggcgtgtgcatcgcccagagcatcaagatccccagagagcccaagcccggcgagttcagcaaggtgatcagaagactgatggagacccccaacgccagaggcatcatcatcttcgccaacgaggacgacatcagaagagtgctggaggccgccagacaggccaacctgaccggccacttcctgtgggtgggcagcgacagctggggcgccaagaccagccccatcctgagcctggaggacgtggccgtgggcgccatcaccatcctgcccaagagagccagcatcgacggcttcgaccagtacttcatgaccagaagcctggagaacaacagaagaaacatctggttcgccgagttctgggaggagaacttcaactgcaagctgaccagcagcggcacccagagcgacgacagcaccagaaagtgcaccggcgaggagagaatcggcagagacagcacctacgagcaggagggcaaggtgcagttcgtgatcgacgccgtgtacgccatcgcccacgccctgcacagcatgcaccaggccctgtgccccggccacaccggcctgtgccccgccatggagcccaccgacggcagaatgctgctgcagtacatcagagccgtgagattcaacggcagcgccggcacccccgtgatgttcaacgagaacggcgacgcccccggcagatacgacatcttccagtaccaggccaccaacggcagcgccagcagcggcggctaccaggccgtgggccagtgggccgagaccctgagactggacgtggaggccctgcagtggagcggcgacccccacgaggtgcccagcagcctgtgcagcctgccctgcggccccggcgagagaaagaagatggtgaagggcgtgccctgctgctggcactgcgaggcctgcgacggctacagattccaggtggacgagttcacctgcgaggcctgccccggcgacatgagacccacccccaaccacaccggctgcagacccacccccgtggtgagactgagctggagcagcccctgggccgccccccccctgctgctggccgtgctgggcatcgtggccaccaccaccgtggtggccaccttcgtgagatacaacaacacccccatcgtgagagccagcggcagagagctgagctacgtgctgctgaccggcatcttcctgatctacgccatcaccttcctgatggtggccgagcccggcgccgccgtgtgcgccgccagaagactgttcctgggcctgggcaccaccctgagctacagcgccctgctgaccaagaccaacagaatctacagaatcttcgagcagggcaagagaagcgtgacccccccccccttcatcagccccaccagccagctggtgatcaccttcagcctgaccagcctgcaggtggtgggcatgatcgcctggctgggcgccagacccccccacagcgtgatcgactacgaggagcagagaaccgtggaccccgagcaggccagaggcgtgctgaagtgcgacatgagcgacctgagcctgatcggctgcctgggctacagcctgctgctgatggtgacctgcaccgtgtacgccatcaaggccagaggcgtgcccgagaccttcaacgaggccaagcccatcggcttcaccatgtacaccacctgcatcatctggctggccttcgtgcccatcttcttcggcaccgcccagagcgccgagaagatctacatccagaccaccaccctgaccgtgagcctgagcctgagcgccagcgtgagcctgggcatgctgtacgtgcccaagacctacgtgatcctgttccaccccgagcagaacgtgcagaagagaaagagaagcctgaaggccaccagcaccgtggccgccccccccaagggcgaggacgccgaggcccacaagtag

SEQ ID NO: 83209 - DNA, 2748 bp, Artificial Sequence
  Description of Artificial Sequence: Synthetic coding sequence
atggtgcagctgagaaagctgctgagagtgctgaccctgatgaagttcccctgctgcgtgctggaggtgctgctgtgcgccctggccgccgccgccagaggccaggagatgtacgccccccacagcatcagaatcgagggcgacgtgaccctgggcggcctgttccccgtgcacgccaagggccccagcggcgtgccctgcggcgacatcaagagagagaacggcatccacagactggaggccatgctgtacgccctggaccagatcaacagcgaccccaacctgctgcccaacgtgaccctgggcgccagaatcctggacacctgcagcagagacacctacgccctggagcagagcctgaccttcgtgcaggccctgatccagaaggacaccagcgacgtgagatgcaccaacggcgagccccccgtgttcgtgaagcccgagaaggtggtgggcgtgatcggcgccagcggcagcagcgtgagcatcatggtggccaacatcctgagactgttccagatcccccagatcagctacgccagcaccgcccccgagctgagcgacgacagaagatacgacttcttcagcagagtggtgccccccgacagcttccaggcccaggccatggtggacatcgtgaaggccctgggctggaactacgtgagcaccctggccagcgagggcagctacggcgagaagggcgtggagagcttcacccagatcagcaaggaggccggcggcctgtgcatcgcccagagcgtgagaatcccccaggagagaaaggacagaaccatcgacttcgacagaatcatcaagcagctgctggacacccccaacagcagagccgtggtgatcttcgccaacgacgaggacatcaagcagatcctggccgccgccaagagagccgaccaggtgggccacttcctgtgggtgggcagcgacagctggggcagcaagatcaaccccctgcaccagcacgaggacatcgccgagggcgccatcaccatccagcccaagagagccaccgtggagggcttcgacgcctacttcaccagcagaaccctggagaacaacagaagaaacgtgtggttcgccgagtactgggaggagaacttcaactgcaagctgaccatcagcggcagcaagaaggaggacaccgacagaaagtgcaccggccaggagagaatcggcaaggacagcaactacgagcaggagggcaaggtgcagttcgtgatcgacgccgtgtacgccatggcccacgccctgcaccacatgaacaaggacctgtgcgccgactacagaggcgtgtgccccgagatggagcaggccggcggcaagaagctgctgaagtacatcagaaacgtgaacttcaacggcagcgccggcacccccgtgatgttcaacaagaacggcgacgcccccggcagatacgacatcttccagtaccagaccaccaacaccagcaaccccggctacagactgatcggccagtggaccgacgagctgcagctgaacatcgaggacatgcagtggggcaagggcgtgagagagatccccgccagcgtgtgcaccctgccctgcaagcccggccagagaaagaagacccagaagggcaccccctgctgctggacctgcgagccctgcgacggctaccagtaccagttcgacgagatgacctgccagcactgcccctacgaccagagacccaacgagaacagaaccggctgccaggacatccccatcatcaagctggagtggcacagcccctgggccgtgatccccgtgttcctggccatgctgggcatcatcgccaccatcttcgtgatggccaccttcatcagatacaacgacacccccatcgtgagagccagcggcagagagctgagctacgtgctgctgaccggcatcttcctgtgctacatcatcaccttcctgatgatcgccaagcccgacgtggccgtgtgcagcttcagaagagtgttcctgggcctgggcatgtgcatcagctacgccgccctgctgaccaagaccaacagaatctacagaatcttcgagcagggcaagaagagcgtgaccgcccccagactgatcagccccaccagccagctggccatcaccagcagcctgatcagcgtgcagctgctgggcgtgttcatctggttcggcgtggacccccccaacatcatcatcgactacgacgagcacaagaccatgaaccccgagcaggccagaggcgtgctgaagtgcgacatcaccgacctgcagatcatctgcagcctgggctacagcatcctgctgatggtgacctgcaccgtgtacgccatcaagaccagaggcgtgcccgagaacttcaacgaggccaagcccatcggcttcaccatgtacaccacctgcatcgtgtggctggccttcatccccatcttcttcggcaccgcccagagcgccgagaagctgtacatccagaccaccaccctgaccatcagcatgaacctgagcgccagcgtggccctgggcatgctgtacatgcccaaggtgtacatcatcatcttccaccccgagctgaacgtgcagaagagaaagagaagcttcaaggccgtggtgaccgccgccaccatgagcagcagactgagccacaagcccagcgacagacccaacggcgaggccaagaccgagctgtgcgagaacgtggaccccaacagccccgccgccaagaagaagtacgtgagctacaacaacctggtgatctag

SEQ ID NO: 83210 - DNA, 2721 bp, Artificial Sequence
  Description of Artificial Sequence: Synthetic coding sequence
atggtgcagctgagaaagctgctgagagtgctgaccctgatgaagttcccctgctgcgtgctggaggtgctgctgtgcgccctggccgccgccgccagaggccaggagatgtacgccccccacagcatcagaatcgagggcgacgtgaccctgggcggcctgttccccgtgcacgccaagggccccagcggcgtgccctgcggcgacatcaagagagagaacggcatccacagactggaggccatgctgtacgccctggaccagatcaacagcgaccccaacctgctgcccaacgtgaccctgggcgccagaatcctggacacctgcagcagagacacctacgccctggagcagagcctgaccttcgtgcaggccctgatccagaaggacaccagcgacgtgagatgcaccaacggcgagccccccgtgttcgtgaagcccgagaaggtggtgggcgtgatcggcgccagcggcagcagcgtgagcatcatggtggccaacatcctgagactgttccagatcccccagatcagctacgccagcaccgcccccgagctgagcgacgacagaagatacgacttcttcagcagagtggtgccccccgacagcttccaggcccaggccatggtggacatcgtgaaggccctgggctggaactacgtgagcaccctggccagcgagggcagctacggcgagaagggcgtggagagcttcacccagatcagcaaggaggccggcggcctgtgcatcgcccagagcgtgagaatcccccaggagagaaaggacagaaccatcgacttcgacagaatcatcaagcagctgctggacacccccaacagcagagccgtggtgatcttcgccaacgacgaggacatcaagcagatcctggccgccgccaagagagccgaccaggtgggccacttcctgtgggtgggcagcgacagctggggcagcaagatcaaccccctgcaccagcacgaggacatcgccgagggcgccatcaccatccagcccaagagagccaccgtggagggcttcgacgcctacttcaccagcagaaccctggagaacaacagaagaaacgtgtggttcgccgagtactgggaggagaacttcaactgcaagctgaccatcagcggcagcaagaaggaggacaccgacagaaagtgcaccggccaggagagaatcggcaaggacagcaactacgagcaggagggcaaggtgcagttcgtgatcgacgccgtgtacgccatggcccacgccctgcaccacatgaacaaggacctgtgcgccgactacagaggcgtgtgccccgagatggagcaggccggcggcaagaagctgctgaagtacatcagaaacgtgaacttcaacggcagcgccggcacccccgtgatgttcaacaagaacggcgacgcccccggcagatacgacatcttccagtaccagaccaccaacaccagcaaccccggctacagactgatcggccagtggaccgacgagctgcagctgaacatcgaggacatgcagtggggcaagggcgtgagagagatccccgccagcgtgtgcaccctgccctgcaagcccggccagagaaagaagacccagaagggcaccccctgctgctggacctgcgagccctgcgacggctaccagtaccagttcgacgagatgacctgccagcactgcccctacgaccagagacccaacgagaacagaaccggctgccaggacatccccatcatcaagctggagtggcacagcccctgggccgtgatccccgtgttcctggccatgctgggcatcatcgccaccatcttcgtgatggccaccttcatcagatacaacgacacccccatcgtgagagccagcggcagagagctgagctacgtgctgctgaccggcatcttcctgtgctacatcatcaccttcctgatgatcgccaagcccgacgtggccgtgtgcagcttcagaagagtgttcctgggcctgggcatgtgcatcagctacgccgccctgctgaccaagaccaacagaatctacagaatcttcgagcagggcaagaagagcgtgaccgcccccagactgatcagccccaccagccagctggccatcaccagcagcctgatcagcgtgcagctgctgggcgtgttcatctggttcggcgtggacccccccaacatcatcatcgactacgacgagcacaagaccatgaaccccgagcaggccagaggcgtgctgaagtgcgacatcaccgacctgcagatcatctgcagcctgggctacagcatcctgctgatggtgacctgcaccgtgtacgccatcaagaccagaggcgtgcccgagaacttcaacgaggccaagcccatcggcttcaccatgtacaccacctgcatcgtgtggctggccttcatccccatcttcttcggcaccgcccagagcgccgagaagctgtacatccagaccaccaccctgaccatcagcatgaacctgagcgccagcgtggccctgggcatgctgtacatgcccaaggtgtacatcatcatcttccaccccgagctgaacgtgcagaagagaaagagaagcttcaaggccgtggtgaccgccgccaccatgagcagcagactgagccacaagcccagcgacagacccaacggcgaggccaagaccgagctgtgcgagaacgtggaccccaacagcgagaagtgcaactgctactag

SEQ ID NO: 83211 - DNA, 2769 bp, Artificial Sequence; identical to SEQ ID NO: 83099
  Description of Artificial Sequence: Synthetic coding sequence

SEQ ID NO: 83212 - DNA, 2736 bp, Artificial Sequence
  Description of Artificial Sequence: Synthetic coding sequence
atggtgcagctgagaaagctgctgagagtgctgaccctgatgaagttcccctgctgcgtgctggaggtgctgctgtgcgccctggccgccgccgccagaggccaggagatgtacgccccccacagcatcagaatcgagggcgacgtgaccctgggcggcctgttccccgtgcacgccaagggccccagcggcgtgccctgcggcgacatcaagagagagaacggcatccacagactggaggccatgctgtacgccctggaccagatcaacagcgaccccaacctgctgcccaacgtgaccctgggcgccagaatcctggacacctgcagcagagacacctacgccctggagcagagcctgaccttcgtgcaggccctgatccagaaggacaccagcgacgtgagatgcaccaacggcgagccccccgtgttcgtgaagcccgagaaggtggtgggcgtgatcggcgccagcggcagcagcgtgagcatcatggtggccaacatcctgagactgttccagatcccccagatcagctacgccagcaccgcccccgagctgagcgacgacagaagatacgacttcttcagcagagtggtgccccccgacagcttccaggcccaggccatggtggacatcgtgaaggccctgggctggaactacgtgagcaccctggccagcgagggcagctacggcgagaagggcgtggagagcttcacccagatcagcaaggaggccggcggcctgtgcatcgcccagagcgtgagaatcccccaggagagaaaggacagaaccatcgacttcgacagaatcatcaagcagctgctggacacccccaacagcagagccgtggtgatcttcgccaacgacgaggacatcaagcagatcctggccgccgccaagagagccgaccaggtgggccacttcctgtgggtgggcagcgacagctggggcagcaagatcaaccccctgcaccagcacgaggacatcgccgagggcgccatcaccatccagcccaagagagccaccgtggagggcttcgacgcctacttcaccagcagaaccctggagaacaacagaagaaacgtgtggttcgccgagtactgggaggagaacttcaactgcaagctgaccatcagcggcagcaagaaggaggacaccgacagaaagtgcaccggccaggagagaatcggcaaggacagcaactacgagcaggagggcaaggtgcagttcgtgatcgacgccgtgtacgccatggcccacgccctgcaccacatgaacaaggacctgtgcgccgactacagaggcgtgtgccccgagatggagcaggccggcggcaagaagctgctgaagtacatcagaaacgtgaacttcaacggcagcgccggcacccccgtgatgttcaacaagaacggcgacgcccccggcagatacgacatcttccagtaccagaccaccaacaccagcaaccccggctacagactgatcggccagtggaccgacgagctgcagctgaacatcgaggacatgcagtggggcaagggcgtgagagagatccccgccagcgtgtgcaccctgccctgcaagcccggccagagaaagaagacccagaagggcaccccctgctgctggacctgcgagccctgcgacggctaccagtaccagttcgacgagatgacctgccagcactgcccctacgaccagagacccaacgagaacagaaccggctgccaggacatccccatcatcaagctggagtggcacagcccctgggccgtgatccccgtgttcctggccatgctgggcatcatcgccaccatcttcgtgatggccaccttcatcagatacaacgacacccccatcgtgagagccagcggcagagagctgagctacgtgctgctgaccggcatcttcctgtgctacatcatcaccttcctgatgatcgccaagcccgacgtggccgtgtgcagcttcagaagagtgttcctgggcctgggcatgtgcatcagctacgccgccctgctgaccaagaccaacagaatctacagaatcttcgagcagggcaagaagagcgtgaccgcccccagactgatcagccccaccagccagctggccatcaccagcagcctgatcagcgtgcagctgctgggcgtgttcatctggttcggcgtggacccccccaacatcatcatcgactacgacgagcacaagaccatgaaccccgagcaggccagaggcgtgctgaagtgcgacatcaccgacctgcagatcatctgcagcctgggctacagcatcctgctgatggtgacctgcaccgtgtacgccatcaagaccagaggcgtgcccgagaacttcaacgaggccaagcccatcggcttcaccatgtacaccacctgcatcgtgtggctggccttcatccccatcttcttcggcaccgcccagagcgccgagaagctgtacatccagaccaccaccctgaccatcagcatgaacctgagcgccagcgtggccctgggcatgctgtacatgcccaaggtgtacatcatcatcttccaccccgagctgaacgtgcagaagagaaagagaagcttcaaggccgtggtgaccgccgccaccatgagcagcagactgagccacaagcccagcgacagacccaacggcgaggccaagaccgagctgtgcgagaacgtggaccccaacatcaccagcgaggacctgagcctgcacaaggaggactag

SEQ ID NO: 83213 - DNA, 2475 bp, Artificial Sequence
  Description of Artificial Sequence: Synthetic coding sequence
atggtgcagctgagaaagctgctgagagtgctgaccctgatgaagttcccctgctgcgtgctggaggtgctgctgtgcgccctggccgccgccgccagaggccaggagatgtacgccccccacagcatcagaatcgagggcgacgtgaccctgggcggcctgttccccgtgcacgccaagggccccagcggcgtgccctgcggcgacatcaagagagagaacggcatccacagactggaggccatgctgtacgccctggaccagatcaacagcgaccccaacctgctgcccaacgtgaccctgggcgccagaatcctggacacctgcagcagagacacctacgccctggagcagagcctgaccttcgtgcaggccctgatccagaaggacaccagcgacgtgagatgcaccaacggcgagccccccgtgttcgtgaagcccgagaaggtggtgggcgtgatcggcgccagcggcagcagcgtgagcatcatggtggccaacatcctgagactgttccagatcccccagatcagctacgccagcaccgcccccgagctgagcgacgacagaagatacgacttcttcagcagagtggtgccccccgacagcttccaggcccaggccatggtggacatcgtgaaggccctgggctggaactacgtgagcaccctggccagcgagggcagctacggcgagaagggcgtggagagcttcacccagatcagcaaggaggccggcggcctgtgcatcgcccagagcgtgagaatcccccaggagagaaaggacagaaccatcgacttcgacagaatcatcaagcagctgctggacacccccaacagcagagccgtggtgatcttcgccaacgacgaggacatcaagcagatcctggccgccgccaagagagccgaccaggtgggccacttcctgtgggtgggcagcgacagctggggcagcaagatcaaccccctgcaccagcacgaggacatcgccgagggcgccatcaccatccagcccaagagagccaccgtggagggcttcgacgcctacttcaccagcagaaccctggagaacaacagaagaaacgtgtggttcgccgagtactgggaggagaacttcaactgcaagctgaccatcagcggcagcaagaaggaggacaccgacagaaagtgcaccggccaggagagaatcggcaaggacagcaactacgagcaggagggcaaggtgcagttcgtgatcgacgccgtgtacgccatggcccacgccctgcaccacatgaacaaggacctgtgcgccgactacagaggcgtgtgccccgagatggagcaggccggcggcaagaagctgctgaagtacatcagaaacgtgaacttcaacggcgacgccggcacccccgtgatgttcaacaagaacggcgacgcccccggcagatacgacatcttccagtaccagaccaccaacaccagcaaccccggctacagactgatcggccagtggaccgacgagctgcagctgaacatcgaggacatgcagtggggcaagggcgtgagagagatccccgccagcgtgtgcaccctgccctgcaagcccggccagagaaagaagacccagaagggcaccccctgctgctggacctgcgagccctgcgacggctaccagtaccagttcgacgagatgacctgccagcactgcccctacgaccagagacccaacgagaacagaaccggctgccaggacatccccatcatcaagctggagtggcacagcccctgggccgtgatccccgtgttcctggccatgctgggcatcatcgccaccatcttcgtgatggccaccttcatcagatacaacgacacccccatcgtgagagccagcggcagagagctgagctacgtgctgctgaccggcatcttcctgtgctacatcatcaccttcctgatgatcgccaagcccgacgtggccgtgtgcagcttcagaagagtgttcctgggcctgggcatgtgcatcagctacgccgccctgctgaccaagaccaacagaatctacagaatcttcgagcagggcaagaagagcgtgaccgcccccagactgatcagccccaccagccagctggccatcaccagcagcctgatcagcgtgcagctgctgggcgtgttcatctggttcggcgtggacccccccaacatcatcatcgactacgacgagcacaagaccatgaaccccgagcaggccagaggcgtgctgaagtgcgacatcaccgacctgcagatcatctgcagcctgggctacagcatcctgctgatggtgacctgcaccgtgtacgccatcaagaccagaggcgtgcccgagaacttcaacgaggccaagcccatcggcttcaccatgtacaccacctgcatcgtgtggctggccttcatccccatcttcttcggcaccgcccagagcgccgagaaggtgatcctgtgctgcatcagctag

SEQ ID NO: 83214 - DNA, 2775 bp, Artificial Sequence
  Description of Artificial Sequence: Synthetic coding sequence
atggtgcagctgagaaagctgctgagagtgctgaccctgatgaagttcccctgctgcgtgctggaggtgctgctgtgcgccctggccgccgccgccagaggccaggagatgtacgccccccacagcatcagaatcgagggcgacgtgaccctgggcggcctgttccccgtgcacgccaagggccccagcggcgtgccctgcggcgacatcaagagagagaacggcatccacagactggaggccatgctgtacgccctggaccagatcaacagcgaccccaacctgctgcccaacgtgaccctgggcgccagaatcctggacacctgcagcagagacacctacgccctggagcagagcctgaccttcgtgcaggccctgatccagaaggacaccagcgacgtgagatgcaccaacggcgagccccccgtgttcgtgaagcccgagaaggtggtgggcgtgatcggcgccagcggcagcagcgtgagcatcatggtggccaacatcctgagactgttccagatcccccagatcagctacgccagcaccgcccccgagctgagcgacgacagaagatacgacttcttcagcagagtggtgccccccgacagcttccaggcccaggccatggtggacatcgtgaaggccctgggctggaactacgtgagcaccctggccagcgagggcagctacggcgagaagggcgtggagagcttcacccagatcagcaaggaggccggcggcctgtgcatcgcccagagcgtgagaatcccccaggagagaaaggacagaaccatcgacttcgacagaatcatcaagcagctgctggacacccccaacagcagagccgtggtgatcttcgccaacgacgaggacatcaagcagatcctggccgccgccaagagagccgaccaggtgggccacttcctgtgggtgggcagcgacagctggggcagcaagatcaaccccctgcaccagcacgaggacatcgccgagggcgccatcaccatccagcccaagagagccaccgtggagggcttcgacgcctacttcaccagcagaaccctggagaacaacagaagaaacgtgtggttcgccgagtactgggaggagaacttcaactgcaagctgaccatcagcggcagcaagaaggaggacaccgacagaaagtgcaccggccaggagagaatcggcaaggacagcaactacgagcaggagggcaaggtgcagttcgtgatcgacgccgtgtacgccatggcccacgccctgcaccacatgaacaaggacctgtgcgccgactacagaggcgtgtgccccgagatggagcaggccggcggcaagaagctgctgaagtacatcagaaacgtgaacttcaacggcagcgccggcacccccgtgatgttcaacaagaacggcgacgcccccggcagatacgacatcttccagtaccagaccaccaacaccagcaaccccggctacagactgatcggccagtggaccgacgagctgcagctgaacatcgaggacatgcagtggggcaagggcgtgagagagatccccgccagcgtgtgcaccctgccctgcaagcccggccagagaaagaagacccagaagggcaccccctgctgctggacctgcgagccctgcgacggctaccagtaccagttcgacgagatgacctgccagcactgcccctacgaccagagacccaacgagaacagaaccggctgccaggacatccccatcatcaagctggagtggcacagcccctgggccgtgatccccgtgttcctggccatgctgggcatcatcgccaccatcttcgtgatggccaccttcatcagatacaacgacacccccatcgtgagagccagcggcagagagctgagctacgtgctgctgaccggcatcttcctgtgctacatcatcaccttcctgatgatcgccaagcccgacgtggccgtgtgcagcttcagaagagtgttcctgggcctgggcatgtgcatcagctacgccgccctgctgaccaagaccaacagaatctacagaatcttcgagcagggcaagaagagcgtgaccgcccccagactgatcagccccaccagccagctggccatcaccagcagcctgatcagcgtgcagctgctgggcgtgttcatctggttcggcgtggacccccccaacatcatcatcgactacgacgagcacaagaccatgaaccccgagcaggccagaggcgtgctgaagtgcgacatcaccgacctgcagatcatctgcagcctgggctacagcatcctgctgatggtgacctgcaccgtgtacgccatcaagaccagaggcgtgcccgagaacttcaacgaggccaagcccatcggcttcaccatgtacaccacctgcatcgtgtggctggccttcatccccatcttcttcggcaccgcccagagcgccgagaagctgtacatccagaccaccaccctgaccatcagcatgaacctgagcgccagcgtggccctgggcatgctgtacatgcccaaggtgtacatcatcatcttccaccccgagctgaacgtgcagaagagaaagagaagcttcaaggccgtggtgaccgccgccaccatgagcagcagactgagccacaagcccagcgacagacccaacggcgaggccaagaccgagctgtgcgagaacgtggaccccaacatcttcttcttcggctgcaccgtggagctgggcctgcacttcaagctgaccttcagcagaaaccagagcaacctgtag

SEQ ID NO: 83215 - DNA, 2727 bp, Artificial Sequence
  Description of Artificial Sequence: Synthetic coding sequence
atggtgtgcgagggcaagagaagcgccagctgcccctgcttcttcctgctgaccgccaagttctactggatcctgaccatgatgcagagaacccacagccaggagtacgcccacagcatcagagtggacggcgacatcatcctgggcggcctgttccccgtgcacgccaagggcgagagaggcgtgccctgcggcgagctgaagaaggagaagggcatccacagactggaggccatgctgtacgccatcgaccagatcaacaaggaccccgacctgctgagcaacatcaccctgggcgtgagaatcctggacacctgcagcagagacacctacgccctggagcagagcctgaccttcgtgcaggccctgatcgagaaggacgccagcgacgtgaagtgcgccaacggcgacccccccatcttcaccaagcccgacaagatcagcggcgtgatcggcgccgccgccagcagcgtgagcatcatggtggccaacatcctgagactgttcaagatcccccagatcagctacgccagcaccgcccccgagctgagcgacaacaccagatacgacttcttcagcagagtggtgccccccgacagctaccaggcccaggccatggtggacatcgtgaccgccctgggctggaactacgtgagcaccctggccagcgagggcaactacggcgagagcggcgtggaggccttcacccagatcagcagagagatcggcggcgtgtgcatcgcccagagccagaagatccccagagagcccagacccggcgagttcgagaagatcatcaagagactgctggagacccccaacgccagagccgtgatcatgttcgccaacgaggacgacatcagaagaatcctggaggccgccaagaagctgaaccagagcggccacttcctgtggatcggcagcgacagctggggcagcaagatcgcccccgtgtaccagcaggaggagatcgccgagggcgccgtgaccatcctgcccaagagagccagcatcgacggcttcgacagatacttcagaagcagaaccctggccaacaacagaagaaacgtgtggttcgccgagttctgggaggagaacttcggctgcaagctgggcagccacggcaagagaaacagccacatcaagaagtgcaccggcctggagagaatcgccagagacagcagctacgagcaggagggcaaggtgcagttcgtgatcgacgccgtgtacagcatggcctacgccctgcacaacatgcacaaggacctgtgccccggctacatcggcctgtgccccagaatgagcaccatcgacggcaaggagctgctgggctacatcagagccgtgaacttcaacggcagcgccggcacccccgtgaccttcaacgagaacggcgacgcccccggcagatacgacatcttccagtaccagatcaccaacaagagcaccgagtacaaggtgatcggccactggaccaaccagctgcacctgaaggtggaggacatgcagtgggcccacagagagcacacccaccccgccagcgtgtgcagcctgccctgcaagcccggcgagagaaagaagaccgtgaagggcgtgccctgctgctggcactgcgagagatgcgagggctacaactaccaggtggacgagctgagctgcgagctgtgccccctggaccagagacccaacatgaacagaaccggctgccagctgatccccatcatcaagctggagtggcacagcccctgggccgtggtgcccgtgttcgtggccatcctgggcatcatcgccaccaccttcgtgatcgtgaccttcgtgagatacaacgacacccccatcgtgagagccagcggcagagagctgagctacgtgctgctgaccggcatcttcctgtgctacagcatcaccttcctgatgatcgccgcccccgacaccatcatctgcagcttcagaagagtgttcctgggcctgggcatgtgcttcagctacgccgccctgctgaccaagaccaacagaatccacagaatcttcgagcagggcaagaagagcgtgaccgcccccaagttcatcagccccgccagccagctggtgatcaccttcagcctgatcagcgtgcagctgctgggcgtgttcgtgtggttcgtggtggaccccccccacatcatcatcgactacggcgagcagagaaccctggaccccgagaaggccagaggcgtgctgaagtgcgacatcagcgacctgagcctgatctgcagcctgggctacagcatcctgctgatggtgacctgcaccgtgtacgccatcaagaccagaggcgtgcccgagaccttcaacgaggccaagcccatcggcttcaccatgtacaccacctgcatcatctggctggccttcatccccatcttcttcggcaccgcccagagcgccgagaagatgtacatccagaccaccaccctgaccgtgagcatgagcctgagcgccagcgtgagcctgggcatgctgtacatgcccaaggtgtacatcatcatcttccaccccgagcagaacgtgcagaagagaaagagaagcttcaaggccgtggtgaccgccgccaccatgcagagcaagctgatccagaagggcaacgacagacccaacggcgaggtgaagagcgagctgtgcgagagcctggagaccaacaccagcagcaccaagaccacctacatcagctacagcaaccacagcatctag

SEQ ID NO: 83216 - DNA, 2727 bp, Artificial Sequence
  Description of Artificial Sequence: Synthetic coding sequence
atggtgtgcgagggcaagagaagcgccagctgcccctgcttcttcctgctgaccgccaagttctactggatcctgaccatgatgcagagaacccacagccaggagtacgcccacagcatcagagtggacggcgacatcatcctgggcggcctgttccccgtgcacgccaagggcgagagaggcgtgccctgcggcgagctgaagaaggagaagggcatccacagactggaggccatgctgtacgccatcgaccagatcaacaaggaccccgacctgctgagcaacatcaccctgggcgtgagaatcctggacacctgcagcagagacacctacgccctggagcagagcctgaccttcgtgcaggccctgatcgagaaggacgccagcgacgtgaagtgcgccaacggcgacccccccatcttcaccaagcccgacaagatcagcggcgtgatcggcgccgccgccagcagcgtgagcatcatggtggccaacatcctgagactgttcaagatcccccagatcagctacgccagcaccgcccccgagctgagcgacaacaccagatacgacttcttcagcagagtggtgccccccgacagctaccaggcccaggccatggtggacatcgtgaccgccctgggctggaactacgtgagcaccctggccagcgagggcaactacggcgagagcggcgtggaggccttcacccagatcagcagagagatcggcggcgtgtgcatcgcccagagccagaagatccccagagagcccagacccggcgagttcgagaagatcatcaagagactgctggagacccccaacgccagagccgtgatcatgttcgccaacgaggacgacatcagaagaatcctggaggccgccaagaagctgaaccagagcggccacttcctgtggatcggcagcgacagctggggcagcaagatcgcccccgtgtaccagcaggaggagatcgccgagggcgccgtgaccatcctgcccaagagagccagcatcgacggcttcgacagatacttcagaagcagaaccctggccaacaacagaagaaacgtgtggttcgccgagttctgggaggagaacttcggctgcaagctgggcagccacggcaagagaaacagccacatcaagaagtgcaccggcctggagagaatcgccagagacagcagctacgagcaggagggcaaggtgcagttcgtgatcgacgccgtgtacagcatggcctacgccctgcacaacatgcacaaggacctgtgccccggctacatcggcctgtgccccagaatgagcaccatcgacggcaaggagctgctgggctacatcagagccgtgaacttcaacggcagcgccggcacccccgtgaccttcaacgagaacggcgacgcccccggcagatacgacatcttccagtaccagatcaccaacaagagcaccgagtacaaggtgatcggccactggaccaaccagctgcacctgaaggtggaggacatgcagtgggcccacagagagcacacccaccccgccagcgtgtgcagcctgccctgcaagcccggcgagagaaagaagaccgtgaagggcgtgccctgctgctggcactgcgagagatgcgagggctacaactaccaggtggacgagctgagctgcgagctgtgccccctggaccagagacccaacatgaacagaaccggctgccagctgatccccatcatcaagctggagtggcacagcccctgggccgtggtgcccgtgttcgtggccatcctgggcatcatcgccaccaccttcgtgatcgtgaccttcgtgagatacaacgacacccccatcgtgagagccagcggcagagagctgagctacgtgctgctgaccggcatcttcctgtgctacagcatcaccttcctgatgatcgccgcccccgacaccatcatctgcagcttcagaagagtgttcctgggcctgggcatgtgcttcagctacgccgccctgctgaccaagaccaacagaatccacagaatcttcgagcagggcaagaagagcgtgaccgcccccaagttcatcagccccgccagccagctggtgatcaccttcagcctgatcagcgtgcagctgctgggcgtgttcgtgtggttcgtggtggaccccccccacatcatcatcgactacggcgagcagagaaccctggaccccgagaaggccagaggcgtgctgaagtgcgacatcagcgacctgagcctgatctgcagcctgggctacagcatcctgctgatggtgacctgcaccgtgtacgccatcaagaccagaggcgtgcccgagaccttcaacgaggccaagcccatcggcttcaccatgtacaccacctgcatcatctggctggccttcatccccatcttcttcggcaccgcccagagcgccgagaagatgtacatccagaccaccaccctgaccgtgagcatgagcctgagcgccagcgtgagcctgggcatgctgtacatgcccaaggtgtacatcatcatcttccaccccgagcagaacgtgcagaagagaaagagaagcttcaaggccgtggtgaccgccgccaccatgcagagcaagctgatccagaagggcaacgacagacccaacggcgaggtgaagagcgagctgtgcgagagcctggagaccaacagcaagagcagcgtggagttccccatggtgaagagcggcagcaccagctag

SEQ ID NO: 83217 - DNA, 1506 bp, Artificial Sequence
  Description of Artificial Sequence: Synthetic coding sequence
atggtgtgcgagggcaagagaagcgccagctgcccctgcttcttcctgctgaccgccaagttctactggatcctgaccatgatgcagagaacccacagccaggagtacgcccacagcatcagagtggacggcgacatcatcctgggcggcctgttccccgtgcacgccaagggcgagagaggcgtgccctgcggcgagctgaagaaggagaagggcatccacagactggaggccatgctgtacgccatcgaccagatcaacaaggaccccgacctgctgagcaacatcaccctgggcgtgagaatcctggacacctgcagcagagacacctacgccctggagcagagcctgaccttcgtgcaggccctgatcgagaaggacgccagcgacgtgaagtgcgccaacggcgacccccccatcttcaccaagcccgacaagatcagcggcgtgatcggcgccgccgccagcagcgtgagcatcatggtggccaacatcctgagactgttcaagatcccccagatcagctacgccagcaccgcccccgagctgagcgacaacaccagatacgacttcttcagcagagtggtgccccccgacagctaccaggcccaggccatggtggacatcgtgaccgccctgggctggaactacgtgagcaccctggccagcgagggcaactacggcgagagcggcgtggaggccttcacccagatcagcagagagatcggcggcgtgtgcatcgcccagagccagaagatccccagagagcccagacccggcgagttcgagaagatcatcaagagactgctggagacccccaacgccagagccgtgatcatgttcgccaacgaggacgacatcagaagaatcctggaggccgccaagaagctgaaccagagcggccacttcctgtggatcggcagcgacagctggggcagcaagatcgcccccgtgtaccagcaggaggagatcgccgagggcgccgtgaccatcctgcccaagagagccagcatcgacggcttcgacagatacttcagaagcagaaccctggccaacaacagaagaaacgtgtggttcgccgagttctgggaggagaacttcggctgcaagctgggcagccacggcaagagaaacagccacatcaagaagtgcaccggcctggagagaatcgccagagacagcagctacgagcaggagggcaaggtgcagttcgtgatcgacgccgtgtacagcatggcctacgccctgcacaacatgcacaaggacctgtgccccggctacatcggcctgtgccccagaatgagcaccatcgacggcaaggagctgctgggctacatcagagccgtgaacttcaacggctgcagaagaggcatccagatgagcctgccctggcccaccctgttcacccccagcttcagcagcagctgggccgtgctggccctgctgagcctgctgatgaagaccgagatgctgctggacgtgatgatcagcagcagcatcaagtag

SEQ ID NO: 83218 - DNA, 63 bp, Artificial Sequence
  Description of Artificial Sequence: Synthetic coding sequence
atggtgtgcgagggcaagagaagcgccagctgcccctgcttcttcctgctgaccgccaagtag

SEQ ID NO: 83219 - DNA, 2727 bp, Artificial Sequence; identical to SEQ ID NO: 83215
  Description of Artificial Sequence: Synthetic coding sequence

SEQ ID NO: 83220 - DNA, 885 bp, Artificial Sequence
  Description of Artificial Sequence: Synthetic coding sequence
atggtgtgcgagggcaagagaagcgccagctgcccctgcttcttcctgctgaccgccaagttctactggatcctgaccatgatgcagagaacccacagccaggagtacgcccacagcatcagagtggacggcgacatcatcctgggcggcctgttccccgtgcacgccaagggcgagagaggcgtgccctgcggcgagctgaagaaggagaagggcatccacagactggaggccatgctgtacgccatcgaccagatcaacaaggaccccgacctgctgagcaacatcaccctgggcgtgagaatcctggacacctgcagcagagacacctacgccctggagcagagcctgaccttcgtgcaggccctgatcgagaaggacgccagcgacgtgaagtgcgccaacggcgacccccccatcttcaccaagcccgacaagatcagcggcgtgatcggcgccgccgccagcagcgtgagcatcatggtggccaacatcctgagactgttcaagatcccccagatcagctacgccagcaccgcccccgagctgagcgacaacaccagatacgacttcttcagcagagtggtgccccccgacagctaccaggcccaggccatggtggacatcgtgaccgccctgggctggaactacgtgagcaccctggccagcgagggcaactacggcgagagcggcgtggaggccttcacccagatcagcagagagatcggcggcgtgtgcatcgcccagagccagaagatccccagagagcccagacccggcgagttcgagaagatcatcaagagactgctggagacccccaacgccagagccgtgatcatgttcgccaacgaggacgacatcagaagaatcctggaggccgcctag

SEQ ID NO: 83221 - DNA, 1122 bp, Artificial Sequence
  Description of Artificial Sequence: Synthetic coding sequence
atgaccaccagcgccagcagccacctgaacaagggcatcaagcaggtgtacatgagcctgccccagggcgagaaggtgcaggccatgtacatctggatcgacggcaccggcgagggcctgagatgcaagaccagaaccctggacagcgagcccaagtgcgtggaggagctgcccgagtggaacttcgacggcagcagcaccctgcagagcgagggcagcaacagcgacatgtacctggtgcccgccgccatgttcagagaccccttcagaaaggaccccaacaagctggtgctgtgcgaggtgttcaagtacaacagaagacccgccgagaccaacctgagacacacctgcaagagaatcatggacatggtgagcaaccagcacccctggttcggcatggagcaggagtacaccctgatgggcaccgacggccaccccttcggctggcccagcaacggcttccccggcccccagggcccctactactgcggcgtgggcgccgacagagcctacggcagagacatcgtggaggcccactacagagcctgcctgtacgccggcgtgaagatcgccggcaccaacgccgaggtgatgcccgcccagtgggagttccagatcggcccctgcgagggcatcagcatgggcgaccacctgtgggtggccagattcatcctgcacagagtgtgcgaggacttcggcgtgatcgccaccttcgaccccaagcccatccccggcaactggaacggcgccggctgccacaccaacttcagcaccaaggccatgagagaggagaacggcctgaagtacatcgaggaggccatcgagaagctgagcaagagacaccagtaccacatcagagcctacgaccccaagggcggcctggacaacgccagaagactgaccggcttccacgagaccagcaacatcaacgacttcagcgccggcgtggccaacagaagcgccagcatcagaatccccagaaccgtgggccaggagaagaagggctacttcgaggacagaagacccagcgccaactgcgaccccttcagcgtgaccgaggccctgatcagaacctgcctgctgaacgagaccggcgacgagcccttccagtacaagaactag

SEQ ID NO: 83222 - DNA, 1122 bp, Artificial Sequence; identical to SEQ ID NO: 83221
  Description of Artificial Sequence: Synthetic coding sequence

SEQ ID NO: 83223 - DNA, 1122 bp, Artificial Sequence; identical to SEQ ID NO: 83221
  Description of Artificial Sequence: Synthetic coding sequence

SEQ ID NO: 83224 - DNA, 1122 bp, Artificial Sequence; identical to SEQ ID NO: 83221
  Description of Artificial Sequence: Synthetic coding sequence

SEQ ID NO: 83225 - DNA, 702 bp, Artificial Sequence
  Description of Artificial Sequence: Synthetic coding sequence
atgaccaccagcgccagcagccacctgaacaagggcatcaagcaggtgtacatgagcctgccccagggcgagaaggtgcaggccatgtacatctggatcgacggcaccggcgagggcctgagatgcaagaccagaaccctggacagcgagcccaagtgcgtggaggagctgcccgagtggaacttcgacggcagcagcaccctgcagagcgagggcagcaacagcgacatgtacctggtgcccgccgccatgttcagagaccccttcagaaaggaccccaacaagctggtgctgtgcgaggtgttcaagtacaacagaagacccgccgagaccaacctgagacacacctgcaagagaatcatggacatggtgagcaaccagcacccctggttcggcatggagcaggagtacaccctgatgggcaccgacggccaccccttcggctggcccagcaacggcttccagggccccagagtgcacatcaccgtggtgtgggagcagaccgagcccatggccggcaccagctggagacccatcaccggccccgcctgcatgctggagagcagactgagaggcctgatgcccagaagctgcctgcccagcggcaacttcagactggacctggtgaaggagagcgcctgggagatcatcagcggctggcccgtgagcagctgcatcgtgtgcgtgaagaccctggagtag

SEQ ID NO: 83226 - DNA, 678 bp, Artificial Sequence
  Description of Artificial Sequence: Synthetic coding sequence
atggaccagcaggccatctacgccgagctgaacctgcccaccgacagcggccccgagagcagcagccccagcagcctgcccagagacgtgtgccagggcagcccctggcaccagttcgccctgaagctgagctgcgccggcatcatcctgctggtgctggtggtgaccggcctgagcgtgagcgtgaccagcctgatccagaagagcagcatcgagaagtgcagcgtggacatccagcagagcagaaacaagaccaccgagagacccggcctgctgaactgccccatctactggcagcagctgagagagaagtgcctgctgttcagccacaccgtgaacccctggaacaacagcctggccgactgcagcaccaaggagagcagcctgctgctgatcagagacaaggacgagctgatccacacccagaacctgatcagagacaaggccatcctgttctggatcggcctgaacttcagcctgagcgagaagaactggaagtggatcaacggcagcttcctgaacagcaacgacctggagatcagaggcgacgccaaggagaacagctgcatcagcatcagccagaccagcgtgtacagcgagtactgcagcaccgagatcagatggatctgccagaaggagctgacccccgtgagaaacaaggtgtaccccgacagctag

SEQ ID NO: 83227 - DNA, 825 bp, Artificial Sequence
  Description of Artificial Sequence: Synthetic coding sequence
atgggcaccgacagcagagccgccaaggccctgctggccagagccagaaccctgcacctgcagaccggcaacctgctgaactggggcagactgagaaagaagtgccccagcacccacagcgaggagctgcacgactgcatccagaagaccctgaacgagtggagcagccagatcaaccccgacctggtgagagagttccccgacgtgctggagtgcaccgtgagccacgccgtggagaagatcaaccccgacgagagagaggagatgaaggtgagcgccaagctgttcatcgtggagagcaacagcagcagcagcaccagaagcgccgtggacatggcctgcagcgtgctgggcgtggcccagctggacagcgtgatcatcgccagcccccccatcgaggacggcgtgaacctgagcctggagcacctgcagccctactgggaggagctggagaacctggtgcagagcaagaagatcgtggccatcggcaccagcgacctggacaagacccagctggagcagctgtaccagtgggcccaggtgaagcccaacagcaaccaggtgaacctggccagctgctgcgtgatgccccccgacctgaccgccttcgccaagcagttcgacatccagctgctgacccacaacgaccccaaggagctgctgagcgaggccagcttccaggaggccctgcaggagagcatccccgacatccaggcccacgagtgggtgcccctgtggctgctgagatacagcgtgatcgtgaagagcagaggcatcatcaagagcaagggctacatcctgcaggccaagagaagaggcagctag

SEQ ID NO: 83228 - DNA, 1341 bp, Artificial Sequence
  Description of Artificial Sequence: Synthetic coding sequence
atggccgccagaaagggcagaagaagaacctgcgagaccggcgagcccatggaggccgagagcggcgacaccagcagcgagggccccgcccaggtgtacctgcccggcagaggcccccccctgagagagggcgaggagctggtgatggacgaggaggcctacgtgctgtaccacagagcccagaccggcgccccctgcctgagcttcgacatcgtgagagaccacctgggcgacaacagaaccgagctgcccctgaccctgtacctgtgcgccggcacccaggccgagagcgcccagagcaacagactgatgatgctgagaatgcacaacctgcacggcaccaagcccccccccagcgagggcagcgacgaggaggaggaggaggaggacgaggaggacgaggaggagagaaagccccagctggagctggccatggtgccccactacggcggcatcaacagagtgagagtgagctggctgggcgaggagcccgtggccggcgtgtggagcgagaagggccaggtggaggtgttcgccctgagaagactgctgcaggtggtggaggagccccaggccctggccgccttcctgagagacgagcaggcccagatgaagcccatcttcagcttcgccggccacatgggcgagggcttcgccctggactggagccccagagtgaccggcagactgctgaccggcgactgccagaagaacatccacctgtggacccccaccgacggcggcagctggcacgtggaccagagacccttcgtgggccacaccagaagcgtggaggacctgcagtggagccccaccgagaacaccgtgttcgccagctgcagcgccgacgccagcatcagaatctgggacatcagagccgcccccagcaaggcctgcatgctgaccaccgccaccgcccacgacggcgacgtgaacgtgatcagctggagcagaagagagcccttcctgctgagcggcggcgacgacggcgccctgaagatctgggacctgagacagttcaagagcggcagccccgtggccaccttcaagcagcacgtggcccccgtgaccagcgtggagtggcacccccaggacagcggcgtgttcgccgccagcggcgccgaccaccagatcacccagtgggacctggccgtggagagagaccccgaggccggcgacgtggaggccgaccccggcctggccgacctgccccagcagctgctgttcgtgcaccagggcgagaccgagctgaaggagctgcactggcacccccagtgccccggcctgctggtgagcaccgccctgagcggcttcaccatcttcagaaccatcagcgtgtag

SEQ ID NO: 83229 - DNA, 1572 bp, Artificial Sequence
  Description of Artificial Sequence: Synthetic coding sequence
atgcagagagccgccgccctggtgagaagaggctgcggccccagaacccccagcagctggggcagaagccagagcagcgccgccgccgaggccagcgccgtgctgaaggtgagacccgagagaagcagaagagagagaatcctgaccctggagagcatgaacccccaggtgaaggccgtggagtacgccgtgagaggccccatcgtgctgaaggccggcgagatcgagctggagctgcagagaggcatcaagaagcccttcaccgaggtgatcagagccaacatcggcgacgcccaggccatgggccagcagcccatcaccttcctgagacaggtgatggccctgtgcacctaccccaacctgctggacagccccagcttccccgaggacgccaagaagagagccagaagaatcctgcaggcctgcggcggcaacagcctgggcagctacagcgccagccagggcgtgaactgcatcagagaggacgtggccgcctacatcaccagaagagacggcggcgtgcccgccgaccccgacaacatctacctgaccaccggcgccagcgacggcatcagcaccatcctgaagatcctggtgagcggcggcggcaagagcagaaccggcgtgatgatccccatcccccagtaccccctgtacagcgccgtgatcagcgagctggacgccatccaggtgaactactacctggacgaggagaactgctgggccctgaacgtgaacgagctgagaagagccgtgcaggaggccaaggaccactgcgaccccaaggtgctgtgcatcatcaaccccggcaaccccaccggccaggtgcagagcagaaagtgcatcgaggacgtgatccacttcgcctgggaggagaagctgttcctgctggccgacgaggtgtaccaggacaacgtgtacagccccgactgcagattccacagcttcaagaaggtgctgtacgagatgggccccgagtacagcagcaacgtggagctggccagcttccacagcaccagcaagggctacatgggcgagtgcggctacagaggcggctacatggaggtgatcaacctgcaccccgagatcaagggccagctggtgaagctgctgagcgtgagactgtgcccccccgtgagcggccaggccgccatggacatcgtggtgaacccccccgtggccggcgaggagagcttcgagcagttcagcagagagaaggagagcgtgctgggcaacctggccaagaaggccaagctgaccgaggacctgttcaaccaggtgcccggcatccactgcaaccccctgcagggcgccatgtacgccttccccagaatcttcatccccgccaaggccgtggaggccgcccaggcccaccagatggcccccgacatgttctactgcatgaagctgctggaggagaccggcatctgcgtggtgcccggcagcggcttcggccagagagagggcacctaccacttcagaatgaccatcctgccccccgtggagaagctgaagaccgtgctgcagaaggtgaaggacttccacatcaacttcctggagaagtacgcctag

SEQ ID NO: 83230 - DNA, 1272 bp, Artificial Sequence
  Description of Artificial Sequence: Synthetic coding sequence
atgggccagcagcccatcaccttcctgagacaggtgatggccctgtgcacctaccccaacctgctggacagccccagcttccccgaggacgccaagaagagagccagaagaatcctgcaggcctgcggcggcaacagcctgggcagctacagcgccagccagggcgtgaactgcatcagagaggacgtggccgcctacatcaccagaagagacggcggcgtgcccgccgaccccgacaacatctacctgaccaccggcgccagcgacggcatcagcaccatcctgaagatcctggtgagcggcggcggcaagagcagaaccggcgtgatgatccccatcccccagtaccccctgtacagcgccgtgatcagcgagctggacgccatccaggtgaactactacctggacgaggagaactgctgggccctgaacgtgaacgagctgagaagagccgtgcaggaggccaaggaccactgcgaccccaaggtgctgtgcatcatcaaccccggcaaccccaccggccaggtgcagagcagaaagtgcatcgaggacgtgatccacttcgcctgggaggagaagctgttcctgctggccgacgaggtgtaccaggacaacgtgtacagccccgactgcagattccacagcttcaagaaggtgctgtacgagatgggccccgagtacagcagcaacgtggagctggccagcttccacagcaccagcaagggctacatgggcgagtgcggctacagaggcggctacatggaggtgatcaacctgcaccccgagatcaagggccagctggtgaagctgctgagcgtgagactgtgcccccccgtgagcggccaggccgccatggacatcgtggtgaacccccccgtggccggcgaggagagcttcgagcagttcagcagagagaaggagagcgtgctgggcaacctggccaagaaggccaagctgaccgaggacctgttcaaccaggtgcccggcatccactgcaaccccctgcagggcgccatgtacgccttccccagaatcttcatccccgccaaggccgtggaggccgcccaggcccaccagatggcccccgacatgttctactgcatgaagctgctggaggagaccggcatctgcgtggtgcccggcagcggcttcggccagagagagggcacctaccacttcagaatgaccatcctgccccccgtggagaagctgaagaccgtgctgcagaaggtgaaggacttccacatcaacttcctggagaagtacgcctag

SEQ ID NO: 83231 - DNA, 1242 bp, Artificial Sequence
  Description of Artificial Sequence: Synthetic coding sequence
atggccccccccagcgtgttcgccgaggtgccccaggcccagcccgtgctggtgttcaagctgaccgccgacttcagagaggaccccgaccccagaaaggtgaacctgggcgtgggcgcctacagaaccgacgactgccacccctgggtgctgcccgtggtgaagaaggtggagcagaagatcgccaacgacaacagcctgaaccacgagtacctgcccatcctgggcctggccgagttcagaagctgcgccagcagactggccctgggcgacgacagccccgccctgaaggagaagagagtgggcggcgtgcagagcctgggcggcaccggcgccctgagaatcggcgccgacttcctggccagatggtacaacggcaccaacaacaagaacacccccgtgtacgtgagcagccccacctgggagaaccacaacgccgtgttcagcgccgccggcttcaaggacatcagaagctacagatactgggacgccgagaagagaggcctggacctgcagggcttcctgaacgacctggagaacgcccccgagttcagcatcgtggtgctgcacgcctgcgcccacaaccccaccggcatcgaccccacccccgagcagtggaagcagatcgccagcgtgatgaagcacagattcctgttccccttcttcgacagcgcctaccagggcttcgccagcggcaacctggagagagacgcctgggccatcagatacttcgtgagcgagggcttcgagttcttctgcgcccagagcttcagcaagaacttcggcctgtacaacgagagagtgggcaacctgaccgtggtgggcaaggagcccgagagcatcctgcaggtgctgagccagatggagaagatcgtgagaatcacctggagcaacccccccgcccagggcgccagaatcgtggccagcaccctgagcaaccccgagctgttcgaggagtggaccggcaacgtgaagaccatggccgacagaatcctgaccatgagaagcgagctgagagccagactggaggccctgaagacccccggcacctggaaccacatcaccgaccagatcggcatgttcagcttcaccggcctgaaccccaagcaggtggagtacctggtgaacgagaagcacatctacctgctgcccagcggcagaatcaacgtgagcggcctgaccaccaagaacctggactacgtggccaccagcatccacgaggccgtgaccaagatccagtag

SEQ ID NO: 83232 - DNA, 1101 bp, Artificial Sequence
  Description of Artificial Sequence: Synthetic coding sequence
atggccccccccagcgtgttcgccgaggtgccccaggcccagcccgtgctggtgttcaagctgaccgccgacttcagagaggaccccgaccccagaaaggtgaacctgggcgtgggcgcctacagaaccgacgacagccccgccctgaaggagaagagagtgggcggcgtgcagagcctgggcggcaccggcgccctgagaatcggcgccgacttcctggccagatggtacaacggcaccaacaacaagaacacccccgtgtacgtgagcagccccacctgggagaaccacaacgccgtgttcagcgccgccggcttcaaggacatcagaagctacagatactgggacgccgagaagagaggcctggacctgcagggcttcctgaacgacctggagaacgcccccgagttcagcatcgtggtgctgcacgcctgcgcccacaaccccaccggcatcgaccccacccccgagcagtggaagcagatcgccagcgtgatgaagcacagattcctgttccccttcttcgacagcgcctaccagggcttcgccagcggcaacctggagagagacgcctgggccatcagatacttcgtgagcgagggcttcgagttcttctgcgcccagagcttcagcaagaacttcggcctgtacaacgagagagtgggcaacctgaccgtggtgggcaaggagcccgagagcatcctgcaggtgctgagccagatggagaagatcgtgagaatcacctggagcaacccccccgcccagggcgccagaatcgtggccagcaccctgagcaaccccgagctgttcgaggagtggaccggcaacgtgaagaccatggccgacagaatcctgaccatgagaagcgagctgagagccagactggaggccctgaagacccccggcacctggaaccacatcaccgaccagatcggcatgttcagcttcaccggcctgaaccccaagcaggtggagtacctggtgaacgagaagcacatctacctgctgcccagcggcagaatcaacgtgagcggcctgaccaccaagaacctggactacgtggccaccagcatccacgaggccgtgaccaagatccagtag

SEQ ID NO: 83233 - DNA, 1179 bp, Artificial Sequence
  Description of Artificial Sequence: Synthetic coding sequence
atgcaggtgtggagcccctggaagggcgccatgtgccccagaccccacaagcccgcctacagaaccgacgactgccacccctgggtgctgcccgtggtgaagaaggtggagcagaagatcgccaacgacaacagcctgaaccacgagtacctgcccatcctgggcctggccgagttcagaagctgcgccagcagactggccctgggcgacgacagccccgccctgaaggagaagagagtgggcggcgtgcagagcctgggcggcaccggcgccctgagaatcggcgccgacttcctggccagatggtacaacggcaccaacaacaagaacacccccgtgtacgtgagcagccccacctgggagaaccacaacgccgtgttcagcgccgccggcttcaaggacatcagaagctacagatactgggacgccgagaagagaggcctggacctgcagggcttcctgaacgacctggagaacgcccccgagttcagcatcgtggtgctgcacgcctgcgcccacaaccccaccggcatcgaccccacccccgagcagtggaagcagatcgccagcgtgatgaagcacagattcctgttccccttcttcgacagcgcctaccagggcttcgccagcggcaacctggagagagacgcctgggccatcagatacttcgtgagcgagggcttcgagttcttctgcgcccagagcttcagcaagaacttcggcctgtacaacgagagagtgggcaacctgaccgtggtgggcaaggagcccgagagcatcctgcaggtgctgagccagatggagaagatcgtgagaatcacctggagcaacccccccgcccagggcgccagaatcgtggccagcaccctgagcaaccccgagctgttcgaggagtggaccggcaacgtgaagaccatggccgacagaatcctgaccatgagaagcgagctgagagccagactggaggccctgaagacccccggcacctggaaccacatcaccgaccagatcggcatgttcagcttcaccggcctgaaccccaagcaggtggagtacctggtgaacgagaagcacatctacctgctgcccagcggcagaatcaacgtgagcggcctgaccaccaagaacctggactacgtggccaccagcatccacgaggccgtgaccaagatccagtag

SEQ ID NO: 83234 - DNA, 1293 bp, Artificial Sequence
  Description of Artificial Sequence: Synthetic coding sequence
atggccctgctgcacagcggcagagtgctgcccggcatcgccgccgccttccaccccggcctggccgccgccgccagcgccagagccagcagctggtggacccacgtggagatgggcccccccgaccccatcctgggcgtgaccgaggccttcaagagagacaccaacagcaagaagatgaacctgggcgtgggcgcctacagagacgacaacggcaagccctacgtgctgcccagcgtgagaaaggccgaggcccagatcgccgccaagaacctggacaaggagtacctgcccatcggcggcctggccgagttctgcaaggccagcgccgagctggccctgggcgagaacagcgaggtgctgaagagcggcagattcgtgaccgtgcagaccatcagcggcaccggcgccctgagaatcggcgccagcttcctgcagagattcttcaagttcagcagagacgtgttcctgcccaagcccacctggggcaaccacacccccatcttcagagacgccggcatgcagctgcagggctacagatactacgaccccaagacctgcggcttcgacttcaccggcgccgtggaggacatcagcaagatccccgagcagagcgtgctgctgctgcacgcctgcgcccacaaccccaccggcgtggaccccagacccgagcagtggaaggagatcgccaccgtggtgaagaagagaaacctgttcgccttcttcgacatggcctaccagggcttcgccagcggcgacggcgacaaggacgcctgggccgtgagacacttcatcgagcagggcatcaacgtgtgcctgtgccagagctacgccaagaacatgggcctgtacggcgagagagtgggcgccttcaccatggtgtgcaaggacgccgacgaggccaagagagtggagagccagctgaagatcctgatcagacccatgtacagcaacccccccctgaacggcgccagaatcgccgccgccatcctgaacacccccgacctgagaaagcagtggctgcaggaggtgaaggtgatggccgacagaatcatcggcatgagaacccagctggtgagcaacctgaagaaggagggcagcacccacaactggcagcacatcaccgaccagatcggcatgttctgcttcaccggcctgaagcccgagcaggtggagagactgatcaaggagttcagcatctacatgaccaaggacggcagaatcagcgtggccggcgtgaccagcagcaacgtgggctacctggcccacgccatccaccaggtgaccaagtag

SEQ ID NO: 83235 - DNA, 570 bp, Artificial Sequence
  Description of Artificial Sequence: Synthetic coding sequence
atggccctgctgcacagcggcagagtgctgcccggcatcgccgccgccttccaccccggcctggccgccgccgccagcgccagagccagcagctggtggacccacgtggagatgggcccccccgaccccatcctgggcgtgaccgaggccttcaagagagacaccaacagcaagaagatgaacctgggcgtgggcgcctacagagacgacaacggcaagccctacgtgctgcccagcgtgagaaaggccgaggcccagatcgccgccaagaacctggacaaggagtacctgcccatcggcggcctggccgagttctgcaaggacttcctgagcagcgccgagatgagcttctgccccaaccagcccggcgagaccacccaccccagcagcggcatgctggcctgcagctacaaggtgatcggcatcatgacccccagactggccgtgctgaccagccaggccctgtggagaatcttccagaagtaccagagcagagtgttcttcttctgcatgcccgcccccaccatccccagagagtggaccagagtgagaaacagcggcagaaagtag

SEQ ID NO: 83236 - DNA, 1164 bp, Artificial Sequence
  Description of Artificial Sequence: Synthetic coding sequence
atggccctgctgcacagcggcagagtgctgcccggcatcgccgccgccttccaccccggcctggccgccgccgccagcgccagagccagcagctggtggacccacgtggagatgggcccccccgaccccatcctgggcgtgaccgaggccttcaagagagacaccaacagcaagaagatgaacctgggcgtgggcgcctacagagacgacaacggcaagccctacgtgctgcccagcgtgagaaagttcgtgaccgtgcagaccatcagcggcaccggcgccctgagaatcggcgccagcttcctgcagagattcttcaagttcagcagagacgtgttcctgcccaagcccacctggggcaaccacacccccatcttcagagacgccggcatgcagctgcagggctacagatactacgaccccaagacctgcggcttcgacttcaccggcgccgtggaggacatcagcaagatccccgagcagagcgtgctgctgctgcacgcctgcgcccacaaccccaccggcgtggaccccagacccgagcagtggaaggagatcgccaccgtggtgaagaagagaaacctgttcgccttcttcgacatggcctaccagggcttcgccagcggcgacggcgacaaggacgcctgggccgtgagacacttcatcgagcagggcatcaacgtgtgcctgtgccagagctacgccaagaacatgggcctgtacggcgagagagtgggcgccttcaccatggtgtgcaaggacgccgacgaggccaagagagtggagagccagctgaagatcctgatcagacccatgtacagcaacccccccctgaacggcgccagaatcgccgccgccatcctgaacacccccgacctgagaaagcagtggctgcaggaggtgaaggtgatggccgacagaatcatcggcatgagaacccagctggtgagcaacctgaagaaggagggcagcacccacaactggcagcacatcaccgaccagatcggcatgttctgcttcaccggcctgaagcccgagcaggtggagagactgatcaaggagttcagcatctacatgaccaaggacggcagaatcagcgtggccggcgtgaccagcagcaacgtgggctacctggcccacgccatccaccaggtgaccaagtag

SEQ ID NO: 83237 - DNA, 1491 bp, Artificial Sequence
  Description of Artificial Sequence: Synthetic coding sequence
atggccagcagcaccggcgacagaagccaggccgtgagacacggcctgagagccaaggtgctgaccctggacggcatgaaccccagagtgagaagagtggagtacgccgtgagaggccccatcgtgcagagagccctggagctggagcaggagctgagacagggcgtgaagaagcccttcaccgaggtgatcagagccaacatcggcgacgcccaggccatgggccagagacccatcaccttcctgagacaggtgctggccctgtgcgtgaaccccgacctgctgagcagccccaacttccccgacgacgccaagaagagagccgagagaatcctgcaggcctgcggcggccacagcctgggcgcctacagcgtgagcagcggcatccagctgatcagagaggacgtggccagatacatcgagagaagagacggcggcatccccgccgaccccaacaacgtgttcctgagcaccggcgccagcgacgccatcgtgaccgtgctgaagctgctggtggccggcgagggccacaccagaaccggcgtgctgatccccatcccccagtaccccctgtacagcgccaccctggccgagctgggcgccgtgcaggtggactactacctggacgaggagagagcctgggccctggacgtggccgagctgcacagagccctgggccaggccagagaccactgcagacccagagccctgtgcgtgatcaaccccggcaaccccaccggccaggtgcagaccagagagtgcatcgaggccgtgatcagattcgccttcgaggagagactgttcctgctggccgacgaggtgtaccaggacaacgtgtacgccgccggcagccagttccacagcttcaagaaggtgctgatggagatgggccccccctacgccggccagcaggagctggccagcttccacagcaccagcaagggctacatgggcgagtgcggcttcagaggcggctacgtggaggtggtgaacatggacgccgccgtgcagcagcagatgctgaagctgatgagcgtgagactgtgcccccccgtgcccggccaggccctgctggacctggtggtgagcccccccgcccccaccgaccccagcttcgcccagttccaggccgagaagcaggccgtgctggccgagctggccgccaaggccaagctgaccgagcaggtgttcaacgaggcccccggcatcagctgcaaccccgtgcagggcgccatgtacagcttccccagagtgcagctgccccccagagccgtggagagagcccaggagctgggcctggcccccgacatgttcttctgcctgagactgctggaggagaccggcatctgcgtggtgcccggcagcggcttcggccagagagagggcacctaccacttcagaatgaccatcctgccccccctggagaagctgagactgctgctggagaagctgagcagattccacgccaagttcaccctggagtacagctag

SEQ ID NO: 83238 - DNA, 1491 bp, Artificial Sequence; identical to SEQ ID NO: 83237
  Description of Artificial Sequence: Synthetic coding sequence

SEQ ID NO: 83239 - DNA, 2010 bp, Artificial Sequence
  Description of Artificial Sequence: Synthetic coding sequence
atgatgagactgagaggcagcggcatgctgagagacctgctgctgagaagccccgccggcgtgagcgccaccctgagaagagcccagcccctggtgaccctgtgcagaagacccagaggcggcggcagacccgccgccggccccgccgccgccgccagactgcacccctggtggggcggcggcggctggcccgccgagcccctggccagaggcctgagcagcagccccagcgagatcctgcaggagctgggcaagggcagcacccacccccagcccggcgtgagcccccccgccgcccccgccgcccccggccccaaggacggccccggcgagaccgacgccttcggcaacagcgagggcaaggagctggtggccagcggcgagaacaagatcaagcagggcctgctgcccagcctggaggacctgctgttctacaccatcgccgagggccaggagaagatccccgtgcacaagttcatcaccgccctgaagagcaccggcctgagaaccagcgaccccagactgaaggagtgcatggacatgctgagactgaccctgcagaccaccagcgacggcgtgatgctggacaaggacctgttcaagaagtgcgtgcagagcaacatcgtgctgctgacccaggccttcagaagaaagttcgtgatccccgacttcatgagcttcaccagccacatcgacgagctgtacgagagcgccaagaagcagagcggcggcaaggtggccgactacatcccccagctggccaagttcagccccgacctgtggggcgtgagcgtgtgcaccgtggacggccagagacacagcaccggcgacaccaaggtgcccttctgcctgcagagctgcgtgaagcccctgaagtacgccatcgccgtgaacgacctgggcaccgagtacgtgcacagatacgtgggcaaggagcccagcggcctgagattcaacaagctgttcctgaacgaggacgacaagccccacaaccccatggtgaacgccggcgccatcgtggtgaccagcctgatcaagcagggcgtgaacaacgccgagaagttcgactacgtgatgcagttcctgaacaagatggccggcaacgagtacgtgggcttcagcaacgccaccttccagagcgagagagagagcggcgacagaaacttcgccatcggctactacctgaaggagaagaagtgcttccccgagggcaccgacatggtgggcatcctggacttctacttccagctgtgcagcatcgaggtgacctgcgagagcgccagcgtgatggccgccaccctggccaacggcggcttctgccccatcaccggcgagagagtgctgagccccgaggccgtgagaaacaccctgagcctgatgcacagctgcggcatgtacgacttcagcggccagttcgccttccacgtgggcctgcccgccaagagcggcgtggccggcggcatcctgctggtggtgcccaacgtgatgggcatgatgtgctggagcccccccctggacaagatgggcaacagcgtgaagggcatccacttctgccacgacctggtgagcctgtgcaacttccacaactacgacaacctgagacacttcgccaagaagctggaccccagaagagagggcggcgaccagagagtgaagagcgtgatcaacctgctgttcgccgcctacaccggcgacgtgagcgccctgagaagattcgccctgagcgccatggacatggagcagagagactacgacagcagaaccgccctgcacgtggccgccgccgagggccacgtggaggtggtgaagttcctgctggaggcctgcaaggtgaaccccttccccaaggacagatggaacaacacccccatggacgaggccctgcacttcggccaccacgacgtgttcaagatcctgcaggagtaccaggtgcagtacaccccccagggcgacagcgacaacggcaaggagaaccagaccgtgcacaagaacctggacggcctgctgtag

SEQ ID NO: 83240 - DNA, 1797 bp, Artificial Sequence
  Description of Artificial Sequence: Synthetic coding sequence
atgatgagactgagaggcagcggcatgctgagagacctgctgctgagaagccccgccggcgtgagcgccaccctgagaagagcccagcccctggtgaccctgtgcagaagacccagaggcggcggcagacccgccgccggccccgccgccgccgccagactgcacccctggtggggcggcggcggctggcccgccgagcccctggccagaggcctgagcagcagccccagcgagatcctgcaggagctgggcaagggcagcacccacccccagcccggcgtgagcccccccgccgcccccgccgcccccggccccaaggacggccccggcgagaccgacgccttcggcaacagcgagggcaaggagctggtggccagcggcgagaacaagatcaagcagggcctgctgcccagcctggaggacctgctgttctacaccatcgccgagggccaggagaagatccccgtgcacaagttcatcaccgccctgaagagcaccggcctgagaaccagcgaccccagactgaaggagtgcatggacatgctgagactgaccctgcagaccaccagcgacggcgtgatgctggacaaggacctgttcaagaagtgcgtgcagagcaacatcgtgctgctgacccaggccttcagaagaaagttcgtgatccccgacttcatgagcttcaccagccacatcgacgagctgtacgagagcgccaagaagcagagcggcggcaaggtggccgactacatcccccagctggccaagttcagccccgacctgtggggcgtgagcgtgtgcaccgtggacggccagagacacagcaccggcgacaccaaggtgcccttctgcctgcagagctgcgtgaagcccctgaagtacgccatcgccgtgaacgacctgggcaccgagtacgtgcacagatacgtgggcaaggagcccagcggcctgagattcaacaagctgttcctgaacgaggacgacaagccccacaaccccatggtgaacgccggcgccatcgtggtgaccagcctgatcaagcagggcgtgaacaacgccgagaagttcgactacgtgatgcagttcctgaacaagatggccggcaacgagtacgtgggcttcagcaacgccaccttccagagcgagagagagagcggcgacagaaacttcgccatcggctactacctgaaggagaagaagtgcttccccgagggcaccgacatggtgggcatcctggacttctacttccagctgtgcagcatcgaggtgacctgcgagagcgccagcgtgatggccgccaccctggccaacggcggcttctgccccatcaccggcgagagagtgctgagccccgaggccgtgagaaacaccctgagcctgatgcacagctgcggcatgtacgacttcagcggccagttcgccttccacgtgggcctgcccgccaagagcggcgtggccggcggcatcctgctggtggtgcccaacgtgatgggcatgatgtgctggagcccccccctggacaagatgggcaacagcgtgaagggcatccacttctgccacgacctggtgagcctgtgcaacttccacaactacgacaacctgagacacttcgccaagaagctggaccccagaagagagggcggcgaccagagacacagcttcggccccctggactacgagagcctgcagcaggagctggccctgaaggagaccgtgtggaagaaggtgagccccgagagcaacgaggacatcagcaccaccgtggtgtacagaatggagagcctgggcgagaagagctag

SEQ ID NO: 83241 - DNA, 525 bp, Artificial Sequence
  Description of Artificial Sequence: Synthetic coding sequence
atgggcatgatgtgctggagcccccccctggacaagatgggcaacagcgtgaagggcatccacttctgccacgacctggtgagcctgtgcaacttccacaactacgacaacctgagacacttcgccaagaagctggaccccagaagagagggcggcgaccagagagtgaagagcgtgatcaacctgctgttcgccgcctacaccggcgacgtgagcgccctgagaagattcgccctgagcgccatggacatggagcagagagactacgacagcagaaccgccctgcacgtggccgccgccgagggccacgtggaggtggtgaagttcctgctggaggcctgcaaggtgaaccccttccccaaggacagatggaacaacacccccatggacgaggccctgcacttcggccaccacgacgtgttcaagatcctgcaggagtaccaggtgcagtacaccccccagggcgacagcgacaacggcaaggagaaccagaccgtgcacaagaacctggacggcctgctgtag

SEQ ID NO: 83242 - DNA, 1809 bp, Artificial Sequence
  Description of Artificial Sequence: Synthetic coding sequence
atgagaagcatgaaggccctgcagaaggccctgagcagagccggcagccactgcggcagaggcggctggggccaccccagcagaagccccctgctgggcggcggcgtgagacaccacctgagcgaggccgccgcccagggcagagagaccccccacagccaccagccccagcaccaggaccacgacagcagcgagagcggcatgctgagcagactgggcgacctgctgttctacaccatcgccgagggccaggagagaatccccatccacaagttcaccaccgccctgaaggccaccggcctgcagaccagcgaccccagactgagagactgcatgagcgagatgcacagagtggtgcaggagagcagcagcggcggcctgctggacagagacctgttcagaaagtgcgtgagcagcaacatcgtgctgctgacccaggccttcagaaagaagttcgtgatccccgacttcgaggagttcaccggccacgtggacagaatcttcgaggacgtgaaggagctgaccggcggcaaggtggccgcctacatcccccagctggccaagagcaaccccgacctgtggggcgtgagcctgtgcaccgtggacggccagagacacagcgtgggccacaccaagatccccttctgcctgcagagctgcgtgaagcccctgacctacgccatcagcatcagcaccctgggcaccgactacgtgcacaagttcgtgggcaaggagcccagcggcctgagatacaacaagctgagcctgaacgaggagggcatcccccacaaccccatggtgaacgccggcgccatcgtggtgagcagcctgatcaagatggactgcaacaaggccgagaagttcgacttcgtgctgcagtacctgaacaagatggccggcaacgagtacatgggcttcagcaacgccaccttccagagcgagaaggagaccggcgacagaaactacgccatcggctactacctgaaggagaagaagtgcttccccaagggcgtggacatgatggccgccctggacctgtacttccagctgtgcagcgtggaggtgacctgcgagagcggcagcgtgatggccgccaccctggccaacggcggcatctgccccatcaccggcgagagcgtgctgagcgccgaggccgtgagaaacaccctgagcctgatgcacagctgcggcatgtacgacttcagcggccagttcgccttccacgtgggcctgcccgccaagagcgccgtgagcggcgccatcctgctggtggtgcccaacgtgatgggcatgatgtgcctgagcccccccctggacaagctgggcaacagccacagaggcaccagcttctgccagaagctggtgagcctgttcaacttccacaactacgacaacctgagacactgcgccagaaagctggaccccagaagagagggcgccgagatcagaaacaagaccgtggtgaacctgctgttcgccgcctacagcggcgacgtgagcgccctgagaagattcgccctgagcgccatggacatggagcagaaggactacgacagcagaaccgccctgcacgtggccgccgccgagggccacatcgaggtggtgaagttcctgatcgaggcctgcaaggtgaaccccttcgccaaggacagatggggcaacatccccctggacgacgccgtgcagttcaaccacctggaggtggtgaagctgctgcaggactaccaggacagctacaccctgagcgagacccaggccgaggccgccgccgaggccctgagcaaggagaacctggagagcatggtgtag

SEQ ID NO: 83243 - DNA, 534 bp, Artificial Sequence
  Description of Artificial Sequence: Synthetic coding sequence
atgagaagcatgaaggccctgcagaaggccctgagcagagccggcagccactgcggcagaggcggctggggccaccccagcagaagccccctgctgggcggcggcgtgagacaccacctgagcgaggccgccgcccagggcagagagaccccccacagccaccagccccagcaccaggaccacgacagcagcgagagcggcatgctgagcagactgggcgacctgctgttctacaccatcgccgagggccaggagagaatccccatccacaagttcaccaccgccctgaaggccaccggcctgcagaccagcgaccccagactgagagactgcatgagcgagatgcacagagtggtgcaggagagcagcagcggcggcctgctggacagagacctgttcagaaagtggcagcccaccagcctgagctggcccagccagacccagacctgcggcgtgagcccctgcgccctgtggatggtgaacggcaccctgtgggccacccagagaagccccagcgcctgcagccccgtgtag

SEQ ID NO: 83244 - DNA, 2049 bp, Artificial Sequence
  Description of Artificial Sequence: Synthetic coding sequence
atgtgcggcatcttcgcctacatgaactacagagtgcccagaaccagaaaggagatcttcgagaccctgatcaagggcctgcagagactggagtacagaggctacgacagcgccggcgtggccatcgacggcaacaaccacgaggtgaaggagagacacatccagctggtgaagaagagaggcaaggtgaaggccctggacgaggagctgtacaagcaggacagcatggacctgaaggtggagttcgagacccacttcggcatcgcccacaccagatgggccacccacggcgtgcccagcgccgtgaacagccacccccagagaagcgacaagggcaacgagttcgtggtgatccacaacggcatcatcaccaactacaaggacctgagaaagttcctggagagcaagggctacgagttcgagagcgagaccgacaccgagaccatcgccaagctgatcaagtacgtgttcgacaacagagagaccgaggacatcaccttcagcaccctggtggagagagtgatccagcagctggagggcgccttcgccctggtgttcaagagcgtgcactaccccggcgaggccgtggccaccagaagaggcagccccctgctgatcggcgtgagaagcaagtacaagctgagcaccgagcagatccccatcctgtacagaacctgcaccctggagaacgtgaagaacatctgcaagaccagaatgaagagactggacagcagcgcctgcctgcacgccgtgggcgacaaggccgtggagttcttcttcgccagcgacgccagcgccatcatcgagcacaccaacagagtgatcttcctggaggacgacgacatcgccgccgtggccgacggcaagctgagcatccacagagtgaagagaagcgccagcgacgaccccagcagagccatccagaccctgcagatggagctgcagcagatcatgaagggcaacttcagcgccttcatgcagaaggagatcttcgagcagcccgagagcgtgttcaacaccatgagaggcagagtgaacttcgagaccaacaccgtgctgctgggcggcctgaaggaccacctgaaggagatcagaagatgcagaagactgatcgtgatcggctgcggcaccagctaccacgccgccgtggccaccagacaggtgctggaggagctgaccgagctgcccgtgatggtggagctggccagcgacttcctggacagaaacacccccgtgttcagagacgacgtgtgcttcttcatcagccagagcggcgagaccgccgacaccctgctggccctgagatactgcaaggacagaggcgccctgaccgtgggcgtgaccaacaccgtgggcagcagcatcagcagagagaccgactgcggcgtgcacatcaacgccggccccgagatcggcgtggccagcaccaaggcctacaccagccagttcatcagcctggtgatgttcggcctgatgatgagcgaggacagaatcagcctgcagaacagaagacaggagatcatcagaggcctgagaagcctgcccgagctgatcaaggaggtgctgagcctggaggagaagatccacgacctggccctggagctgtacacccagagaagcctgctggtgatgggcagaggctacaactacgccacctgcctggagggcgccctgaagatcaaggagatcacctacatgcacagcgagggcatcctggccggcgagctgaagcacggccccctggccctgatcgacaagcagatgcccgtgatcatggtgatcatgaaggacccctgcttcgccaagtgccagaacgccctgcagcaggtgaccgccagacagggcagacccatcatcctgtgcagcaaggacgacaccgagagcagcaagttcgcctacaagaccatcgagctgccccacaccgtggactgcctgcagggcatcctgagcgtgatccccctgcagctgctgagcttccacctggccgtgctgagaggctacgacgtggacttccccagaaacctggccaagagcgtgaccgtggagtag

SEQ ID NO: 83245 - DNA, 1086 bp, Artificial Sequence
  Description of Artificial Sequence: Synthetic coding sequence
atggccggcggcagacacagaagagtggtgggcaccctgcacctgctgctgctggtggccgccctgccctgggccagcagaggcgtgagccccagcgccagcgcctggcccgaggagaagaactaccaccagcccgccatcctgaacagcagcgccctgagacagatcgccgagggcaccagcatcagcgagatgtggcagaacgacctgcagcccctgctgatcgagagataccccggcagccccggcagctacgccgccagacagcacatcatgcagagaatccagagactgcaggccgactgggtgctggagatcgacaccttcctgagccagaccccctacggctacagaagcttcagcaacatcatcagcaccctgaaccccaccgccaagagacacctggtgctggcctgccactacgacagcaagtacttcagccactggaacaacagagtgttcgtgggcgccaccgacagcgccgtgccctgcgccatgatgctggagctggccagagccctggacaagaagctgctgagcctgaagaccgtgagcgacagcaagcccgacctgagcctgcagctgatcttcttcgacggcgaggaggccttcctgcactggagcccccaggacagcctgtacggcagcagacacctggccgccaagatggccagcaccccccacccccccggcgccagaggcaccagccagctgcacggcatggacctgctggtgctgctggacctgatcggcgcccccaaccccaccttccccaacttcttccccaacagcgccagatggttcgagagactgcaggccatcgagcacgagctgcacgagctgggcctgctgaaggaccacagcctggagggcagatacttccagaactacagctacggcggcgtgatccaggacgaccacatccccttcctgagaagaggcgtgcccgtgctgcacctgatccccagccccttccccgaggtgtggcacaccatggacgacaacgaggagaacctggacgagagcaccatcgacaacctgaacaagatcctgcaggtgttcgtgctggagtacctgcacctgtag

SEQ ID NO: 83246 - DNA, 939 bp, Artificial Sequence
  Description of Artificial Sequence: Synthetic coding sequence
atggccggcggcagacacagaagagtggtgggcaccctgcacctgctgctgctggtggccgccctgccctgggccagcagaggcgtgagccccagcgccagcgcctggcccgaggagaagcacatcatgcagagaatccagagactgcaggccgactgggtgctggagatcgacaccttcctgagccagaccccctacggctacagaagcttcagcaacatcatcagcaccctgaaccccaccgccaagagacacctggtgctggcctgccactacgacagcaagtacttcagccactggaacaacagagtgttcgtgggcgccaccgacagcgccgtgccctgcgccatgatgctggagctggccagagccctggacaagaagctgctgagcctgaagaccgtgagcgacagcaagcccgacctgagcctgcagctgatcttcttcgacggcgaggaggccttcctgcactggagcccccaggacagcctgtacggcagcagacacctggccgccaagatggccagcaccccccacccccccggcgccagaggcaccagccagctgcacggcatggacctgctggtgctgctggacctgatcggcgcccccaaccccaccttccccaacttcttccccaacagcgccagatggttcgagagactgcaggccatcgagcacgagctgcacgagctgggcctgctgaaggaccacagcctggagggcagatacttccagaactacagctacggcggcgtgatccaggacgaccacatccccttcctgagaagaggcgtgcccgtgctgcacctgatccccagccccttccccgaggtgtggcacaccatggacgacaacgaggagaacctggacgagagcaccatcgacaacctgaacaagatcctgcaggtgttcgtgctggagtacctgcacctgtag

SEQ ID NO: 83247 - DNA, 2328 bp, Artificial Sequence
  Description of Artificial Sequence: Synthetic coding sequence
atggccgccctggacagcctgagcctgttcaccagcctgggcctgagcgagcagaaggccagagagaccctgaagaacagcgccctgagcgcccagctgagagaggccgccacccaggcccagcagaccctgggcagcaccatcgacaaggccaccggcatcctgctgtacggcctggccagcagactgagagacaccagaagactgagcttcctggtgagctacatcgccagcaagaagatccacaccgagccccagctgagcgccgccctggagtacgtgagaagccaccccctggaccccatcgacaccgtggacttcgagagagagtgcggcgtgggcgtgatcgtgacccccgagcagatcgaggaggccgtggaggccgccatcaacagacacagaccccagctgctggtggagagataccacttcaacatgggcctgctgatgggcgaggccagagccgtgctgaagtgggccgacggcaagatgatcaagaacgaggtggacatgcaggtgctgcacctgctgggccccaagctggaggccgacctggagaagaagttcaaggtggccaaggccagactggaggagaccgacagaagaaccgccaaggacgtggtggagaacggcgagaccgccgaccagaccctgagcctgatggagcagctgagaggcgaggccctgaagttccacaagcccggcgagaactacaagacccccggctacgtggtgaccccccacaccatgaacctgctgaagcagcacctggagatcaccggcggccaggtgagaaccagattcccccccgagcccaacggcatcctgcacatcggccacgccaaggccatcaacttcaacttcggctacgccaaggccaacaacggcatctgcttcctgagattcgacgacaccaaccccgagaaggaggaggccaagttcttcaccgccatctgcgacatggtggcctggctgggctacaccccctacaaggtgacctacgccagcgactacttcgaccagctgtacgcctgggccgtggagctgatcagaagaggcctggcctacgtgtgccaccagagaggcgaggagctgaagggccacaacaccctgcccagcccctggagagacagacccatggaggagagcctgctgctgttcgaggccatgagaaagggcaagttcagcgagggcgaggccaccctgagaatgaagctggtgatggaggacggcaagatggaccccgtggcctacagagtgaagtacaccccccaccacagaaccggcgacaagtggtgcatctaccccacctacgactacacccactgcctgtgcgacagcatcgagcacatcacccacagcctgtgcaccaaggagttccaggccagaagaagcagctacttctggctgtgcaacgccctggacgtgtactgccccgtgcagtgggagtacggcagactgaacctgcactacgccgtggtgagcaagagaaagatcctgcagctggtggccaccggcgccgtgagagactgggacgaccccagactgttcaccctgaccgccctgagaagaagaggcttcccccccgaggccatcaacaacttctgcgccagagtgggcgtgaccgtggcccagaccaccatggagccccacctgctggaggcctgcgtgagagacgtgctgaacgacaccgcccccagagccatggccgtgctggagagcctgagagtgatcatcaccaacttccccgccgccaagagcctggacatccaggtgcccaacttccccgccgacgagaccaagggcttccaccaggtgcccttcgcccccatcgtgttcatcgagagaaccgacttcaaggaggagcccgagcccggcttcaagagactggcctggggccagcccgtgggcctgagacacaccggctacgtgatcgagctgcagcacgtggtgaagggccccagcggctgcgtggagagcctggaggtgacctgcagaagagccgacgccggcgagaagcccaaggccttcatccactgggtgagccagcccctgatgtgcgaggtgagactgtacgagagactgttccagcacaagaaccccgaggaccccaccgaggtgcccggcggcttcctgagcgacctgaacctggccagcctgcacgtggtggacgccgccctggtggactgcagcgtggccctggccaagcccttcgacaagttccagttcgagagactgggctacttcagcgtggaccccgacagccaccagggcaagctggtgttcaacagaaccgtgaccctgaaggaggaccccggcaaggtgtag

SEQ ID NO: 83248 - DNA, 2295 bp, Artificial Sequence
  Description of Artificial Sequence: Synthetic coding sequence
atggccgccctggacagcctgagcctgttcaccagcctgggcctgagcgagcagaaggccagagagaccctgaagaacagcgccctgagcgcccagctgagagaggccgccacccaggcccagcagaccctgggcagcaccatcgacaaggccaccggcatcctgctgtacggcctggccagcagactgagagacaccagaagactgagcttcctggtgagctacatcgccaccgccctggagtacgtgagaagccaccccctggaccccatcgacaccgtggacttcgagagagagtgcggcgtgggcgtgatcgtgacccccgagcagatcgaggaggccgtggaggccgccatcaacagacacagaccccagctgctggtggagagataccacttcaacatgggcctgctgatgggcgaggccagagccgtgctgaagtgggccgacggcaagatgatcaagaacgaggtggacatgcaggtgctgcacctgctgggccccaagctggaggccgacctggagaagaagttcaaggtggccaaggccagactggaggagaccgacagaagaaccgccaaggacgtggtggagaacggcgagaccgccgaccagaccctgagcctgatggagcagctgagaggcgaggccctgaagttccacaagcccggcgagaactacaagacccccggctacgtggtgaccccccacaccatgaacctgctgaagcagcacctggagatcaccggcggccaggtgagaaccagattcccccccgagcccaacggcatcctgcacatcggccacgccaaggccatcaacttcaacttcggctacgccaaggccaacaacggcatctgcttcctgagattcgacgacaccaaccccgagaaggaggaggccaagttcttcaccgccatctgcgacatggtggcctggctgggctacaccccctacaaggtgacctacgccagcgactacttcgaccagctgtacgcctgggccgtggagctgatcagaagaggcctggcctacgtgtgccaccagagaggcgaggagctgaagggccacaacaccctgcccagcccctggagagacagacccatggaggagagcctgctgctgttcgaggccatgagaaagggcaagttcagcgagggcgaggccaccctgagaatgaagctggtgatggaggacggcaagatggaccccgtggcctacagagtgaagtacaccccccaccacagaaccggcgacaagtggtgcatctaccccacctacgactacacccactgcctgtgcgacagcatcgagcacatcacccacagcctgtgcaccaaggagttccaggccagaagaagcagctacttctggctgtgcaacgccctggacgtgtactgccccgtgcagtgggagtacggcagactgaacctgcactacgccgtggtgagcaagagaaagatcctgcagctggtggccaccggcgccgtgagagactgggacgaccccagactgttcaccctgaccgccctgagaagaagaggcttcccccccgaggccatcaacaacttctgcgccagagtgggcgtgaccgtggcccagaccaccatggagccccacctgctggaggcctgcgtgagagacgtgctgaacgacaccgcccccagagccatggccgtgctggagagcctgagagtgatcatcaccaacttccccgccgccaagagcctggacatccaggtgcccaacttccccgccgacgagaccaagggcttccaccaggtgcccttcgcccccatcgtgttcatcgagagaaccgacttcaaggaggagcccgagcccggcttcaagagactggcctggggccagcccgtgggcctgagacacaccggctacgtgatcgagctgcagcacgtggtgaagggccccagcggctgcgtggagagcctggaggtgacctgcagaagagccgacgccggcgagaagcccaaggccttcatccactgggtgagccagcccctgatgtgcgaggtgagactgtacgagagactgttccagcacaagaaccccgaggaccccaccgaggtgcccggcggcttcctgagcgacctgaacctggccagcctgcacgtggtggacgccgccctggtggactgcagcgtggccctggccaagcccttcgacaagttccagttcgagagactgggctacttcagcgtggaccccgacagccaccagggcaagctggtgttcaacagaaccgtgaccctgaaggaggaccccggcaaggtgtag

SEQ ID NO: 83249 - DNA, 849 bp, Artificial Sequence
  Description of Artificial Sequence: Synthetic coding sequence
atgcccacctgcagactgggccccaagttcctgctggtgagcggcgtgagcgccatggccgccctggacagcctgagcctgttcaccagcctgggcctgagcgagcagaaggccagagagaccctgaagaacagcgccctgagcgcccagctgagagaggccgccacccaggcccagcagaccctgggcagcaccatcgacaaggccaccggcatcctgctgtacggcctggccagcagactgagagacaccagaagactgagcttcctggtgagctacatcgccagcaagaagatccacaccgagccccagctgagcgccgccctggagtacgtgagaagccaccccctggaccccatcgacaccgtggacttcgagagagagtgcggcgtgggcgtgatcgtgacccccgagcagatcgaggaggccgtggaggccgccatcaacagacacagaccccagctgctggtggagagataccacttcaacatgggcctgctgatgggcgaggccagagccgtgctgaagtgggccgacggcaagatgatcaagaacgaggtggacatgcaggtgctgcacctgctgggccccaagctggaggccgacctggagaagaagttcaaggtggccaaggccagactggaggagaccgacagaagaaccgccaaggacgtggtggagaacggcgagaccgccgaccagaccctgagcctgatggagcagctgagaggcgaggccctgaagttccacaagcccggcacctaccccgtgcccgccagaacccagtggaaccccgcctactggacctgccagagccaccagttccagctgtggctgtgccaggtgtag

SEQ ID NO: 83250 - DNA, 2874 bp, Artificial Sequence
  Description of Artificial Sequence: Synthetic coding sequence
atgaacttcgccgagagagagggcagcaagagatactgcatccagaccaagcacgtggccatcctgtgcgccgtggtggtgggcgtgggcctgatcgtgggcctggccgtgggcctgaccagaagctgcgacagcagcggcgacggcggccccggcaccgcccccgcccccagccacctgcccagcagcaccgccagccccagcggcccccccgcccaggaccaggacatctgccccgccagcgaggacgagagcggccagtggaagaacttcagactgcccgacttcgtgaaccccgtgcactacgacctgcacgtgaagcccctgctggaggaggacacctacaccggcaccgtgagcatcagcatcaacctgagcgcccccaccagatacctgtggctgcacctgagagagaccagaatcaccagactgcccgagctgaagagacccagcggcgaccaggtgcaggtgagaagatgcttcgagtacaagaagcaggagtacgtggtggtggaggccgaggaggagctgacccccagcagcggcgacggcctgtacctgctgaccatggagttcgccggctggctgaacggcagcctggtgggcttctacagaaccacctacaccgagaacggccaggtgaagagcatcgtggccaccgaccacgagcccaccgacgccagaaagagcttcccctgcttcgacgagcccaacaagaaggccacctacaccatcagcatcacccaccccaaggagtacggcgccctgagcaacatgcccgtggccaaggaggagagcgtggacgacaagtggaccagaaccaccttcgagaagagcgtgcccatgagcacctacctggtgtgcttcgccgtgcaccagttcgacagcgtgaagagaatcagcaacagcggcaagcccctgaccatctacgtgcagcccgagcagaagcacaccgccgagtacgccgccaacatcaccaagagcgtgttcgactacttcgaggagtacttcgccatgaactacagcctgcccaagctggacaagatcgccatccccgacttcggcaccggcgccatggagaactggggcctgatcacctacagagagaccaacctgctgtacgaccccaaggagagcgccagcagcaaccagcagagagtggccaccgtggtggcccacgagctggtgcaccagtggttcggcaacatcgtgaccatggactggtgggaggacctgtggctgaacgagggcttcgccagcttcttcgagttcctgggcgtgaaccacgccgagaccgactggcagatgagagaccagatgctgctggaggacgtgctgcccgtgcaggaggacgacagcctgatgagcagccaccccatcatcgtgaccgtgaccacccccgacgagatcaccagcgtgttcgacggcatcagctacagcaagggcagcagcatcctgagaatgctggaggactggatcaagcccgagaacttccagaagggctgccagatgtacctggagaagtaccagttcaagaacgccaagaccagcgacttctgggccgccctggaggaggccagcagactgcccgtgaaggaggtgatggacacctggaccagacagatgggctaccccgtgctgaacgtgaacggcgtgaagaacatcacccagaagagattcctgctggaccccagagccaaccccagccagccccccagcgacctgggctacacctggaacatccccgtgaagtggaccgaggacaacatcaccagcagcgtgctgttcaacagaagcgagaaggagggcatcaccctgaacagcagcaaccccagcggcaacgccttcctgaagatcaaccccgaccacatcggcttctacagagtgaactacgaggtggccacctgggacagcatcgccaccgccctgagcctgaaccacaagaccttcagcagcgccgacagagccagcctgatcgacgacgccttcgccctggccagagcccagctgctggactacaaggtggccctgaacctgaccaagtacctgaagagagaggagaacttcctgccctggcagagagtgatcagcgccgtgacctacatcatcagcatgttcgaggacgacaaggagctgtaccccatgatcgaggagtacttccagggccaggtgaagcccatcgccgacagcctgggctggaacgacgccggcgaccacgtgaccaagctgctgagaagcagcgtgctgggcttcgcctgcaagatgggcgacagagaggccctgaacaacgccagcagcctgttcgagcagtggctgaacggcaccgtgagcctgcccgtgaacctgagactgctggtgtacagatacggcatgcagaacagcggcaacgagatcagctggaactacaccctggagcagtaccagaagaccagcctggcccaggagaaggagaagctgctgtacggcctggccagcgtgaagaacgtgaccctgctgagcagatacctggacctgctgaaggacaccaacctgatcaagacccaggacgtgttcaccgtgatcagatacatcagctacaacagctacggcaagaacatggcctggaactggatccagctgaactgggactacctggtgaacagatacaccctgaacaacagaaacctgggcagaatcgtgaccatcgccgagcccttcaacaccgagctgcagctgtggcagatggagagcttcttcgccaagtacccccaggccggcgccggcgagaagcccagagagcaggtgctggagaccgtgaagaacaacatcgagtggctgaagcagcacagaaacaccatcagagagtggttcttcaacctgctggagagcggctag

SEQ ID NO: 83251 - DNA, 4539 bp, Artificial Sequence
  Description of Artificial Sequence: Synthetic coding sequence
atggccaccctgagcctgaccgtgaacagcggcgacccccccctgggcgccctgctggccgtggagcacgtgaaggacgacgtgagcatcagcgtggaggagggcaaggagaacatcctgcacgtgagcgagaacgtgatcttcaccgacgtgaacagcatcctgagatacctggccagagtggccaccaccgccggcctgtacggcagcaacctgatggagcacaccgagatcgaccactggctggagttcagcgccaccaagctgagcagctgcgacagcttcaccagcaccatcaacgagctgaaccactgcctgagcctgagaacctacctggtgggcaacagcctgagcctggccgacctgtgcgtgtgggccaccctgaagggcaacgccgcctggcaggagcagctgaagcagaagaaggcccccgtgcacgtgaagagatggttcggcttcctggaggcccagcaggccttccagagcgtgggcaccaagtgggacgtgagcaccaccaaggccagagtggcccccgagaagaagcaggacgtgggcaagttcgtggagctgcccggcgccgagatgggcaaggtgaccgtgagattcccccccgaggccagcggctacctgcacatcggccacgccaaggccgccctgctgaaccagcactaccaggtgaacttcaagggcaagctgatcatgagattcgacgacaccaaccccgagaaggagaaggaggacttcgagaaggtgatcctggaggacgtggccatgctgcacatcaagcccgaccagttcacctacaccagcgaccacttcgagaccatcatgaagtacgccgagaagctgatccaggagggcaaggcctacgtggacgacacccccgccgagcagatgaaggccgagagagagcagagaatcgacagcaagcacagaaagaaccccatcgagaagaacctgcagatgtgggaggagatgaagaagggcagccagttcggccagagctgctgcctgagagccaagatcgacatgagcagcaacaacggctgcatgagagaccccaccctgtacagatgcaagatccagccccaccccagaaccggcaacaagtacaacgtgtaccccacctacgacttcgcctgccccatcgtggacagcatcgagggcgtgacccacgccctgagaaccaccgagtaccacgacagagacgagcagttctactggatcatcgaggccctgggcatcagaaagccctacatctgggagtacagcagactgaacctgaacaacaccgtgctgagcaagagaaagctgacctggttcgtgaacgagggcctggtggacggctgggacgaccccagattccccaccgtgagaggcgtgctgagaagaggcatgaccgtggagggcctgaagcagttcatcgccgcccagggcagcagcagaagcgtggtgaacatggagtgggacaagatctgggccttcaacaagaaggtgatcgaccccgtggcccccagatacgtggccctgctgaagaaggaggtgatccccgtgaacgtgcccgaggcccaggaggagatgaaggaggtggccaagcaccccaagaaccccgaggtgggcctgaagcccgtgtggtacagccccaaggtgttcatcgagggcgccgacgccgagaccttcagcgagggcgagatggtgaccttcatcaactggggcaacctgaacatcaccaagatccacaagaacgccgacggcaagatcatcagcctggacgccaagctgaacctggagaacaaggactacaagaagaccaccaaggtgacctggctggccgagaccacccacgccctgcccatccccgtgatctgcgtgacctacgagcacctgatcaccaagcccgtgctgggcaaggacgaggacttcaagcagtacgtgaacaagaacagcaagcacgaggagctgatgctgggcgacccctgcctgaaggacctgaagaagggcgacatcatccagctgcagagaagaggcttcttcatctgcgaccagccctacgagcccgtgagcccctacagctgcaaggaggccccctgcgtgctgatctacatccccgacggccacaccaaggagatgcccaccagcggcagcaaggagaagaccaaggtggaggccaccaagaacgagaccagcgcccccttcaaggagagacccacccccagcctgaacaacaactgcaccaccagcgaggacagcctggtgctgtacaacagagtggccgtgcagggcgacgtggtgagagagctgaaggccaagaaggcccccaaggaggacgtggacgccgccgtgaagcagctgctgagcctgaaggccgagtacaaggagaagaccggccaggagtacaagcccggcaacccccccgccgagatcggccagaacatcagcagcaacagcagcgccagcatcctggagagcaagagcctgtacgacgaggtggccgcccagggcgaggtggtgagaaagctgaaggccgagaagagccccaaggccaagatcaacgaggccgtggagtgcctgctgagcctgaaggcccagtacaaggagaagaccggcaaggagtacatccccggccagccccccctgagccagagcagcgacagcagccccaccagaaacagcgagcccgccggcctggagacccccgaggccaaggtgctgttcgacaaggtggccagccagggcgaggtggtgagaaagctgaagaccgagaaggcccccaaggaccaggtggacatcgccgtgcaggagctgctgcagctgaaggcccagtacaagagcctgatcggcgtggagtacaagcccgtgagcgccaccggcgccgaggacaaggacaagaagaagaaggagaaggagaacaagagcgagaagcagaacaagccccagaagcagaacgacggccagagaaaggaccccagcaagaaccagggcggcggcctgagcagcagcggcgccggcgagggccagggccccaagaagcagaccagactgggcctggaggccaagaaggaggagaacctggccgactggtacagccaggtgatcaccaagagcgagatgatcgagtaccacgacatcagcggctgctacatcctgagaccctgggcctacgccatctgggaggccatcaaggacttcttcgacgccgagatcaagaagctgggcgtggagaactgctacttccccatgttcgtgagccagagcgccctggagaaggagaagacccacgtggccgacttcgcccccgaggtggcctgggtgaccagaagcggcaagaccgagctggccgagcccatcgccatcagacccaccagcgagaccgtgatgtaccccgcctacgccaagtgggtgcagagccacagagacctgcccatcaagctgaaccagtggtgcaacgtggtgagatgggagttcaagcacccccagcccttcctgagaaccagagagttcctgtggcaggagggccacagcgccttcgccaccatggaggaggccgccgaggaggtgctgcagatcctggacctgtacgcccaggtgtacgaggagctgctggccatccccgtggtgaagggcagaaagaccgagaaggagaagttcgccggcggcgactacaccaccaccatcgaggccttcatcagcgccagcggcagagccatccagggcggcaccagccaccacctgggccagaacttcagcaagatgttcgagatcgtgttcgaggaccccaagatccccggcgagaagcagttcgcctaccagaacagctggggcctgaccaccagaaccatcggcgtgatgaccatggtgcacggcgacaacatgggcctggtgctgccccccagagtggcctgcgtgcaggtggtgatcatcccctgcggcatcaccaacgccctgagcgaggaggacaaggaggccctgatcgccaagtgcaacgactacagaagaagactgctgagcgtgaacatcagagtgagagccgacctgagagacaactacagccccggctggaagttcaaccactgggagctgaagggcgtgcccatcagactggaggtgggccccagagacatgaagagctgccagttcgtggccgtgagaagagacaccggcgagaagctgaccgtggccgagaacgaggccgagaccaagctgcaggccatcctggaggacatccaggtgaccctgttcaccagagccagcgaggacctgaagacccacatggtggtggccaacaccatggaggacttccagaagatcctggacagcggcaagatcgtgcagatccccttctgcggcgagatcgactgcgaggactggatcaagaagaccaccgccagagaccaggacctggagcccggcgcccccagcatgggcgccaagagcctgtgcatccccttcaagcccctgtgcgagctgcagcccggcgccaagtgcgtgtgcggcaagaaccccgccaagtactacaccctgttcggcagaagctactag

SEQ ID NO: 83252 - DNA, 2964 bp, Artificial Sequence
  Description of Artificial Sequence: Synthetic coding sequence
atggccaccctgagcctgaccgtgaacagcggcgacccccccctgggcgccctgctggccgtggagcacgtgaaggacgacgtgagcatcagcgtggaggagggcaaggagaacatcctgcacgtgagcgagaacgtgatcttcaccgacgtgaacagcatcctgagatacctggccagagtggccaccaccgccggcctgtacggcagcaacctgatggagcacaccgagatcgaccactggctggagttcagcgccaccaagctgagcagctgcgacagcttcaccagcaccatcaacgagctgaaccactgcctgagcctgagaacctacctggtgggcaacagcctgagcctggccgacctgtgcgtgtgggccaccctgaagggcaacgccgcctggcaggagcagctgaagcagaagaaggcccccgtgcacgtgaagagatggttcggcttcctggaggcccagcaggccttccagagcgtgggcaccaagtgggacgtgagcaccaccaaggccagagtggcccccgagaagaagcaggacgtgggcaagttcgtggagctgcccggcgccgagatgggcaaggtgaccgtgagattcccccccgaggccagcggctacctgcacatcggccacgccaaggccgccctgctgaaccagcactaccaggtgaacttcaagggcaagctgatcatgagattcgacgacaccaaccccgagaaggagaaggaggacttcgagaaggtgatcaagagcgtggtgatgaccctgtgccagaagagcatcaaggtgaccggcctgcccaacaccttcatggtgatcctggaggacgtggccatgctgcacatcaagcccgaccagttcacctacaccagcgaccacttcgagaccatcatgaagtacgccgagaagctgatccaggagggcaaggcctacgtggacgacacccccgccgagcagatgaaggccgagagagagcagagaatcgacagcaagcacagaaagaaccccatcgagaagaacctgcagatgtgggaggagatgaagaagggcagccagttcggccagagctgctgcctgagagccaagatcgacatgagcagcaacaacggctgcatgagagaccccaccctgtacagatgcaagatccagccccaccccagaaccggcaacaagtacaacgtgtaccccacctacgacttcgcctgccccatcgtggacagcatcgagggcgtgacccacgccctgagaaccaccgagtaccacgacagagacgagcagttctactggatcatcgaggccctgggcatcagaaagccctacatctgggagtacagcagactgaacctgaacaacaccgtgctgagcaagagaaagctgacctggttcgtgaacgagggcctggtggacggctgggacgaccccagattccccaccgtgagaggcgtgctgagaagaggcatgaccgtggagggcctgaagcagttcatcgccgcccagggcagcagcagaagcgtggtgaacatggagtgggacaagatctgggccttcaacaagaaggtgatcgaccccgtggcccccagatacgtggccctgctgaagaaggaggtgatccccgtgaacgtgcccgaggcccaggaggagatgaaggaggtggccaagcaccccaagaaccccgaggtgggcctgaagcccgtgtggtacagccccaaggtgttcatcgagggcgccgacgccgagaccttcagcgagggcgagatggtgaccttcatcaactggggcaacctgaacatcaccaagatccacaagaacgccgacggcaagatcatcagcctggacgccaagctgaacctggagaacaaggactacaagaagaccaccaaggtgacctggctggccgagaccacccacgccctgcccatccccgtgatctgcgtgacctacgagcacctgatcaccaagcccgtgctgggcaaggacgaggacttcaagcagtacgtgaacaagaacagcaagcacgaggagctgatgctgggcgacccctgcctgaaggacctgaagaagggcgacatcatccagctgcagagaagaggcttcttcatctgcgaccagccctacgagcccgtgagcccctacagctgcaaggaggccccctgcgtgctgatctacatccccgacggccacaccaaggagatgcccaccagcggcagcaaggagaagaccaaggtggaggccaccaagaacgagaccagcgcccccttcaaggagagacccacccccagcctgaacaacaactgcaccaccagcgaggacagcctggtgctgtacaacagagtggccgtgcagggcgacgtggtgagagagctgaaggccaagaaggcccccaaggaggacgtggacgccgccgtgaagcagctgctgagcctgaaggccgagtacaaggagaagaccggccaggagtacaagcccggcaacccccccgccgagatcggccagaacatcagcagcaacagcagcgccagcatcctggagagcaagagcctgtacgacgaggtggccgcccagggcgaggtggtgagaaagctgaaggccgagaagagccccaaggccaagatcaacgaggccgtggagtgcctgctgagcctgaaggcccagtacaaggagaagaccggcaaggagtacatccccggccagccccccctgagccagagcagcgacagcagccccaccagaaacagcgagcccgccggcctggagacccccgaggccaaggtgctgttcgacaaggtggccagccagggcgaggtggtgagaaagctgaagaccgagaaggcccccaaggaccaggtggacatcgccgtgcaggagctgctgcagctgaaggcccagtacaagagcctgatcggcgtggagtacaagcccgtgagcgccaccggcgccgaggacaaggacaagtag

SEQ ID NO: 83253 - DNA, 2928 bp, Artificial Sequence
  Description of Artificial Sequence: Synthetic coding sequence
atggccaccctgagcctgaccgtgaacagcggcgacccccccctgggcgccctgctggccgtggagcacgtgaaggacgacgtgagcatcagcgtggaggagggcaaggagaacatcctgcacgtgagcgagaacgtgatcttcaccgacgtgaacagcatcctgagatacctggccagagtggccaccaccgccggcctgtacggcagcaacctgatggagcacaccgagatcgaccactggctggagttcagcgccaccaagctgagcagctgcgacagcttcaccagcaccatcaacgagctgaaccactgcctgagcctgagaacctacctggtgggcaacagcctgagcctggccgacctgtgcgtgtgggccaccctgaagggcaacgccgcctggcaggagcagctgaagcagaagaaggcccccgtgcacgtgaagagatggttcggcttcctggaggcccagcaggccttccagagcgtgggcaccaagtgggacgtgagcaccaccaaggccagagtggcccccgagaagaagcaggacgtgggcaagttcgtggagctgcccggcgccgagatgggcaaggtgaccgtgagattcccccccgaggccagcggctacctgcacatcggccacgccaaggccgccctgctgaaccagcactaccaggtgaacttcaagggcaagctgatcatgagattcgacgacaccaaccccgagaaggagaaggaggacttcgagaaggtgatcctggaggacgtggccatgctgcacatcaagcccgaccagttcacctacaccagcgaccacttcgagaccatcatgaagtacgccgagaagctgatccaggagggcaaggcctacgtggacgacacccccgccgagcagatgaaggccgagagagagcagagaatcgacagcaagcacagaaagaaccccatcgagaagaacctgcagatgtgggaggagatgaagaagggcagccagttcggccagagctgctgcctgagagccaagatcgacatgagcagcaacaacggctgcatgagagaccccaccctgtacagatgcaagatccagccccaccccagaaccggcaacaagtacaacgtgtaccccacctacgacttcgcctgccccatcgtggacagcatcgagggcgtgacccacgccctgagaaccaccgagtaccacgacagagacgagcagttctactggatcatcgaggccctgggcatcagaaagccctacatctgggagtacagcagactgaacctgaacaacaccgtgctgagcaagagaaagctgacctggttcgtgaacgagggcctggtggacggctgggacgaccccagattccccaccgtgagaggcgtgctgagaagaggcatgaccgtggagggcctgaagcagttcatcgccgcccagggcagcagcagaagcgtggtgaacatggagtgggacaagatctgggccttcaacaagaagctgagagccctgtgcaagaaggtgatcgaccccgtggcccccagatacgtggccctgctgaagaaggaggtgatccccgtgaacgtgcccgaggcccaggaggagatgaaggaggtggccaagcaccccaagaaccccgaggtgggcctgaagcccgtgtggtacagccccaaggtgttcatcgagggcgccgacgccgagaccttcagcgagggcgagatggtgaccttcatcaactggggcaacctgaacatcaccaagatccacaagaacgccgacggcaagatcatcagcctggacgccaagctgaacctggagaacaaggactacaagaagaccaccaaggtgacctggctggccgagaccacccacgccctgcccatccccgtgatctgcgtgacctacgagcacctgatcaccaagcccgtgctgggcaaggacgaggacttcaagcagtacgtgaacaagaacagcaagcacgaggagctgatgctgggcgacccctgcctgaaggacctgaagaagggcgacatcatccagctgcagagaagaggcttcttcatctgcgaccagccctacgagcccgtgagcccctacagctgcaaggaggccccctgcgtgctgatctacatccccgacggccacaccaaggagatgcccaccagcggcagcaaggagaagaccaaggtggaggccaccaagaacgagaccagcgcccccttcaaggagagacccacccccagcctgaacaacaactgcaccaccagcgaggacagcctggtgctgtacaacagagtggccgtgcagggcgacgtggtgagagagctgaaggccaagaaggcccccaaggaggacgtggacgccgccgtgaagcagctgctgagcctgaaggccgagtacaaggagaagaccggccaggagtacaagcccggcaacccccccgccgagatcggccagaacatcagcagcaacagcagcgccagcatcctggagagcaagagcctgtacgacgaggtggccgcccagggcgaggtggtgagaaagctgaaggccgagaagagccccaaggccaagatcaacgaggccgtggagtgcctgctgagcctgaaggcccagtacaaggagaagaccggcaaggagtacatccccggccagccccccctgagccagagcagcgacagcagccccaccagaaacagcgagcccgccggcctggagacccccgaggccaaggtgctgttcgacaaggtggccagccagggcgaggtggtgagaaagctgaagaccgagaaggcccccaaggaccaggtggacatcgccgtgcaggagctgctgcagctgaaggcccagtacaagagcctgatcggcgtggagtacaagcccgtgagcgccaccggcgccgaggacaaggacaagaagaagaaggagaagtag

SEQ ID NO: 83254 - DNA, 1572 bp, Artificial Sequence
  Description of Artificial Sequence: Synthetic coding sequence
atggccgccctgctgagaagactgctgcagagagagagacccagcgccgccagcggcagacccgtgggcagaagagaggccaacctgggcaccgacgccggcgtggccgtgagagtgagattcgcccccagccccaccggcttcctgcacctgggcggcctgagaaccgccctgtacaactacatcttcgccaagaagtaccagggcagcttcatcctgagactggaggacaccgaccagaccagagtggtgcccggcgccgccgagaacatcgaggacatgctggagtgggccggcatcccccccgacgagagccccagaagaggcggccccgccggcccctaccagcagagccagagactggagctgtacgcccaggccaccgaggccctgctgaagaccggcgccgcctacccctgcttctgcagcccccagagactggagctgctgaagaaggaggccctgagaaaccaccagacccccagatacgacaacagatgcagaaacatgagccaggagcaggtggcccagaagctggccaaggaccccaagcccgccatcagattcagactggagcaggtggtgcccgccttccaggacctggtgtacggctggaacagacacgaggtggccagcgtggagggcgaccccgtgatcatgaagagcgacggcttccccacctaccacctggcctgcgtggtggacgaccaccacatgggcatcagccacgtgctgagaggcagcgagtggctggtgagcaccgccaagcacctgctgctgtaccaggccctgggctggcagcccccccacttcgcccacctgcccctgctgctgaacagagacggcagcaagctgagcaagagacagggcgacgtgttcctggagcacttcgccgccgacggcttcctgcccgacagcctgctggacatcatcaccaactgcggcagcggcttcgccgagaaccagatgggcagaaccctgcccgagctgatcacccagttcaacctgacccaggtgacctgccacagcgccctgctggacctggagaagctgcccgagttcaacagactgcacctgcagagactggtgagcaacgagagccagagaagacagctggtgggcaagctgcaggtgctggtggaggaggccttcggctgccagctgcagaacagagacgtgctgaaccccgtgtacgtggagagaatcctgctgctgagacagggccacatctgcagactgcaggacctggtgagccccgtgtacagctacctgtggaccagacccgccgtgggcagagcccagctggacgccatcagcgagaaggtggacgtgatcgccaagagagtgctgggcctgctggagagaagcagcatgagcctgacccaggacatgctgaacggcgagctgaagaagctgagcgagggcctggagggcaccaagtacagcaacgtgatgaagctgctgagaatggccctgagcggccagcagcagggcccccccgtggccgagatgatgctggccctgggccccaaggaggtgagagagagaatccagaaggtggtgagcagctag

SEQ ID NO: 83255 - DNA, 1572 bp, Artificial Sequence; identical to SEQ ID NO: 83254
  Description of Artificial Sequence: Synthetic coding sequence

SEQ ID NO: 83256 - DNA, 321 bp, Artificial Sequence
  Description of Artificial Sequence: Synthetic coding sequence
atggcccaggagttcgtgaactgcaagatccagcccggcaaggtggtggtgttcatcaagcccacctgcccctactgcagaagagcccaggagatcctgagccagctgcccatcaagcagggcctgctggagttcgtggacatcaccgccaccaaccacaccaacgagatccaggactacctgcagcagctgaccggcgccagaaccgtgcccagagtgttcatcggcaaggactgcatcggcggctgcagcgacctggtgagcctgcagcagagcggcgagctgctgaccagactgaagcagatcggcgccctgcagtag

SEQ ID NO: 83257 - DNA, 321 bp, Artificial Sequence; identical to SEQ ID NO: 83256
  Description of Artificial Sequence: Synthetic coding sequence

SEQ ID NO: 83258 - DNA, 321 bp, Artificial Sequence; identical to SEQ ID NO: 83256
  Description of Artificial Sequence: Synthetic coding sequence

SEQ ID NO: 83259 - DNA, 321 bp, Artificial Sequence; identical to SEQ ID NO: 83256
  Description of Artificial Sequence: Synthetic coding sequence

SEQ ID NO: 83260 - DNA, 321 bp, Artificial Sequence; identical to SEQ ID NO: 83256
  Description of Artificial Sequence: Synthetic coding sequence

SEQ ID NO: 83261 - DNA, 495 bp, Artificial Sequence
  Description of Artificial Sequence: Synthetic coding sequence
atgatctggagaagagccgccctggccggcaccagactggtgtggagcagaagcggcagcgccggctggctggacagagccgccggcgccgccggcgccgccgccgccgccgccagcggcatggagagcaacaccagcagcagcctggagaacctggccaccgcccccgtgaaccagatccaggagaccatcagcgacaactgcgtggtgatcttcagcaagaccagctgcagctactgcaccatggccaagaagctgttccacgacatgaacgtgaactacaaggtggtggagctggacctgctggagtacggcaaccagttccaggacgccctgtacaagatgaccggcgagagaaccgtgcccagaatcttcgtgaacggcaccttcatcggcggcgccaccgacacccacagactgcacaaggagggcaagctgctgcccctggtgcaccagtgctacctgaagaagagcaagagaaaggagttccagtag

SEQ ID NO: 83262 - DNA, 498 bp, Artificial Sequence
  Description of Artificial Sequence: Synthetic coding sequence
atgaaccccagagacaagcaggtgagcagattcagccccctgaaggacgtgtacacctgggtggccctggccggcatccagagaagcggcagccccggcagaaccagaagcgccgccagaagaatggagagcaacaccagcagcagcctggagaacctggccaccgcccccgtgaaccagatccaggagaccatcagcgacaactgcgtggtgatcttcagcaagaccagctgcagctactgcaccatggccaagaagctgttccacgacatgaacgtgaactacaaggtggtggagctggacctgctggagtacggcaaccagttccaggacgccctgtacaagatgaccggcgagagaaccgtgcccagaatcttcgtgaacggcaccttcatcggcggcgccaccgacacccacagactgcacaaggagggcaagctgctgcccctggtgcaccagtgctacctgaagaagagcaagagaaaggagttccagtag

SEQ ID NO: 83263 - DNA, 1008 bp, Artificial Sequence
  Description of Artificial Sequence: Synthetic coding sequence
atggccgccggcgccgccgaggccgccgtggccgccgtggaggaggtgggcagcgccggccagttcgaggagctgctgagactgaaggccaagagcctgctggtggtgcacttctgggccccctgggccccccagtgcgcccagatgaacgaggtgatggccgagctggccaaggagctgccccaggtgagcttcgtgaagctggaggccgagggcgtgcccgaggtgagcgagaagtacgagatcagcagcgtgcccaccttcctgttcttcaagaacagccagaagatcgacagactggacggcgcccacgcccccgagctgaccaagaaggtgcagagacacgccagcagcggcagcttcctgcccagcgccaacgagcacctgaaggaggacctgaacctgagactgaagaagctgacccacgccgccccctgcatgctgttcatgaagggcaccccccaggagcccagatgcggcttcagcaagcagatggtggagatcctgcacaagcacaacatccagttcagcagcttcgacatcttcagcgacgaggaggtgagacagggcctgaaggcctacagcagctggcccacctacccccagctgtacgtgagcggcgagctgatcggcggcctggacatcatcaaggagctggaggccagcgaggagctggacaccatctgccccaaggcccccaagctggaggagagactgaaggtgctgaccaacaaggccagcgtgatgctgttcatgaagggcaacaagcaggaggccaagtgcggcttcagcaagcagatcctggagatcctgaacagcaccggcgtggagtacgagaccttcgacatcctggaggacgaggaggtgagacagggcctgaaggcctacagcaactggcccacctacccccagctgtacgtgaagggcgagctggtgggcggcctggacatcgtgaaggagctgaaggagaacggcgagctgctgcccatcctgagaggcgagaactag

SEQ ID NO: 83264 - DNA, 1008 bp, Artificial Sequence; identical to SEQ ID NO: 83263
  Description of Artificial Sequence: Synthetic coding sequence

SEQ ID NO: 83265 - DNA, 1008 bp, Artificial Sequence; identical to SEQ ID NO: 83263
  Description of Artificial Sequence: Synthetic coding sequence

SEQ ID NO: 83266 - DNA, 474 bp, Artificial Sequence
  Description of Artificial Sequence: Synthetic coding sequence
atgagcggcagcctgggcagagccgccgccgccctgctgagatggggcagaggcgccggcggcggcggcctgtggggccccggcgtgagagccgccggcagcggcgccggcggcggcggcagcgccgagcagctggacgccctggtgaagaaggacaaggtggtggtgttcctgaagggcacccccgagcagccccagtgcggcttcagcaacgccgtggtgcagatcctgagactgcacggcgtgagagactacgccgcctacaacgtgctggacgaccccgagctgagacagggcatcaaggactacagcaactggcccaccatcccccaggtgtacctgaacggcgagttcgtgggcggctgcgacatcctgctgcagatgcaccagaacggcgacctggtggaggagctgaagaagctgggcatccacagcgccctgctggacgagaagaaggaccaggacagcaagtag

SEQ ID NO: 83267 - DNA, 873 bp, Artificial Sequence
  Description of Artificial Sequence: Synthetic coding sequence
atgctgaagagagagatgaagcccgagagcgacagacccagaaaggtgagattcagaatcgccagcagccacagcggcagagtgctgaaggaggtgtacgaggacggccagcccagcggcagcctggacagcgagtgcgccagcatctgcggcatcgacggcctgggcgacagcgacggccagcagaacggccacatcgagagcgagggcgacgagaacgagaacgaccaggacagcctgctggtgctggccagagccgccagcgagaagggcttcggcaccagaagagtgaacatcctgagcaagaacggcaccgtgagaggcgtgaagtacaaggtgagcgccggccaggccctgttcaacaacctgaccaaggtgctgcagcagcccagcaccgacctggagttcgacagagtggtgatctacaccacctgcctgagagtggtgagaaccaccttcgagagatgcgagctggtgagaaagatcttccagaaccacagagtgaagttcgaggagaagaacatcgccctgaacggcgagtacggcaaggagctggacgagagatgcagaagagtgagcgaggcccccagcctgcccgtggtgttcatcgacggccactacctgggcggcgccgagaagatcctgagcatgaacgagagcggcgagctgcaggacatcctgaccaagatcgagagagtgcagcacccccacgagtgccccagctgcggcggcttcggcttcctgccctgcagcgtgtgccacggcagcaagatgagcatgttcagaaactgcttcaccgacagcttcaaggccctgaagtgcaccgcctgcaacgagaacggcctgcagagatgcaagaactgcgccggctag

SEQ ID NO: 83268 - DNA, 828 bp, Artificial Sequence; identical to SEQ ID NO: 75015
  Description of Artificial Sequence: Synthetic coding sequence

SEQ ID NO: 83269 - DNA, 987 bp, Artificial Sequence
  Description of Artificial Sequence: Synthetic coding sequence
atggccctgagaggcgtgagcgtgagactgctgagcagaggccccggcctgcacgtgctgagaacctgggtgagcagcgccgcccagaccgccagcagacccgagttcgactggcaggaccccctggtgctggaggagcagctgaccaccgacgagatcctgatcagagacaccttcagaacctactgccaggagagactgatgcccagaatcctgctggccaacagaaacgagggctacggctgcgccggcgtgagcagcgtggcctacggcctgctggccagagagctggagagagtggacagcggctacagaagcgccatgagcgtgcagagcagcctggtgatgcaccccatctacgcctacggcagcgaggagcagagacagaagtacctgccccagctggccaagggcgagctgctgggctgcttcggcctgaccgagcccaacagcggcagcgaccccagcagcatggagaccagagcccactacaacagcagcaacaagagctacaccctgaacggcaccaagacctggatcaccaacagccccatggccgacctgttcgtggtgtgggccagatgcgaggacggctgcatcagaggcttcctgctggagaagggcatgagaggcctgagcgcccccagaatccagggcaagttcagcctgagagccagcgccaccggcatgatcatcatggacggcgtggaggtgcccgaggagaacgtgctgcccggcgccagcagcctgggcggccccttcggctgcctgaacaacgccagatacggcatcgcctggggcgtgctgggcgccagcgagttctgcctgcacaccgccagacagtacgccctggacagaatgcagttcggcgtgcccctggccagaaaccagctgatccagaagaagctggccgacatgctgaccgagatcaccctgggcctgcacgcctgcctgcagctgggcagactgaaggaccaggacaagtag

SEQ ID NO: 83270 - DNA, 1185 bp, Artificial Sequence
  Description of Artificial Sequence: Synthetic coding sequence
atgagaagcagcagcggcacccccagcgcccccaccgccagaagagacagctgcctggccagctgctggcccatcgccaccaagagcctggccctgctgcccagactggagtgcagcggcaccatcctggcccactgcaagttctgcctgcccggcagcagcgacagccccgccagcacccccctggtggccggcatcaccggctacggctgcgccggcgtgagcagcgtggcctacggcctgctggccagagagctggagagagtggacagcggctacagaagcgccatgagcgtgcagagcagcctggtgatgcaccccatctacgcctacggcagcgaggagcagagacagaagtacctgccccagctggccaagggcgagctgctgggctgcttcggcctgaccgagcccaacagcggcagcgaccccagcagcatggagaccagagcccactacaacagcagcaacaagagctacaccctgaacggcaccaagacctggatcaccaacagccccatggccgacctgttcgtggtgtgggccagatgcgaggacggctgcatcagaggcttcctgctggagaagggcatgagaggcctgagcgcccccagaatccagggcaagttcagcctgagagccagcgccaccggcatgatcatcatggacggcgtggaggtgcccgaggagaacgtgctgcccggcgccagcagcctgggcggccccttcggctgcctgaacaacgccagatacggcatcgcctggggcgtgctgggcgccagcgagttctgcctgcacaccgccagacagtacgccctggacagaatgcagttcggcgtgcccctggccagaaaccagctgatccagaagaagctggccgacatgctgaccgagatcaccctgggcctgcacgcctgcctgcagctgggcagactgaaggaccaggacaaggccgcccccgagatggtgagcctgctgaagagaaacaactgcggcaaggccctggacatcgccagacaggccagagacatgctgggcggcaacggcatcagcgacgagtaccacgtgatcagacacgccatgaacctggaggccgtgaacacctacgagggcacccacgacatccacgccctgatcctgggcagagccatcaccggcatccaggccttcaccgccagcaagtag

SEQ ID NO: 83271 - DNA, 1287 bp, Artificial Sequence
  Description of Artificial Sequence: Synthetic coding sequence
atggccctgagaggcgtgagcgtgagactgctgagcagaggccccggcctgcacgtgctgagaacctgggtgagcagcgccgcccagaccgagaagggcggcagaacccagagccagctggccaagagcagcagacccgagttcgactggcaggaccccctggtgctggaggagcagctgaccaccgacgagatcctgatcagagacaccttcagaacctactgccaggagagactgatgcccagaatcctgctggccaacagaaacgaggtgttccacagagagatcatcagcgagatgggcgagctgggcgtgctgggccccaccatcaagggctacggctgcgccggcgtgagcagcgtggcctacggcctgctggccagagagctggagagagtggacagcggctacagaagcgccatgagcgtgcagagcagcctggtgatgcaccccatctacgcctacggcagcgaggagcagagacagaagtacctgccccagctggccaagggcgagctgctgggctgcttcggcctgaccgagcccaacagcggcagcgaccccagcagcatggagaccagagcccactacaacagcagcaacaagagctacaccctgaacggcaccaagacctggatcaccaacagccccatggccgacctgttcgtggtgtgggccagatgcgaggacggctgcatcagaggcttcctgctggagaagggcatgagaggcctgagcgcccccagaatccagggcaagttcagcctgagagccagcgccaccggcatgatcatcatggacggcgtggaggtgcccgaggagaacgtgctgcccggcgccagcagcctgggcggccccttcggctgcctgaacaacgccagatacggcatcgcctggggcgtgctgggcgccagcgagttctgcctgcacaccgccagacagtacgccctggacagaatgcagttcggcgtgcccctggccagaaaccagctgatccagaagaagctggccgacatgctgaccgagatcaccctgggcctgcacgcctgcctgcagctgggcagactgaaggaccaggacaaggccgcccccgagatggtgagcctgctgaagagaaacaactgcggcaaggccctggacatcgccagacaggccagagacatgctgggcggcaacggcatcagcgacgagtaccacgtgatcagacacgccatgaacctggaggccgtgaacacctacgaggtggtgcagatgtgcagcctgaagagaagatggaacagcctgtag

SEQ ID NO: 83272 - DNA, 297 bp, Artificial Sequence
  Description of Artificial Sequence: Synthetic coding sequence
  Description of Combined DNA/RNA Molecule: Synthetic coding sequence
atgtgcgccgccagactggccgccgccgccgccgccgcccagagcgtgtacgccttcagcgccagacccctggccggcggcgagcccgtgagcctgggcagcctgagaggcaaggtgctgctgatcgagaacgtggccagcctgugaggcaccaccgtgagagactacacccagatgaacgagctgcagagaagactgggccccagaggcctggtggtgctgggcttcccctgcaaccagttcggccaccaggtgagaagagccgagagaggcggcgccggcgccgacgtgcagtag

SEQ ID NO: 83273 - DNA, 612 bp, Artificial Sequence
  Description of Artificial Sequence: Synthetic coding sequence
  Description of Combined DNA/RNA Molecule: Synthetic coding sequence
atgtgcgccgccagactggccgccgccgccgccgccgcccagagcgtgtacgccttcagcgccagacccctggccggcggcgagcccgtgagcctgggcagcctgagaggcaaggtgctgctgatcgagaacgtggccagcctgugaggcaccaccgtgagagactacacccagatgaacgagctgcagagaagactgggccccagaggcctggtggtgctgggcttcccctgcaaccagttcggccaccaggagaacgccaagaacgaggagatcctgaacagcctgaagtacgtgagacccggcggcggcttcgagcccaacttcatgctgttcgagaagtgcgaggtgaacggcgccggcgcccaccccctgttcgccttcctgagagaggccctgcccgcccccagcgacgacgccaccgccctgatgaccgaccccaagctgatcacctggagccccgtgtgcagaaacgacgtggcctggaacttcgagaagttcctggtgggccccgacggcgtgcccctgagaagatacagcagaagattccagaccatcgacatcgagcccgacatcgaggccctgctgagccagggccccagctgcgcctag

SEQ ID NO: 83274 - DNA, 573 bp, Artificial Sequence
  Description of Artificial Sequence: Synthetic coding sequence
  Description of Combined DNA/RNA Molecule: Synthetic coding sequence
atggccttcatcgccaagagcttctacgacctgagcgccatcagcctggacggcgagaaggtggacttcaacaccttcagaggcagagccgtgctgatcgagaacgtggccagcctgugaggcaccaccaccagagacttcacccagctgaacgagctgcagtgcagattccccagaagactggtggtgctgggcttcccctgcaaccagttcggccaccaggagaactgccagaacgaggagatcctgaacagcctgaagtacgtgagacccggcggcggctaccagcccaccttcaccctggtgcagaagtgcgaggtgaacggccagaacgagcaccccgtgttcgcctacctgaaggacaagctgccctacccctacgacgaccccttcagcctgatgaccgaccccaagctgatcatctggagccccgtgagaagaagcgacgtggcctggaacttcgagaagttcctgatcggccccgagggcgagcccttcagaagatacagcagaaccttccccaccatcaacatcgagcccgacatcaagagactgctgaaggtggccatctag

SEQ ID NO: 83275 - DNA, 594 bp, Artificial Sequence
  Description of Artificial Sequence: Synthetic coding sequence
  Description of Combined DNA/RNA Molecule: Synthetic coding sequence
atgagcctgggcagactgtgcagactgctgaagcccgccctgctgtgcggcgccctggccgcccccggcctggccggcaccatgtgcgccagcagagacgactggagatgcgccagaagcatgcacgagttcagcgccaaggacatcgacggccacatggtgaacctggacaagtacagaggcttcgtgtgcatcgtgaccaacgtggccagccagugaggcaagaccgaggtgaactacacccagctggtggacctgcacgccagatacgccgagtgcggcctgagaatcctggccttcccctgcaaccagttcggcaagcaggagcccggcagcaacgaggagatcaaggagttcgccgccggctacaacgtgaagttcgacatgttcagcaagatctgcgtgaacggcgacgacgcccaccccctgtggaagtggatgaagatccagcccaagggcaagggcatcctgggcaacgccatcaagtggaacttcaccaagttcctgatcgacaagaacggctgcgtggtgaagagatacggccccatggaggagcccctggtgatcgagaaggacctgccccactacttctag

SEQ ID NO: 83276 - DNA, 666 bp, Artificial Sequence
  Description of Artificial Sequence: Synthetic coding sequence
atgaccacccagctgagagtggtgcacctgctgcccctgctgctggcctgcttcgtgcagaccagccccaagcaggagaagatgaagatggactgccacaaggacgagaagggcaccatctacgactacgaggccatcgccctgaacaagaacgagtacgtgagcttcaagcagtacgtgggcaagcacatcctgttcgtgaacgtggccacctactgcggcctgaccgcccagtaccccgagctgaacgccctgcaggaggagctgaagccctacggcctggtggtgctgggcttcccctgcaaccagttcggcaagcaggagcccggcgacaacaaggagatcctgcccggcctgaagtacgtgagacccggcggcggcttcgtgcccagcttccagctgttcgagaagggcgacgtgaacggcgagaaggagcagaaggtgttcagcttcctgaagcacagctgcccccaccccagcgagatcctgggcaccttcaagagcatcagctgggaccccgtgaaggtgcacgacatcagatggaacttcgagaagttcctggtgggccccgacggcatccccgtgatgagatggagccacagagccaccgtgagcagcgtgaagaccgacatcctggcctacctgaagcagttcaagaccaagtag

SEQ ID NO: 83277 - DNA, 303 bp, Artificial Sequence
  Description of Artificial Sequence: Synthetic coding sequence
atgaccacccagctgagagtggtgcacctgctgcccctgctgctggcctgcttcgtgcagaccagccccaagcaggagaagatgaagatggactgccacaaggacgagaagggcaccatctacgactacgaggccatcgccctgaacaagaacgagtacgtgagcttcaagcagtacgtgggcaagcacatcctgttcgtgaacgtggccacctactgcggcctgaccgcccagtaccccggcatgagcgtgcagggcgaggacctgtacctggtgagcagcttcctgagaaagggcatgtag

SEQ ID NO: 83278 - DNA, 573 bp, Artificial Sequence
  Description of Artificial Sequence: Synthetic coding sequence
atggccgagaagacccagaagagcgtgaagatcgcccccggcgccgtggtgtgcgtggagagcgagatcagaggcgacgtgaccatcggccccagaaccgtgatccaccccaaggccagaatcatcgccgaggccggccccatcgtgatcggcgagggcaacctgatcgaggagcaggccctgatcatcaacgcctaccccgacaacatcacccccgacaccgaggaccccgagcccaagcccatgatcatcggcaccaacaacgtgttcgaggtgggctgctacagccaggccatgaagatgggcgacaacaacgtgatcgagagcaaggcctacgtgggcagaaacgtgatcctgaccagcggctgcatcatcggcgcctgctgcaacctgaacaccttcgaggtgatccccgagaacaccgtgatctacggcgccgactgcctgagaagagtgcagaccgagagaccccagccccagaccctgcagctggacttcctgatgaagatcctgcccaactaccaccacctgaagaagaccatgaagggcagcagcacccccgtgaagaactag

SEQ ID NO: 83279 - DNA, 1440 bp, Artificial Sequence
  Description of Artificial Sequence: Synthetic coding sequence
atggcctgcagacaggagccccagccccagggccccccccccgccgccggcgccgtggccagctacgactacctggtgatcggcggcggcagcggcggcctggccagcgccagaagagccgccgagctgggcgccagagccgccgtggtggagagccacaagctgggcggcacctgcgtgaacgtgggctgcgtgcccaagaaggtgatgtggaacaccgccgtgcacagcgagttcatgcacgaccacgccgactacggcttccccagctgcgagggcaagttcaactggagagtgatcaaggagaagagagacgcctacgtgagcagactgaacgccatctaccagaacaacctgaccaagagccacatcgagatcatcagaggccacgccgccttcaccagcgaccccaagcccaccatcgaggtgagcggcaagaagtacaccgccccccacatcctgatcgccaccggcggcatgcccagcaccccccacgagagccagatccccggcgccagcctgggcatcaccagcgacggcttcttccagctggaggagctgcccggcagaagcgtgatcgtgggcgccggctacatcgccgtggagatggccggcatcctgagcgccctgggcagcaagaccagcctgatgatcagacacgacaaggtgctgagaagcttcgacagcatgatcagcaccaactgcaccgaggagctggagaacgccggcgtggaggtgctgaagttcagccaggtgaaggaggtgaagaagaccctgagcggcctggaggtgagcatggtgaccgccgtgcccggcagactgcccgtgatgaccatgatccccgacgtggactgcctgctgtgggccatcggcagagtgcccaacaccaaggacctgagcctgaacaagctgggcatccagaccgacgacaagggccacatcatcgtggacgagttccagaacaccaacgtgaagggcatctacgccgtgggcgacgtgtgcggcaaggccctgctgacccccgtggccatcgccgccggcagaaagctggcccacagactgttcgagtacaaggaggacagcaagctggactacaacaacatccccaccgtggtgttcagccacccccccatcggcaccgtgggcctgaccgaggacgaggccatccacaagtacggcatcgagaacgtgaagacctacagcaccagcttcacccccatgtaccacgccgtgaccaagagaaagaccaagtgcgtgatgaagatggtgtgcgccaacaaggaggagaaggtggtgggcatccacatgcagggcctgggctgcgacgagatgctgcagggcttcgccgtggccgtgaagatgggcgccaccaaggccgacttcgacaacaccgtggccatccaccccaccagcagcgaggagctggtgaccctgagatag

SEQ ID NO: 83280 - DNA, 1323 bp, Artificial Sequence
  Description of Artificial Sequence: Synthetic coding sequence
atggccctgctgcccagagccctgagcgccggcgccggccccagctggagaagagccgccagagccttcagaggcttcctgctgctgctgcccgagcccgccgccctgaccagagccctgagcagagccatggcctgcagacaggagccccagccccagggccccccccccgccgccggcgccgtggccagctacgactacctggtgatcggcggcggcagcggcggcctggccagcgccagaagagccgccgagctgggcgccagagccgccgtggtggagagccacaagctgggcggcacctgcgtgaacgtgggctgcgtgcccaagaaggtgatgtggaacaccgccgtgcacagcgagttcatgcacgaccacgccgactacggcttccccagctgcgagggcaagttcaactggagagtgatcaaggagaagagagacgcctacgtgagcagactgaacgccatctaccagaacaacctgaccaagagccacatcgagatcatcagaggccacgccgccttcaccagcgaccccaagcccaccatcgaggtgagcggcaagaagtacaccgccccccacatcctgatcgccaccggcggcatgcccagcaccccccacgagagccagatccccggcgccagcctgggcatcaccagcgacggcttcttccagctggaggagctgcccggcagaagcgtgatcgtgggcgccggctacatcgccgtggagatggccggcatcctgagcgccctgggcagcaagaccagcctgatgatcagacacgacaagggcatccagaccgacgacaagggccacatcatcgtggacgagttccagaacaccaacgtgaagggcatctacgccgtgggcgacgtgtgcggcaaggccctgctgacccccgtggccatcgccgccggcagaaagctggcccacagactgttcgagtacaaggaggacagcaagctggactacaacaacatccccaccgtggtgttcagccacccccccatcggcaccgtgggcctgaccgaggacgaggccatccacaagtacggcatcgagaacgtgaagacctacagcaccagcttcacccccatgtaccacgccgtgaccaagagaaagaccaagtgcgtgatgaagatggtgtgcgccaacaaggaggagaaggtggtgggcatccacatgcagggcctgggctgcgacgagatgctgcagggcttcgccgtggccgtgaagatgggcgccaccaaggccgacttcgacaacaccgtggccatccaccccaccagcagcgaggagctggtgaccctgagatag

SEQ ID NO: 83281 - DNA, 1410 bp, Artificial Sequence
  Description of Artificial Sequence: Synthetic coding sequence
atggccctgctgcccagagccctgagcgccggcgccggccccagctggagaagagccgccagagccttcagaggcttcctgctgctgctgcccgagcccgccgccctgaccagagccctgagcagagccatggcctgcagacaggagccccagccccagggccccccccccgccgccggcgccgtggccagctacgactacctggtgatcggcggcggcagcggcggcctggccagcgccagaagagccgccgagctgggcgccagagccgccgtggtggagagccacaagctgggcggcacctgcgtgaacgtgggctgcgtgcccaagaaggtgatgtggaacaccgccgtgcacagcgagttcatgcacgaccacgccgactacggcttccccagctgcgagggcaagttcaactggagagtgatcaaggagaagagagacgcctacgtgagcagactgaacgccatctaccagaacaacctgaccaagagccacatcgagatcatcagaggccacgccgccttcaccagcgaccccaagcccaccatcgaggtgagcggcaagaagtacaccgccccccacatcctgatcgccaccggcggcatgcccagcaccccccacgagagccagatccccggcgccagcctgggcatcaccagcgacggcttcttccagctggaggagctgcccggcagaagcgtgatcgtgggcgccggctacatcgccgtggagatggccggcatcctgagcgccctgggcagcaagaccagcctgatgatcagacacgacaaggtgctgagaagcttcgacagcatgatcagcaccaactgcaccgaggagctggagaacgccggcgtggaggtgctgaagttcagccagggcatccagaccgacgacaagggccacatcatcgtggacgagttccagaacaccaacgtgaagggcatctacgccgtgggcgacgtgtgcggcaaggccctgctgacccccgtggccatcgccgccggcagaaagctggcccacagactgttcgagtacaaggaggacagcaagctggactacaacaacatccccaccgtggtgttcagccacccccccatcggcaccgtgggcctgaccgaggacgaggccatccacaagtacggcatcgagaacgtgaagacctacagcaccagcttcacccccatgtaccacgccgtgaccaagagaaagaccaagtgcgtgatgaagatggtgtgcgccaacaaggaggagaaggtggtgggcatccacatgcagggcctgggctgcgacgagatgctgcagggcttcgccgtggccgtgaagatgggcgccaccaaggccgacttcgacaacaccgtggccatccaccccaccagcagcgaggagctggtgaccctgagatag

SEQ ID NO: 83282 - DNA, 1482 bp, Artificial Sequence
  Description of Artificial Sequence: Synthetic coding sequence
atggccctgctgcccagagccctgagcgccggcgccggccccagctggagaagagccgccagagccttcagaggcttcctgctgctgctgcccgagcccgccgccctgaccagagccctgagcagagccatggcctgcagacaggagccccagccccagggccccccccccgccgccggcgccgtggccagctacgactacctggtgatcggcggcggcagcggcggcctggccagcgccagaagagccgccgagctgggcgccagagccgccgtggtggagagccacaagctgggcggcacctgcgtgaacgtgggctgcgtgcccaagaaggtgatgtggaacaccgccgtgcacagcgagttcatgcacgaccacgccgactacggcttccccagctgcgagggcaagttcaactggagagtgatcaaggagaagagagacgcctacgtgagcagactgaacgccatctaccagaacaacctgaccaagagccacatcgagatcatcagaggccacgccgccttcaccagcgaccccaagcccaccatcgaggtgagcggcaagaagtacaccgccccccacatcctgatcgccaccggcggcatgcccagcaccccccacgagagccagatccccggcgccagcctgggcatcaccagcgacggcttcttccagctggaggagctgcccggcagaagcgtgatcgtgggcgccggctacatcgccgtggagatggccggcatcctgagcgccctgggcagcaagaccagcctgatgatcagacacgacaaggtgaaggaggtgaagaagaccctgagcggcctggaggtgagcatggtgaccgccgtgcccggcagactgcccgtgatgaccatgatccccgacgtggactgcctgctgtgggccatcggcagagtgcccaacaccaaggacctgagcctgaacaagctgggcatccagaccgacgacaagggccacatcatcgtggacgagttccagaacaccaacgtgaagggcatctacgccgtgggcgacgtgtgcggcaaggccctgctgacccccgtggccatcgccgccggcagaaagctggcccacagactgttcgagtacaaggaggacagcaagctggactacaacaacatccccaccgtggtgttcagccacccccccatcggcaccgtgggcctgaccgaggacgaggccatccacaagtacggcatcgagaacgtgaagacctacagcaccagcttcacccccatgtaccacgccgtgaccaagagaaagaccaagtgcgtgatgaagatggtgtgcgccaacaaggaggagaaggtggtgggcatccacatgcagggcctgggctgcgacgagatgctgcagggcttcgccgtggccgtgaagatgggcgccaccaaggccgacttcgacaacaccgtggccatccaccccaccagcagcgaggagctggtgaccctgagatag

SEQ ID NO: 83283 - DNA, 669 bp, Artificial Sequence
  Description of Artificial Sequence: Synthetic coding sequence
atggccgagaagcccaagctgcactacttcaacgccagaggcagaatggagagcaccagatggctgctggccgccgccggcgtggagttcgaggagaagttcatcaagagcgccgaggacctggacaagctgagaaacgacggctacctgatgttccagcaggtgcccatggtggagatcgacggcatgaagctggtgcagaccagagccatcctgaactacatcgccagcaagtacaacctgtacggcaaggacatcaaggagagagccctgatcgacatgtacatcgagggcatcgccgacctgggcgagatgatcctgctgctgcccgtgtgcccccccgaggagaaggacgccaagctggccctgatcaaggagaagatcaagaacagatacttccccgccttcgagaaggtgctgaagagccacggccaggactacctggtgggcaacaagctgagcagagccgacatccacctggtggagctgctgtactacgtggaggagctggacagcagcctgatcagcagcttccccctgctgaaggccctgaagaccagaatcagcaacctgcccaccgtgaagaagttcctgcagcccggcagccccagaaagccccccatggacgagaagagcctggaggaggccagaaagatcttcagattctag

SEQ ID NO: 83284 - DNA, 669 bp, Artificial Sequence
  Description of Artificial Sequence: Synthetic coding sequence
atggccgagaagcccaagctgcactacagcaacatcagaggcagaatggagagcatcagatggctgctggccgccgccggcgtggagttcgaggagaagttcatcaagagcgccgaggacctggacaagctgagaaacgacggctacctgatgttccagcaggtgcccatggtggagatcgacggcatgaagctggtgcagaccagagccatcctgaactacatcgccagcaagtacaacctgtacggcaaggacatcaaggagaaggccctgatcgacatgtacatcgagggcatcgccgacctgggcgagatgatcctgctgctgcccttcagccagcccgaggagcaggacgccaagctggccctgatccaggagaagaccaagaacagatacttccccgccttcgagaaggtgctgaagagccacggccaggactacctggtgggcaacaagctgagcagagccgacatccacctggtggagctgctgtactacgtggaggagctggacagcagcctgatcagcagcttccccctgctgaaggccctgaagaccagaatcagcaacctgcccaccgtgaagaagttcctgcagcccggcagccccagaaagccccccatggacgagaagagcctggaggagagcagaaagatcttcagattctag

SEQ ID NO: 83285 - DNA, 729 bp, Artificial Sequence
  Description of Artificial Sequence: Synthetic coding sequence
atgctgctgctggccccccagatgctgagcctgctgctgctggccctgcccgtgctggccagccccgcctacgtggcccccgcccccggccaggccctgcagcagaccggcatcgtgggcggccaggaggcccccagaagcaagtggccctggcaggtgagcctgagagtgagaggcccctactggatgcacttctgcggcggcagcctgatccacccccagtgggtgctgaccgccgcccactgcgtggagcccgacatcaaggacctggccgccctgagagtgcagctgagagagcagcacctgtactaccaggaccagctgctgcccgtgagcagaatcatcgtgcacccccagttctacatcatccagaccggcgccgacatcgccctgctggagctggaggagcccgtgaacatcagcagccacatccacaccgtgaccctgccccccgccagcgagaccttcccccccggcatgccctgctgggtgaccggctggggcgacgtggacaacaacgtgcacctgccccccccctaccccctgaaggaggtggaggtgcccgtggtggagaaccacctgtgcaacgccgagtaccacaccggcctgcacaccggccacagcttccagatcgtgagagacgacatgctgtgcgccggcagcgagaaccacgacagctgccagggcgacagcggcggccccctggtgtgcaaggtgaacggcacctag

SEQ ID NO: 83286 - DNA, 519 bp, Artificial Sequence
  Description of Artificial Sequence: Synthetic coding sequence
atgttccagcaggtgcccatggtggagatcgacggcatgaagctggtgcagaccagagccatcctgaactacatcgccagcaagtacaacctgtacggcaaggacatcaaggagagagccctgatcgacatgtacaccgagggcatggccgacctgaacgagatgatcctgctgctgcccctgtgcagacccgaggagaaggacgccaagatcgccctgatcaaggagaagaccaagagcagatacttccccgccttcgagaaggtgctgcagagccacggccaggactacctggtgggcaacaagctgagcagagccgacatcagcctggtggagctgctgtactacgtggaggagctggacagcagcctgatcagcaacttccccctgctgaaggccctgaagaccagaatcagcaacctgcccaccgtgaagaagttcctgcagcccggcagccccagaaagccccccgccgacgccaaggccctggaggaggccagaaagatcttcagattctag

SEQ ID NO: 83287 - DNA, 327 bp, Artificial Sequence
  Description of Artificial Sequence: Synthetic coding sequence
atgttccagcaggtgcccatggtggagatcgacggcatgaagctggtgcagaccagagccatcctgaactacatcgccagcaagtacaacctgtacggcaaggacatcaaggagagagccctgatcgacatgtacaccgagggcatggccgacctgaacgagatgatcctgctgctgcccctgtgcagacccgaggagaaggacgccaagatcgccctgatcaaggagaagaccaagagcagatacttccccgccttcgaggccgacatcagcctggtggagctgctgtactacgtggaggagctggacagcagcctgatcagctag

SEQ ID NO: 83288 - DNA, 669 bp, Artificial Sequence
  Description of Artificial Sequence: Synthetic coding sequence
atggccgccagacccaagctgcactaccccaacggcagaggcagaatggagagcgtgagatgggtgctggccgccgccggcgtggagttcgacgaggagttcctggagaccaaggagcagctgtacaagctgcaggacggcaaccacctgctgttccagcaggtgcccatggtggagatcgacggcatgaagctggtgcagaccagaagcatcctgcactacatcgccgacaagcacaacctgttcggcaagaacctgaaggagagaaccctgatcgacatgtacgtggagggcaccctggacctgctggagctgctgatcatgcaccccttcctgaagcccgacgaccagcagaaggaggtggtgaacatggcccagaaggccatcatcagatacttccccgtgttcgagaagatcctgagaggccacggccagagcttcctggtgggcaaccagctgagcctggccgacgtgatcctgctgcagaccatcctggccctggaggagaagatccccaacatcctgagcgccttccccttcctgcaggagtacaccgtgaagctgagcaacatccccaccatcaagagattcctggagcccggcagcaagaagaagcccccccccgacgagatctacgtgagaaccgtgtacaacatcttcagaccctag

SEQ ID NO: 83289 - DNA, 390 bp, Artificial Sequence
  Description of Artificial Sequence: Synthetic coding sequence
atgtacgtggagggcaccctggacctgctggagctgctgatcatgcaccccttcctgaagcccgacgaccagcagaaggaggtggtgaacatggcccagaaggccatcatcagatacttccccgtgttcgagaagatcctgagaggccacggccagagcttcctggtgggcaaccagctgagcctggccgacgtgatcctgctgcagaccatcctggccctggaggagaagatccccaacatcctgagcgccttccccttcctgcaggagtacaccgtgaagctgagcaacatccccaccatcaagagattcctggagcccggcagcaagaagaagcccccccccgacgagatctacgtgagaaccgtgtacaacatcttcagaccctag

SEQ ID NO: 83290 - DNA, 669 bp, Artificial Sequence; identical to SEQ ID NO: 83288
  Description of Artificial Sequence: Synthetic coding sequence

SEQ ID NO: 83291 - DNA, 270 bp, Artificial Sequence
  Description of Artificial Sequence: Synthetic coding sequence
atgtacgtggagggcaccctggacctgctggagctgctgatcatgcaccccttcctgaagcccgacgaccagcagaaggaggtggtgaacatggcccagaaggccatcatcagatacttccccgtgttcgagaagatcctgagaggccacggccagagcttcctggtgggcaaccagctgagcctggccgacgtgatcctgctgcagaccatcctggccctggaggagaagatccccaacatcctgagcgccttccccttcctgcagtag

SEQ ID NO: 83292 - DNA, 390 bp, Artificial Sequence; identical to SEQ ID NO: 83289
  Description of Artificial Sequence: Synthetic coding sequence

SEQ ID NO: 83293 - DNA, 669 bp, Artificial Sequence
  Description of Artificial Sequence: Synthetic coding sequence
atggccgagaagcccaagctgcactacagcaacgccagaggcagcatggagagcatcagatggctgctggccgccgccggcgtggagctggaggagaagttcctggagagcgccgaggacctggacaagctgagaaacgacggcagcctgctgttccagcaggtgcccatggtggagatcgacggcatgaagctggtgcagaccagagccatcctgaactacatcgccagcaagtacaacctgtacggcaaggacatgaaggagagagccctgatcgacatgtacaccgagggcatcgtggacctgaccgagatgatcctgctgctgctgatctgccagcccgaggagagagacgccaagaccgccctggtgaaggagaagatcaagaacagatacttccccgccttcgagaaggtgctgaagagccacagacaggactacctggtgggcaacaagctgagctgggccgacatccacctggtggagctgttctactacgtggaggagctggacagcagcctgatcagcagcttccccctgctgaaggccctgaagaccagaatcagcaacctgcccaccgtgaagaagttcctgcagcccggcagccagagaaagccccccatggacgagaagagcctggaggaggccagaaagatcttcagattctag

SEQ ID NO: 83294 - DNA, 669 bp, Artificial Sequence; identical to SEQ ID NO: 83293
  Description of Artificial Sequence: Synthetic coding sequence

SEQ ID NO: 83295 - DNA, 657 bp, Artificial Sequence
  Description of Artificial Sequence: Synthetic coding sequence
atgcccatgatcctgggctactgggacatcagaggcctggcccacgccatcagactgctgctggagtacaccgacagcagctacgaggagaagaagtacaccatgggcgacgcccccgactacgacagaagccagtggctgaacgagaagttcaagctgggcctggacttccccaacctgccctacctgatcgacggcgcccacaagatcacccagagcaacgccatcctgtgctacatcgccagaaagcacaacctgtgcggcgagaccgaggaggagaagatcagagtggacatcctggagaaccagaccatggacaaccacatgcagctgggcatgatctgctacaaccccgagttcgagaagctgaagcccaagtacctggaggagctgcccgagaagctgaagctgtacagcgagttcctgggcaagagaccctggttcgccggcaacaagatcaccttcgtggacttcctggtgtacgacgtgctggacctgcacagaatcttcgagcccaagtgcctggacgccttccccaacctgaaggacttcatcagcagattcgagggcctggagaagatcagcgcctacatgaagagcagcagattcctgcccagacccgtgttcagcaagatggccgtgtggggcaacaagtag

SEQ ID NO: 83296 - DNA, 546 bp, Artificial Sequence
  Description of Artificial Sequence: Synthetic coding sequence
atgcccatgatcctgggctactgggacatcagaggcctggcccacgccatcagactgctgctggagtacaccgacagcagctacgaggagaagaagtacaccatgggcgacgcccccgactacgacagaagccagtggctgaacgagaagttcaagctgggcctggacttccccaacctgccctacctgatcgacggcgcccacaagatcacccagagcaacgccatcctgtgctacatcgccagaaagcacaacctgtgcggcgagaccgaggaggagaagatcagagtggacatcctggagaaccagaccatggacaaccacatgcagctgggcatgatctgctacaaccccgagttcgagaagctgaagcccaagtacctggaggagctgcccgagaagctgaagctgtacagcgagttcctgggcaagagaccctggttcgccggcaacaagggcctggagaagatcagcgcctacatgaagagcagcagattcctgcccagacccgtgttcagcaagatggccgtgtggggcaacaagtag

SEQ ID NO: 83297 - DNA, 450 bp, Artificial Sequence
  Description of Artificial Sequence: Synthetic coding sequence
atgcccatgatcctgggctactgggacatcagaggcctggcccacgccatcagactgctgctggagtacaccgacagcagctacgaggagaagaagtacaccatgggcgacgcccccgactacgacagaagccagtggctgaacgagaagttcaagctgggcctggacttccccaacctgccctacctgatcgacggcgcccacaagatcacccagagcaacgccatcctgtgctacatcgccagaaagcacaacctgtgcggcgagaccgaggaggagaagatcagagtggacatcctggagaaccagaccatggacaaccacatgcagctgggcatgatctgctacaaccccgagttcggcctggagaagatcagcgcctacatgaagagcagcagattcctgcccagacccgtgttcagcaagatggccgtgtggggcaacaagtag

SEQ ID NO: 83298 - DNA, 714 bp, Artificial Sequence
  Description of Artificial Sequence: Synthetic coding sequence
atgcccatgatcctgggctactgggacatcagaggcctggcccacgccatcagactgctgctggagtacaccgacagcagctacgaggagaagaagtacaccatgggcgacgcccccgactacgacagaagccagtggctgaacgagaagttcaagctgggcctggacttccccaacggcatgctgggcagcctggtggcccagctgagcttcgccggcttccccagcatccagctgccctacctgatcgacggcgcccacaagatcacccagagcaacgccatcctgtgctacatcgccagaaagcacaacctgtgcggcgagaccgaggaggagaagatcagagtggacatcctggagaaccagaccatggacaaccacatgcagctgggcatgatctgctacaaccccgagttcgagaagctgaagcccaagtacctggaggagctgcccgagaagctgaagctgtacagcgagttcctgggcaagagaccctggttcgccggcaacaagatcaccttcgtggacttcctggtgtacgacgtgctggacctgcacagaatcttcgagcccaagtgcctggacgccttccccaacctgaaggacttcatcagcagattcgagggcctggagaagatcagcgcctacatgaagagcagcagattcctgcccagacccgtgttcagcaagatggccgtgtggggcaacaagtag

SEQ ID NO: 83299 - DNA, 657 bp, Artificial Sequence
  Description of Artificial Sequence: Synthetic coding sequence
atgcccatgaccctgggctactggaacatcagaggcctggcccacagcatcagactgctgctggagtacaccgacagcagctacgaggagaagaagtacaccatgggcgacgcccccgactacgacagaagccagtggctgaacgagaagttcaagctgggcctggacttccccaacctgccctacctgatcgacggcacccacaagatcacccagagcaacgccatcctgagatacatcgccagaaagcacaacctgtgcggcgagagcgagaaggagcagatcagagaggacatcctggagaaccagttcatggacagcagaatgcagctggccaagctgtgctacgaccccgacttcgagaagctgaagcccgagtacctgcaggccctgcccgagatgctgaagctgtacagccagttcctgggcaagcagccctggttcctgggcgacaagatcaccttcgtggacttcatcgcctacgacgtgctggagagaaaccaggtgttcgagcccagctgcctggacgccttccccaacctgaaggacttcatcagcagattcgagggcctggagaagatcagcgcctacatgaagagcagcagattcctgcccagacccgtgttcaccaagatggccgtgtggggcaacaagtag

SEQ ID NO: 83300 - DNA, 540 bp, Artificial Sequence
  Description of Artificial Sequence: Synthetic coding sequence
atgaccctgggctactggaacatcagaggcctggcccacagcatcagactgctgctggagtacaccgacagcagctacgaggagaagaagtacaccatgggcgacgcccccgactacgacagaagccagtggctgaacgagaagttcaagctgggcctggacttccccaacctgccctacctgatcgacggcacccacaagatcacccagagcaacgccatcctgagatacatcgccagaaagcacaacctgtgcggcgagagcgagaaggagcagatcagagaggacatcctggagaaccagttcatggacagcagaatgcagctggccaagctgtgctacgaccccgacttcgagaagctgaagcccgagtacctgcaggccctgcccgagatgctgaagctgtacagccagttcctgggcaagcagccctggttcctgggcgacaagggcctggagaagatcagcgcctacatgaagagcagcagattcctgcccagacccgtgttcaccaagatggccgtgtggggcaacaagtag

SEQ ID NO: 83301 - DNA, 264 bp, Artificial Sequence
  Description of Artificial Sequence: Synthetic coding sequence
atggacagcagaatgcagctggccaagctgtgctacgaccccgacttcgagaagctgaagcccgagtacctgcaggccctgcccgagatgctgaagctgtacagccagttcctgggcaagcagccctggttcctgggcgacaagatcaccttcgtggacttcatcgcctacgacgtgctggagagaaaccaggtgttcgagcccagctgcctggacgccttccccaacctgaaggacttcatcagcagattcgagcacagctag

SEQ ID NO: 83302 - DNA, 576 bp, Artificial Sequence
  Description of Artificial Sequence: Synthetic coding sequence
atgcccatgaccctgggctactggaacatcagaggcctggcccacagcatcagactgctgctggagtacaccgacagcagctacgaggagaagaagtacaccatgggcgacgcccccgactacgacagaagccagtggctgaacgagaagttcaagctgggcctggacttccccaacctgccctacctgatcgacggcacccacaagatcacccagagcaacgccatcctgagatacatcgccagaaagcacaacctgtgcggcgagagcgagaaggagcagatcagagaggacatcctggagaaccagttcatggacagcagaatgcagctggccaagctgtgctacgaccccgacttcgagaagctgaagcccgagtacctgcaggccctgcccgagatgctgaagctgtacagccagttcctgggcaagcagccctggttcctgggcgacaagatcaccttcgtggacttcatcgcctacgacgtgctggagagaaaccaggtgttcgagcccagctgcctggacgccttccccaacctgaaggacttcatcagcagattcgagcacagctag

SEQ ID NO: 83303 - DNA, 576 bp, Artificial Sequence; identical to SEQ ID NO: 83302
  Description of Artificial Sequence: Synthetic coding sequence

SEQ ID NO: 83304 - DNA, 678 bp, Artificial Sequence
  Description of Artificial Sequence: Synthetic coding sequence
atgagctgcgagagcagcatggtgctgggctactgggacatcagaggcctggcccacgccatcagactgctgctggagttcaccgacaccagctacgaggagaagagatacacctgcggcgaggcccccgactacgacagaagccagtggctggacgtgaagttcaagctggacctggacttccccaacctgccctacctgctggacggcaagaacaagatcacccagagcaacgccatcctgagatacatcgccagaaagcacaacatgtgcggcgagaccgaggaggagaagatcagagtggacatcatcgagaaccaggtgatggacttcagaacccagctgatcagactgtgctacagcagcgaccacgagaagctgaagccccagtacctggaggagctgcccggccagctgaagcagttcagcatgttcctgggcaagttcagctggttcgccggcgagaagctgaccttcgtggacttcctgacctacgacatcctggaccagaacagaatcttcgaccccaagtgcctggacgagttccccaacctgaaggccttcatgtgcagattcgaggccctggagaagatcgccgcctacctgcagagcgaccagttctgcaagatgcccatcaacaacaagatggcccagtggggcaacaagcccgtgtgctag

SEQ ID NO: 83305 - DNA, 678 bp, Artificial Sequence; identical to SEQ ID NO: 83304
  Description of Artificial Sequence: Synthetic coding sequence

SEQ ID NO: 83306 - DNA, 678 bp, Artificial Sequence; identical to SEQ ID NO: 83304
  Description of Artificial Sequence: Synthetic coding sequence

SEQ ID NO: 83307 - DNA, 588 bp, Artificial Sequence
  Description of Artificial Sequence: Synthetic coding sequence
atgagcatgaccctgggctactgggacatcagaggcctggcccacgccatcagactgctgctggagtacaccgacagcagctacgaggagaagaagtacaccatgggcgacgcccccgactacgacagaagccagtggctgaacgagaagttcaagctgggcctggacttccccaacctgccctacctgatcgacggcgcccacaagatcacccagagcaacgccatcctgtgctacatcgccagaaagcacaacctgtgcggcgagaccgaggaggagaagatcagagtggacatcctggagaaccaggccatggacgtgagcaaccagctggccagagtgtgctacagccccgacttcgagaagctgaagcccgagtacctggaggagctgcccaccatgatgcagcacttcagccagttcctgggcaagagaccctggttcgtgggcgacaagatcaccttcgtggacttcctggcctacgacgtgctggacctgcacagaatcttcgagcccaactgcctggacgccttccccaacctgaaggacttcatcagcagattcgaggtgagctgcggcatcatgtag

SEQ ID NO: 83308 - DNA, 474 bp, Artificial Sequence
  Description of Artificial Sequence: Synthetic coding sequence
atgagcatgaccctgggctactgggacatcagaggcctggcccacgccatcagactgctgctggagtacaccgacagcagctacgaggagaagaagtacaccatgggcgacgcccccgactacgacagaagccagtggctgaacgagaagttcaagctgggcctggacttccccaacgagaagctgaagcccgagtacctggaggagctgcccaccatgatgcagcacttcagccagttcctgggcaagagaccctggttcgtgggcgacaagatcaccttcgtggacttcctggcctacgacgtgctggacctgcacagaatcttcgagcccaactgcctggacgccttccccaacctgaaggacttcatcagcagattcgagggcctggagaagatcagcgcctacatgaagagcagcagattcctgcccaagcccctgtacaccagagtggccgtgtggggcaacaagtag

SEQ ID NO: 83309 - DNA, 609 bp, Artificial Sequence
  Description of Artificial Sequence: Synthetic coding sequence
atgctgggcagcctgctggcccagctgagcttccccggcttccccagcatccagctgccctacctgatcgacggcgcccacaagatcacccagagcaacgccatcctgtgctacatcgccagaaagcacaacctgtgcggcgagaccgaggaggagaagatcagagtggacatcctggagaaccaggccatggacgtgagcaaccagctggccagagtgtgctacagccccgacttcgagaagctgaagcccgagtacctggaggagctgcccaccatgatgcagcacttcagccagttcctgggcaagagaccctggttcgtgggcgacaagatcaccttcgtggacttcctggcctacgacgtgctggacctgcacagaatcttcgagcccaactgcctggacgccttccccaacctgaaggacttcatcagcagattcgaggtgatgccccccagcagcttcctgttcgacgccccctgcagcgtgaccagcttccagatgctgagccagagctggagctacatcaagaacaacctgcacctgctgagcgccggcttcatgcccggcaccctgcccagcaccctgtacctgagctgcggcatctag

SEQ ID NO: 83310 - DNA, 657 bp, Artificial Sequence
  Description of Artificial Sequence: Synthetic coding sequence
atgagcatgaccctgggctactgggacatcagaggcctggcccacgccatcagactgctgctggagtacaccgacagcagctacgaggagaagaagtacaccatgggcgacgcccccgactacgacagaagccagtggctgaacgagaagttcaagctgggcctggacttccccaacctgccctacctgatcgacggcgcccacaagatcacccagagcaacgccatcctgtgctacatcgccagaaagcacaacctgtgcggcgagaccgaggaggagaagatcagagtggacatcctggagaaccaggccatggacgtgagcaaccagctggccagagtgtgctacagccccgacttcgagaagctgaagcccgagtacctggaggagctgcccaccatgatgcagcacttcagccagttcctgggcaagagaccctggttcgtgggcgacaagatcaccttcgtggacttcctggcctacgacgtgctggacctgcacagaatcttcgagcccaactgcctggacgccttccccaacctgaaggacttcatcagcagattcgagggcctggagaagatcagcgcctacatgaagagcagcagattcctgcccaagcccctgtacaccagagtggccgtgtggggcaacaagtag

SEQ ID NO: 83311 - DNA, 657 bp, Artificial Sequence
  Description of Artificial Sequence: Synthetic coding sequence
atgcccatgaccctgggctactgggacatcagaggcctggcccacgccatcagactgctgctggagtacaccgacagcagctacgtggagaagaagtacaccctgggcgacgcccccgactacgacagaagccagtggctgaacgagaagttcaagctgggcctggacttccccaacctgccctacctgatcgacggcgcccacaagatcacccagagcaacgccatcctgagatacatcgccagaaagcacaacctgtgcggcgagaccgaggaggagaagatcagagtggacatcctggagaaccaggtgatggacaaccacatggagctggtgagactgtgctacgaccccgacttcgagaagctgaagcccaagtacctggaggagctgcccgagaagctgaagctgtacagcgagttcctgggcaagagaccctggttcgccggcgacaagatcaccttcgtggacttcctggcctacgacgtgctggacatgaagagaatcttcgagcccaagtgcctggacgccttcctgaacctgaaggacttcatcagcagattcgagggcctgaagaagatcagcgcctacatgaagagcagccagttcctgagaggcctgctgttcggcaagagcgccacctggaacagcaagtag

SEQ ID NO: 83312 - DNA, 714 bp, Artificial Sequence
  Description of Artificial Sequence: Synthetic coding sequence
atgcccatgaccctgggctactgggacatcagaggcctggcccacgccatcagactgctgctggagtacaccgacagcagctacgtggagaagaagtacaccctgggcgacgcccccgactacgacagaagccagtggctgaacgagaagttcaagctgggcctggacttccccaacggcatgctgggcagcctggtggcccagctgagcttccccggcttccccagcatccagctgccctacctgatcgacggcgcccacaagatcacccagagcaacgccatcctgagatacatcgccagaaagcacaacctgtgcggcgagaccgaggaggagaagatcagagtggacatcctggagaaccaggtgatggacaaccacatggagctggtgagactgtgctacgaccccgacttcgagaagctgaagcccaagtacctggaggagctgcccgagaagctgaagctgtacagcgagttcctgggcaagagaccctggttcgccggcgacaagatcaccttcgtggacttcctggcctacgacgtgctggacatgaagagaatcttcgagcccaagtgcctggacgccttcctgaacctgaaggacttcatcagcagattcgagggcctgaagaagatcagcgcctacatgaagagcagccagttcctgagaggcctgctgttcggcaagagcgccacctggaacagcaagtag

SEQ ID NO: 83313 - DNA, 609 bp, Artificial Sequence
  Description of Artificial Sequence: Synthetic coding sequence
atgctgggcagcctggtggcccagctgagcttccccggcttccccagcatccagctgccctacctgatcgacggcgcccacaagatcacccagagcaacgccatcctgagatacatcgccagaaagcacaacctgtgcggcgagaccgaggaggagaagatcagagtggacatcctggagaaccaggtgatggacaaccacatggagctggtgagactgtgctacgaccccgacttcgagaagctgaagcccaagtacctggaggagctgcccgagaagctgaagctgtacagcgagttcctgggcaagagaccctggttcgccggcgacaagatcaccttcgtggacttcctggcctacgacgtgctggacatgaagagaatcttcgagcccaagtgcctggacgccttcctgaacctgaaggacttcatcagcagattcgaggtgatgccccccagcagcttcctgttcgacgccccctgcagcttcctgagcttccagatgctgagccagagctggagctacaccaagaacaacagctacgtgctgagcaccggcttcatgcccggcatcatgcccagcaccctgtacctgagctgcagaatctag

SEQ ID NO: 83314 - DNA, 627 bp, Artificial Sequence
  Description of Artificial Sequence: Synthetic coding sequence
atgagcggcgagagcgccagaagcctgggcaagggcagcgccccccccggccccgtgcccgagggcagcatcagaatctacagcatgagattctgccccttcgccgagagaaccagactggtgctgaaggccaagggcatcagacacgaggtgatcaacatcaacctgaagaacaagcccgagtggttcttcaagaagaaccccttcggcctggtgcccgtgctggagaacagccagggccagctgatctacgagagcgccatcacctgcgagtacctggacgaggcctaccccggcaagaagctgctgcccgacgacccctacgagaaggcctgccagaagatgatcctggagctgttcagcaaggtgctgaccaacaagaagaccaccttcttcggcggcaacagcatcagcatgatcgactacctgatctggccctggttcgagagactggaggccatgaagctgaacgagtgcgtggaccacacccccaagctgaagctgtggatggccgccatgaaggaggaccccaccgtgagcgccctgctgaccagcgagaaggactggcagggcttcctggagctgtacctgcagaacagccccgaggcctgcgactacggcctgtag

SEQ ID NO: 83315 - DNA, 726 bp, Artificial Sequence
  Description of Artificial Sequence: Synthetic coding sequence
atgagcggcgagagcgccagaagcctgggcaagggcagcgccccccccggccccgtgcccgagggcagcatcagaatctacagcatgagattctgccccttcgccgagagaaccagactggtgctgaaggccaagggcatcagacacgaggtgatcaacatcaacctgaagaacaagcccgagtggttcttcaagaagaaccccttcggcctggtgcccgtgctggagaacagccagggccagctgatctacgagagcgccatcacctgcgagtacctggacgaggcctaccccggcaagaagctgctgcccgacgacccctacgagaaggcctgccagaagatgatcctggagctgttcagcaaggtgcccagcctggtgggcagcttcatcagaagccagaacaaggaggactacgccggcctgaaggaggagttcagaaaggagttcaccaagctggaggaggtgctgaccaacaagaagaccaccttcttcggcggcaacagcatcagcatgatcgactacctgatctggccctggttcgagagactggaggccatgaagctgaacgagtgcgtggaccacacccccaagctgaagctgtggatggccgccatgaaggaggaccccaccgtgagcgccctgctgaccagcgagaaggactggcagggcttcctggagctgtacctgcagaacagccccgaggcctgcgactacggcctgtag

SEQ ID NO: 83316 - DNA, 543 bp, Artificial Sequence
  Description of Artificial Sequence: Synthetic coding sequence
atgagattctgccccttcgccgagagaaccagactggtgctgaaggccaagggcatcagacacgaggtgatcaacatcaacctgaagaacaagcccgagtggttcttcaagaagaaccccttcggcctggtgcccgtgctggagaacagccagggccagctgatctacgagagcgccatcacctgcgagtacctggacgaggcctaccccggcaagaagctgctgcccgacgacccctacgagaaggcctgccagaagatgatcctggagctgttcagcaaggtgctgaccaacaagaagaccaccttcttcggcggcaacagcatcagcatgatcgactacctgatctggccctggttcgagagactggaggccatgaagctgaacgagtgcgtggaccacacccccaagctgaagctgtggatggccgccatgaaggaggaccccaccgtgagcgccctgctgaccagcgagaaggactggcagggcttcctggagctgtacctgcagaacagccccgaggcctgcgactacggcctgtag

SEQ ID NO: 83317 - DNA, 603 bp, Artificial Sequence
  Description of Artificial Sequence: Synthetic coding sequence
atgagattctgccccttcgccgagagaaccagactggtgctgaaggccaagggcatcagacacgaggtgatcaacatcaacctgaagaacaagcccgagtggttcttcaagaagaaccccttcggcctggtgcccgtgctggagaacagccagggccagctgatctacgagagcgccatcacctgcgagtacctggacgaggcctaccccggcaagaagctgctgcccgacgacccctacgagaaggcctgccagaagatgatcctggagctgttcagcaaggtgcccagcctggtgggcagcttcatcagaagccagaacaaggaggactacgccggcctgaaggaggagttcagaaaggagttcaccaagctggaggaggtgctgaccaacaagaagaccaccttcttcggcggcaacagcatcagcatgatcgactacctgatctggccctggttcgagagactggaggccatgaagctgaacgagtgcgtggaccacacccccaagctgaagctgtggatggccgccatgaaggaggaccccaccgtgagcgccctgctgaccagcgagaaggactggcagggcttcctggagctgtag

SEQ ID NO: 83318 - DNA, 642 bp, Artificial Sequence
  Description of Artificial Sequence: Synthetic coding sequence
atgagattctgccccttcgccgagagaaccagactggtgctgaaggccaagggcatcagacacgaggtgatcaacatcaacctgaagaacaagcccgagtggttcttcaagaagaaccccttcggcctggtgcccgtgctggagaacagccagggccagctgatctacgagagcgccatcacctgcgagtacctggacgaggcctaccccggcaagaagctgctgcccgacgacccctacgagaaggcctgccagaagatgatcctggagctgttcagcaaggtgcccagcctggtgggcagcttcatcagaagccagaacaaggaggactacgccggcctgaaggaggagttcagaaaggagttcaccaagctggaggaggtgctgaccaacaagaagaccaccttcttcggcggcaacagcatcagcatgatcgactacctgatctggccctggttcgagagactggaggccatgaagctgaacgagtgcgtggaccacacccccaagctgaagctgtggatggccgccatgaaggaggaccccaccgtgagcgccctgctgaccagcgagaaggactggcagggcttcctggagctgtacctgcagaacagccccgaggcctgcgactacggcctgtag

SEQ ID NO: 83319 - DNA, 732 bp, Artificial Sequence
  Description of Artificial Sequence: Synthetic coding sequence
atgagcggcgacgccaccagaaccctgggcaagggcagccagccccccggccccgtgcccgagggcctgatcagaatctacagcatgagattctgcccctacagccacagaaccagactggtgctgaaggccaaggacatcagacacgaggtggtgaacatcaacctgagaaacaagcccgagtggtactacaccaagcaccccttcggccacatccccgtgctggagaccagccagtgccagctgatctacgagagcgtgatcgcctgcgagtacctggacgacgcctaccccggcagaaagctgttcccctacgacccctacgagagagccagacagaagatgctgctggagctgttctgcaaggtgccccacctgaccaaggagtgcctggtggccctgagatgcggcagagagtgcaccaacctgaaggccgccctgagacaggagttcagcaacctggaggagatcctggagtaccagaacaccaccttcttcggcggcacctgcatcagcatgatcgactacctgctgtggccctggttcgagagactggacgtgtacggcatcctggactgcgtgagccacacccccgccctgagactgtggatcagcgccatgaagtgggaccccaccgtgtgcgccctgctgatggacaagagcatcttccagggcttcctgaacctgtacttccagaacaaccccaacgccttcgacttcggcctgtgctag

SEQ ID NO: 83320 - DNA, 648 bp, Artificial Sequence
  Description of Artificial Sequence: Synthetic coding sequence
atgagattctgcccctacagccacagaaccagactggtgctgaaggccaaggacatcagacacgaggtggtgaacatcaacctgagaaacaagcccgagtggtactacaccaagcaccccttcggccacatccccgtgctggagaccagccagtgccagctgatctacgagagcgtgatcgcctgcgagtacctggacgacgcctaccccggcagaaagctgttcccctacgacccctacgagagagccagacagaagatgctgctggagctgttctgcaaggtgccccacctgaccaaggagtgcctggtggccctgagatgcggcagagagtgcaccaacctgaaggccgccctgagacaggagttcagcaacctggaggagatcctggagtaccagaacaccaccttcttcggcggcacctgcatcagcatgatcgactacctgctgtggccctggttcgagagactggacgtgtacggcatcctggactgcgtgagccacacccccgccctgagactgtggatcagcgccatgaagtgggaccccaccgtgtgcgccctgctgatggacaagagcatcttccagggcttcctgaacctgtacttccagaacaaccccaacgccttcgacttcggcctgtgctag

SEQ ID NO: 83321 - DNA, 732 bp, Artificial Sequence; identical to SEQ ID NO: 83319
  Description of Artificial Sequence: Synthetic coding sequence

SEQ ID NO: 83322 - DNA, 501 bp, Artificial Sequence
  Description of Artificial Sequence: Synthetic coding sequence
atgagcggcgacgccaccagaaccctgggcaagggcagccagccccccggccccgtgcccgagggcctgatcagaatctacagcatgagattctgcccctacagccacagaaccagactggtgctgaaggccaaggacatcagacacgaggtggtgaacatcaacctgagaaacaagcccgagtggtactacaccaagcaccccttcggccacatccccgtgctggagaccagccagtgccagctgatctacgagagcgtgatcgcctgcgagtacctggacgacgcctaccccggcagaaagctgttcccctacgacccctacgagagagccagacagaagatgctgctggagctgttctgcaaggtgccccacctgaccaaggagtgcctggtggccctgagatgcggcagagagtgcaccaacctgaaggccgccctgagacaggagttcagcaacctggaggaggacagaaagaagagaaagttcatccccggctag

SEQ ID NO: 83323 - DNA, 366 bp, Artificial Sequence
  Description of Artificial Sequence: Synthetic coding sequence
atgagattctgcccctacagccacagaaccagactggtgctgaaggccaaggacatcagacacgaggtggtgaacatcaacctgagaaacaagcccgagtggtactacaccaagcaccccttcggccacatccccgtgctggagaccagccagtgccagctgatctacgagagcgtgatcgcctgcgagtacctggacgacgcctaccccggcagaaagctgttcccctacgacccctacgagagagccagacagaagatgctgctggagctgttctgcaagctgtgcgagccccacgccagccccgccgccctggacatcagccacgaggtgggcccccacagcctgtgcagcagccacggctag

SEQ ID NO: 83324 - DNA, 630 bp, Artificial Sequence
  Description of Artificial Sequence: Synthetic coding sequence
atgagcggcgacgccaccagaaccctgggcaagggcagccagccccccggccccgtgcccgagggcctgatcagaatctacagcatgagattctgcccctacagccacagaaccagactggtgctgaaggccaaggacatcagacacgaggtggtgaacatcaacctgagaaacaagcccgagtggtactacaccaagcaccccttcggccacatccccgtgctggagaccagccagtgccagctgatctacgagagcgtgatcgcctgcgagtacctggacgacgcctaccccggcagaaagctgttcccctacgacccctacgagagagccagacagaagatgctgctggagctgttctgcaagatcctggagtaccagaacaccaccttcttcggcggcacctgcatcagcatgatcgactacctgctgtggccctggttcgagagactggacgtgtacggcatcctggactgcgtgagccacacccccgccctgagactgtggatcagcgccatgaagtgggaccccaccgtgtgcgccctgctgatggacaagagcatcttccagggcttcctgaacctgtacttccagaacaaccccaacgccttcgacttcggcctgtgctag

SEQ ID NO: 83325 - DNA, 723 bp, Artificial Sequence
  Description of Artificial Sequence: Synthetic coding sequence
atgggcctggagctgtacctggacctgctgagccagccctgcagagccgtgtacatcttcgccaagaagaacgacatccccttcgagctgagaatcgtggacctgatcaagggccagcacctgagcgacgccttcgcccaggtgaaccccctgaagaaggtgcccgccctgaaggacggcgacttcaccctgaccgagagcgtggccatcctgctgtacctgaccagaaagtacaaggtgcccgactactggtacccccaggacctgcaggccagagccagagtggacgagtacctggcctggcagcacaccaccctgagaagaagctgcctgagagccctgtggcacaaggtgatgttccccgtgttcctgggcgagcccgtgagcccccagaccctggccgccaccctggccgagctggacgtgaccctgcagctgctggaggacaagttcctgcagaacaaggccttcctgaccggcccccacatcagcctggccgacctggtggccatcaccgagctgatgcaccccgtgggcgccggctgccaggtgttcgagggcagacccaagctggccacctggagacagagagtggaggccgccgtgggcgaggacctgttccaggaggcccacgaggtgatcctgaaggccaaggacttcccccccgccgaccccaccatcaagcagaagctgatgccctgggtgctggccatgatcagatag

SEQ ID NO: 83326 - DNA, 486 bp, Artificial Sequence
  Description of Artificial Sequence: Synthetic coding sequence
atgggcctggagctgtacctggacctgctgagccagccctgcagagccgtgtacatcttcgccaagaagaacgacatccccttcgagctgagaatcgtggacctgatcaagggcgtgatgttccccgtgttcctgggcgagcccgtgagcccccagaccctggccgccaccctggccgagctggacgtgaccctgcagctgctggaggacaagttcctgcagaacaaggccttcctgaccggcccccacatcagcctggccgacctggtggccatcaccgagctgatgcaccccgtgggcgccggctgccaggtgttcgagggcagacccaagctggccacctggagacagagagtggaggccgccgtgggcgaggacctgttccaggaggcccacgaggtgatcctgaaggccaaggacttcccccccgccgaccccaccatcaagcagaagctgatgccctgggtgctggccatgatcagatag

SEQ ID NO: 83327 - DNA, 369 bp, Artificial Sequence
  Description of Artificial Sequence: Synthetic coding sequence
atgttccccgtgttcctgggcgagcccgtgagcccccagaccctggccgccaccctggccgagctggacgtgaccctgcagctgctggaggacaagttcctgcagaacaaggccttcctgaccggcccccacatcagcctggccgacctggtggccatcaccgagctgatgcaccccgtgggcgccggctgccaggtgttcgagggcagacccaagctggccacctggagacagagagtggaggccgccgtgggcgaggacctgttccaggaggcccacgaggtgatcctgaaggccaaggacttcccccccgccgaccccaccatcaagcagaagctgatgccctgggtgctggccatgatcagatag

SEQ ID NO: 83328 - DNA, 198 bp, Artificial Sequence
  Description of Artificial Sequence: Synthetic coding sequence
atgggcctggagctgtacctggacctgctgagccagccctgcagagccgtgtacatcttcgccaagaagaacgacatccccttcgagctgagaatcgtggacctgatcaagggccagcacctgagcgacgccttcgcccaggtgaaccccctgaagaaggtgcccgccctgaaggacggcgacttcaccctgacctag

SEQ ID NO: 83329 - DNA, 219 bp, Artificial Sequence
  Description of Artificial Sequence: Synthetic coding sequence
atgggcctggagctgtacctggacctgctgagccagccctgcagagccgtgtacatcttcgccaagaagaacgacatccccttcgagctgagaatcgtggacctgatcaaggccagaggctgctggctgcccagcctgagaagacccacccaggccggccacatggccgccgccagaggcggcagcagcggcggcggccccctgcccggcggcccctag

SEQ ID NO: 83330 - DNA, 405 bp, Artificial Sequence
  Description of Artificial Sequence: Synthetic coding sequence
atgcccttcctggagctggacaccaacctgcccgccaacagagtgcccgccggcctggagaagagactgtgcgccgccgccgccagcatcctgggcaagcccgccgacagagtgaacgtgaccgtgagacccggcctggccatggccctgagcggcagcaccgagccctgcgcccagctgagcatcagcagcatcggcgtggtgggcaccgccgaggacaacagaagccacagcgcccacttcttcgagttcctgaccaaggagctggccctgggccaggacagattccccaccgtgctgagcaccagccccgccgcccacggcggccccagatgccccggcgagatcatcgagggcaagaagagctgcctgaacgaggaggccctgttcatctacttcatctag

SEQ ID NO: 83331 - DNA, 831 bp, Artificial Sequence
  Description of Artificial Sequence: Synthetic coding sequence
atgcccgtgcccgccagctggccccacccccccggccccttcctgctgctgaccctgctgctgggcctgaccgaggtggccggcgaggaggagctgcagatgatccagcccgagaagctgctgctggtgaccgtgggcaagaccgccaccctgcactgcaccgtgaccagcctgctgcccgtgggccccgtgctgtggttcagaggcgtgggccccggcagagagctgatctacaaccagaaggagggccacttccccagagtgaccaccgtgagcgacctgaccaagagaaacaacatggacttcagcatcagaatcagcagcatcacccccgccgacgtgggcacctactactgcgtgaagttcagaaagggcagccccgagaacgtggagttcaagagcggccccggcaccgagatggccctgggcgccaagcccagcgcccccgtggtgctgggccccgccgccagaaccacccccgagcacaccgtgagcttcacctgcgagagccacggcttcagccccagagacatcaccctgaagtggttcaagaacggcaacgagctgagcgacttccagaccaacgtggaccccaccggccagagcgtggcctacagcatcagaagcaccgccagagtggtgctggacccctgggacgtgagaagccaggtgatctgcgaggtggcccacgtgaccctgcagggcgaccccctgagaggcaccgccaacctgagcgaggccatcagaggccccgccagcagcctgaccgccctgctgctgatcgccgtgctgctgggccccatctacgtgccctggaagcagaagacctag

SEQ ID NO: 83332 - DNA, 1092 bp, Artificial Sequence
  Description of Artificial Sequence: Synthetic coding sequence
atggccaccaactggggcagcctgctgcaggacaagcagcagctggaggagctggccagacaggccgtggacagagccctggccgagggcgtgctgctgagaaccagccaggagcccaccagcagcgaggtggtgagctacgcccccttcaccctgttccccagcctggtgcccagcgccctgctggagcaggcctacgccgtgcagatggacttcaacctgctggtggacgccgtgagccagaacgccgccttcctggagcagaccctgagcagcgccctggtgctgctgatcgcccaggagaaggagagaaacatcttcgaccagagagccatcgagaacgagctgctggccagaaacatccacgtgatcagaagaaccttcgaggacatcagcgagaagggcagcctggaccaggacagaagactgttcgtggacggccaggagatcgccgtggtgtacttcagagacggctacatgcccagacagtacagcctgcagaactgggaggccagactgctgctggagagaagccacgccgccaagtgccccgacatcgccacccagctggccggcaccaagaaggtgcagcaggagctgagcagacccggcatgctggagatgctgctgcccggccagcccgaggccgtggccagactgagagccaccttcgccggcctgtacagcctggacgtgggcgaggagggcgaccaggccatcgccgaggccctggccgcccccagcagattcgtgctgaagccccagagagagggcggcggcaacaacctgtacggcgaggagatggtgcaggccctgaagcagctgaaggacagcgaggagagagccagctacatcctgatggagaagatcgagcccgagcccttcgagaactgcctgctgagacccggcagccccgccagagtggtgcagtgcatcagcgagctgggcatcttcggcgtgtacgtgagacaggagaagaccctggtgatgaacaagcacgtgggccacctgctgagaaccaaggccatcgagcacgccgacggcggcgtggccgccggcgtggccgtgctggacaacccctaccccgtgtag

SEQ ID NO: 83333 - DNA, 1041 bp, Artificial Sequence
  Description of Artificial Sequence: Synthetic coding sequence
atgttccagagaagcgccgacggcagccccgccctgaagcagatcgagatcaacaccatcagcgccagcttcggcggcctggccagcagaacccccgccgtgcacagacacgtgctgagcgtgctgagcaagaccaaggaggccggcaagatcctgagcaacaaccccagcaagggcctggccctgggcatcgccaaggcctgggagctgtacggcagccccaacgccctggtgctgctgatcgcccaggagaaggagagaaacatcttcgaccagagagccatcgagaacgagctgctggccagaaacatccacgtgatcagaagaaccttcgaggacatcagcgagaagggcagcctggaccaggacagaagactgttcgtggacggccaggagatcgccgtggtgtacttcagagacggctacatgcccagacagtacagcctgcagaactgggaggccagactgctgctggagagaagccacgccgccaagtgccccgacatcgccacccagctggccggcaccaagaaggtgcagcaggagctgagcagacccggcatgctggagatgctgctgcccggccagcccgaggccgtggccagactgagagccaccttcgccggcctgtacagcctggacgtgggcgaggagggcgaccaggccatcgccgaggccctggccgcccccagcagattcgtgctgaagccccagagagagggcggcggcaacaacctgtacggcgaggagatggtgcaggccctgaagcagctgaaggacagcgaggagagagccagctacatcctgatggagaagatcgagcccgagcccttcgagaactgcctgctgagacccggcagccccgccagagtggtgcagtgcatcagcgagctgggcatcttcggcgtgtacgtgagacaggagaagaccctggtgatgaacaagcacgtgggccacctgctgagaaccaaggccatcgagcacgccgacggcggcgtggccgccggcgtggccgtgctggacaacccctaccccgtgtag

SEQ ID NO: 83334 - DNA, 768 bp, Artificial Sequence
  Description of Artificial Sequence: Synthetic coding sequence
atgagcagcatcggcaccggctacgacctgagcgccagcaccttcagccccgacggcagagtgttccaggtggagtacgccatgaaggccgtggagaacagcagcaccgccatcggcatcagatgcaaggacggcgtggtgttcggcgtggagaagctggtgctgagcaagctgtacgaggagggcagcaacaagagactgttcaacgtggacagacacgtgggcatggccgtggccggcctgctggccgacgccagaagcctggccgacatcgccagagaggaggccagcaacttcagaagcaacttcggctacaacatccccctgaagcacctggccgacagagtggccatgtacgtgcacgcctacaccctgtacagcgccgtgagacccttcggctgcagcttcatgctgggcagctacagcgtgaacgacggcgcccagctgtacatgatcgaccccagcggcgtgagctacggctactggggctgcgccatcggcaaggccagacaggccgccaagaccgagatcgagaagctgcagatgaaggagatgacctgcagagacatcgtgaaggaggtggccaagatcatctacatcgtgcacgacgaggtgaaggacaaggccttcgagctggagctgagctgggtgggcgagctgaccaacggcagacacgagatcgtgcccaaggacatcagagaggaggccgagaagtacgccaaggagagcctgaaggaggaggacgagagcgacgacgacaacatgtag

SEQ ID NO: 83335 - DNA, 525 bp, Artificial Sequence
  Description of Artificial Sequence: Synthetic coding sequence
atgcaggccggcaagcccatcctgtacagctacttcagaagcagctgcagctggagagtgagaatcgccctggccctgaagggcatcgactacgagaccgtgcccatcaacctgatcaaggacggcggccagcagttcagcaaggacttccaggccctgaaccccatgaagcaggtgcccaccctgaagatcgacggcatcaccatccaccagagcaacctgagcgtgctgaagcaggtgggcgaggagatgcagctgacctgggcccagaacgccatcacctgcggcttcaacgccctggagcagatcctgcagagcaccgccggcatctactgcgtgggcgacgaggtgaccatggccgacctgtgcctggtgccccaggtggccaacgccgagagattcaaggtggacctgaccccctaccccaccatcagcagcatcaacaagagactgctggtgctggaggccttccaggtgagccacccctgcagacagcccgacacccccaccgagctgagagcctag

SEQ ID NO: 83336 - DNA, 486 bp, Artificial Sequence
  Description of Artificial Sequence: Synthetic coding sequence
atgaagcaggtgcccaccctgaagatcgacggcatcaccatccaccagagcctggccatcatcgagtacctggaggagatgagacccacccccagactgctgccccaggaccccaagaagagagccagcgtgagaatgatcagcgacctgatcgccggcggcatccagcccctgcagaacctgagcgtgctgaagcaggtgggcgaggagatgcagctgacctgggcccagaacgccatcacctgcggcttcaacgccctggagcagatcctgcagagcaccgccggcatctactgcgtgggcgacgaggtgaccatggccgacctgtgcctggtgccccaggtggccaacgccgagagattcaaggtggacctgaccccctaccccaccatcagcagcatcaacaagagactgctggtgctggaggccttccaggtgagccacccctgcagacagcccgacacccccaccgagctgagagcctag

SEQ ID NO: 83337 - DNA, 486 bp, Artificial Sequence; identical to SEQ ID NO: 83336
  Description of Artificial Sequence: Synthetic coding sequence

SEQ ID NO: 83338 - DNA, 180 bp, Artificial Sequence
  Description of Artificial Sequence: Synthetic coding sequence
atgaagcaggtgcccaccctgaagatcgacggcatcaccatccaccagagcctggccatcatcgagtacctggaggagatgagacccacccccagactgctgccccaggaccccaagaagagagccagcgtgagaatgatcagcgacctgatcgccggcggcatccagcccctgcagtag

SEQ ID NO: 83339 - DNA, 117 bp, Artificial Sequence
  Description of Artificial Sequence: Synthetic coding sequence
atgaagcaggtgcccaccctgaagatcgacggcatcaccatccaccagagcctggccatcatcgagtacctggaggagatgagacccacccccagactgctgccccaggacccctag

SEQ ID NO: 83340 - DNA, 486 bp, Artificial Sequence; identical to SEQ ID NO: 83336
  Description of Artificial Sequence: Synthetic coding sequence

SEQ ID NO: 83341 - DNA, 387 bp, Artificial Sequence
  Description of Artificial Sequence: Synthetic coding sequence
atggccggcaacctgctgagcggcgccggcagaagactgtgggactgggtgcccctggcctgcagaagcttcagcctgggcgtgcccagactgatcggcatcagactgaccctgcccccccccaaggtggtggacagatggaacgagaagagagccatgttcggcgtgtacgacaacatcggcatcctgggcaacttcgagaagcaccccaaggagctgatcagaggccccatctggctgagaggctggaagggcaacgagctgcagagatgcatcagaaagagaaagatggtgggcagcagaatgttcgccgacgacctgcacaacctgaacaagagaatcagatacctgtacaagcacttcaacagacacggcaagttcagatag

SEQ ID NO: 83342 - DNA, 783 bp, Artificial Sequence
  Description of Artificial Sequence: Synthetic coding sequence
atggaggagatgagagaccccagcaagatcaagtggggcgacgccggcgccgagtacgtggtggagagcaccggcgtgttcaccaccatggagaaggccggcgcccacctgcagggcggcgccaagagagtgatcatcagcgcccccagcgccgacgcccccatgttcgtgatgggcgtgaaccacgagaagtacgacaacagcctgaagatcatcagcaacgccagctgcaccaccaactgcctggcccccctggccaaggtgatccacgacaacttcggcatcgtggagggcctgatgaccaccgtgcacgccatcaccgccacccagaagaccgtggacggccccagcggcaagctgtggagagacggcagaggcgccctgcagaacatcatccccgccagcaccggcgccgccaaggccgtgggcaaggtgatccccgagctgaacggcaagctgaccggcatggccttcagagtgcccaccgccaacgtgagcgtggtggacctgacctgcagactggagaagcccgccaagtacgacgacatcaagaaggtggtgaagcaggccagcgagggccccctgaagggcatcctgggctacaccgagcaccaggtggtgagcagcgacttcaacagcgacacccacagcagcaccttcgacgccggcgccggcatcgccctgaacgaccacttcgtgaagctgatcagctggtacgacaacgagttcggctacagcaacagagtggtggacctgatggcccacatggccagcaaggagtag

SEQ ID NO: 83343 - DNA, 882 bp, Artificial Sequence
  Description of Artificial Sequence: Synthetic coding sequence
atggtgtacatgttccagtacgacagcacccacggcaagttccacggcaccgtgaaggccgagaacggcaagctggtgatcaacggcaaccccatcaccatcttccaggagagagaccccagcaagatcaagtggggcgacgccggcgccgagtacgtggtggagagcaccggcgtgttcaccaccatggagaaggccggcgcccacctgcagggcggcgccaagagagtgatcatcagcgcccccagcgccgacgcccccatgttcgtgatgggcgtgaaccacgagaagtacgacaacagcctgaagatcatcagcaacgccagctgcaccaccaactgcctggcccccctggccaaggtgatccacgacaacttcggcatcgtggagggcctgatgaccaccgtgcacgccatcaccgccacccagaagaccgtggacggccccagcggcaagctgtggagagacggcagaggcgccctgcagaacatcatccccgccagcaccggcgccgccaaggccgtgggcaaggtgatccccgagctgaacggcaagctgaccggcatggccttcagagtgcccaccgccaacgtgagcgtggtggacctgacctgcagactggagaagcccgccaagtacgacgacatcaagaaggtggtgaagcaggccagcgagggccccctgaagggcatcctgggctacaccgagcaccaggtggtgagcagcgacttcaacagcgacacccacagcagcaccttcgacgccggcgccggcatcgccctgaacgaccacttcgtgaagctgatcagctggtacgacaacgagttcggctacagcaacagagtggtggacctgatggcccacatggccagcaaggagtag

SEQ ID NO: 83344 - DNA, 1008 bp, Artificial Sequence
  Description of Artificial Sequence: Synthetic coding sequence
atgggcaaggtgaaggtgggcgtgaacggcttcggcagaatcggcagactggtgaccagagccgccttcaacagcggcaaggtggacatcgtggccatcaacgaccccttcatcgacctgaactacatggtgtacatgttccagtacgacagcacccacggcaagttccacggcaccgtgaaggccgagaacggcaagctggtgatcaacggcaaccccatcaccatcttccaggagagagaccccagcaagatcaagtggggcgacgccggcgccgagtacgtggtggagagcaccggcgtgttcaccaccatggagaaggccggcgcccacctgcagggcggcgccaagagagtgatcatcagcgcccccagcgccgacgcccccatgttcgtgatgggcgtgaaccacgagaagtacgacaacagcctgaagatcatcagcaacgccagctgcaccaccaactgcctggcccccctggccaaggtgatccacgacaacttcggcatcgtggagggcctgatgaccaccgtgcacgccatcaccgccacccagaagaccgtggacggccccagcggcaagctgtggagagacggcagaggcgccctgcagaacatcatccccgccagcaccggcgccgccaaggccgtgggcaaggtgatccccgagctgaacggcaagctgaccggcatggccttcagagtgcccaccgccaacgtgagcgtggtggacctgacctgcagactggagaagcccgccaagtacgacgacatcaagaaggtggtgaagcaggccagcgagggccccctgaagggcatcctgggctacaccgagcaccaggtggtgagcagcgacttcaacagcgacacccacagcagcaccttcgacgccggcgccggcatcgccctgaacgaccacttcgtgaagctgatcagctggtacgacaacgagttcggctacagcaacagagtggtggacctgatggcccacatggccagcaaggagtag

SEQ ID NO: 83345 - DNA, 1008 bp, Artificial Sequence; identical to SEQ ID NO: 83344
  Description of Artificial Sequence: Synthetic coding sequence

SEQ ID NO: 83346 - DNA, 648 bp, Artificial Sequence
  Description of Artificial Sequence: Synthetic coding sequence
atgggcaaggtgaaggtgggcgtgaacggcttcggcagaatcggcagactggtgaccagagccgccttcaacagcggcaaggtggacatcgtggccatcaacgaccccttcatcgacctgaactacatggtgtacatgttccagtacgacagcacccacggcaagttccacggcaccgtgaaggccgagaacggcaagctggtgatcaacggcaaccccatcaccatcttccaggagagagaccccagcaagatcaagtggggcgacgccggcgccgagtacgtggtggagagcaccggcgtgttcaccaccatggagaaggccggcgcccacctgcagggcggcgccaagagagtgatcatcagcgcccccagcgccgacgcccccatgttcgtgatgggcgtgaaccacgagaagtacgacaacagcctgaagatcatcagcaacgccagctgcaccaccaactgcctggcccccctggccaaggtgatccacgacaacttcggcatcgtggagggcctgatgaccaccgtgcacgccatcaccgccacccagagagaggcccactggcacggcctgccctgcccccactgccagagagtgagcggcggccccgacctgcccagcagaaagacctgccagatctag

SEQ ID NO: 83347 - DNA, 675 bp, Artificial Sequence
  Description of Artificial Sequence: Synthetic coding sequence
atgaccctgttccacttcggcaactgcttcgccctggcctacttcccctacttcatcacctacaagtgcagcggcctgagcgagtacaacgccttctggaagtgcgtgcaggccggcgtgacctacctgttcgtgcagctgtgcaagatgctgttcctggccaccttcttccccacctgggagggcggcatctacgacttcatcggcgagttcatgaaggccagcgtggacgtggccgacctgatcggcctgaacctggtgatgagcagaaacgccggcaagggcgagtacaagatcatggtggccgccctgggctgggccaccgccgagctgatcatgagcagatgcatccccctgtgggtgggcgccagaggcatcgagttcgactggaagtacatccagatgagcatcgacagcaacatcagcctggtgcactacatcgtggccagcgcccaggtgtggatgatcaccagatacgacctgtaccacaccttcagacccgccgtgctgctgctgatgttcctgagcgtgtacaaggccttcgtgatggagaccttcgtgcacctgtgcagcctgggcagctgggccgccctgctggccagagccgtggtgaccggcctgctggccctgagcaccctggccctgtacgtggccgtggtgaacgtgcacagctag

SEQ ID NO: 83348 - DNA, 1104 bp, Artificial Sequence
  Description of Artificial Sequence: Synthetic coding sequence
atggccgccgccctgcaggtgctgcccagactggccagagcccccctgcaccccctgctgtggagaggcagcgtggccagactggccagcagcatggccctggccgagcaggccagacagctgttcgagagcgccgtgggcgccgtgctgcccggccccatgctgcacagagccctgagcctggaccccggcggcagacagctgaaggtgagagacagaaacttccagctgagacagaacctgtacctggtgggcttcggcaaggccgtgctgggcatggccgccgccgccgaggagctgctgggccagcacctggtgcagggcgtgatcagcgtgcccaagggcatcagagccgccatggagagagccggcaagcaggagatgctgctgaagccccacagcagagtgcaggtgttcgagggcgccgaggacaacctgcccgacagagacgccctgagagccgccctggccatccagcagctggccgagggcctgaccgccgacgacctgctgctggtgctgatcagcggcggcggcagcgccctgctgcccgcccccatcccccccgtgaccctggaggagaagcagaccctgaccagactgctggccgccagaggcgccaccatccaggagctgaacaccatcagaaaggccctgagccagctgaagggcggcggcctggcccaggccgcctaccccgcccaggtggtgagcctgatcctgagcgacgtggtgggcgaccccgtggaggtgatcgccagcggccccaccgtggccagcagccacaacgtgcaggactgcctgcacatcctgaacagatacggcctgagagccgccctgcccagaagcgtgaagaccgtgctgagcagagccgacagcgacccccacggcccccacacctgcggccacgtgctgaacgtgatcatcggcagcaacgtgctggccctggccgaggcccagagacaggccgaggccctgggctaccaggccgtggtgctgagcgccgccatgcagggctggggcacccccgccgcccacagagacgacagataccagtgccacggccacccccccctggtgcccgccgccagcgtgatggcctag

SEQ ID NO: 83349 - DNA, 705 bp, Artificial Sequence
  Description of Artificial Sequence: Synthetic coding sequence
atggccgccgccctgcaggtgctgcccagactggccagagcccccctgcaccccctgctgtggagaggcagcgtggccagactggccagcagcatggccctggccgagcaggccagacagctgttcgagagcgccgtgggcgccgtgctgcccggccccatgctgcacagagccctgagcctggaccccggcggcagacagctgaaggtgagagacagaaacttccagctgagacagaacctgtacctggtgggcttcggcaaggccgtgctgggcatggccgccgccgccgaggagctgctgggccagcacctggtgcagggcgtgatcagcgtgcccaagggcatcagagccgccatggagagagccggcaagcaggagatgctgctgaagccccacagcagagtgcaggtgttcgagggcgccgaggacaacctgcccgacagagacgccctgagagccgccctggccatccagcagctggccgagggcctgaccgccgacgacctgctgctggtgctgatcagcggcggcgagccccaccccgtgagatgcggcggcggcccctgcggcggcgactgccagtggccccacagaggccagttcccccagtgcgccagactgcccgcctacccccagagcctgagacccccctgcagccccgccaccttctgcgaggactgcgccgtgagcggcagactgtag

SEQ ID NO: 83350 - DNA, 1374 bp, Artificial Sequence
  Description of Artificial Sequence: Synthetic coding sequence
atggccgccgccctgcaggtgctgcccagactggccagagcccccctgcaccccctgctgtggagaggcagcgtggccagactggccagcagcatggccctggccgagcaggccagacagctgttcgagagcgccgtgggcgccgtgctgcccggccccatgctgcacagagccctgagcctggaccccggcggcagacagctgaaggtgagagacagaaacttccagctgagacagaacctgtacctggtgggcttcggcaaggccgtgctgggcatggccgccgccgccgaggagctgctgggccagcacctggtgcagggcgtgatcagcgtgcccaagggcatcagagccgcccccatcccccccgtgaccctggaggagaagcagaccctgaccagactgctggccgccagaggcgccaccatccaggagctgaacaccatcagaaaggccctgagccagctgaagggcggcggcctggcccaggccgcctaccccgcccaggtggtgagcctgatcctgagcgacgtggtgggcgaccccgtggaggtgatcgccagcggccccaccgtggccagcagccacaacgtgcaggactgcctgcacatcctgaacagatacggcctgagagccgccctgcccagaagcgtgaagaccgtgctgagcagagccgacagcgacccccacggcccccacacctgcggccacgtgctgaacgtgatcatcggcagcaacgtgctggccctggccgaggcccagagacaggccgaggccctgggctaccaggccgtggtgctgagcgccgccatgcagggcgacgtgaagagcatggcccagttctacggcctgctggcccacgtggccagaaccagactgacccccagcatggccggcgccagcgtggaggaggacgcccagctgcacgagctggccgccgagctgcagatccccgacctgcagctggaggaggccctggagaccatggcctggggcagaggccccgtgtgcctgctggccggcggcgagcccaccgtgcagctgcagggcagcggcagaggcggcagaaaccaggagctggccctgagagtgggcgccgagctgagaagatggcccctgggccccatcgacgtgctgttcctgagcggcggcaccgacggccaggacggccccaccgaggccgccggcgcctgggtgacccccgagctggccagccaggccgccgccgagggcctggacatcgccaccttcctggcccacaacgacagccacaccttcttctgctgcctgcagggcggcgcccacctgctgcacaccggcatgaccggcaccaacgtgatggacacccacctgctgttcctgagacccagatag

SEQ ID NO: 83351 - DNA, 1572 bp, Artificial Sequence
  Description of Artificial Sequence: Synthetic coding sequence
atggccgccgccctgcaggtgctgcccagactggccagagcccccctgcaccccctgctgtggagaggcagcgtggccagactggccagcagcatggccctggccgagcaggccagacagctgttcgagagcgccgtgggcgccgtgctgcccggccccatgctgcacagagccctgagcctggaccccggcggcagacagctgaaggtgagagacagaaacttccagctgagacagaacctgtacctggtgggcttcggcaaggccgtgctgggcatggccgccgccgccgaggagctgctgggccagcacctggtgcagggcgtgatcagcgtgcccaagggcatcagagccgccatggagagagccggcaagcaggagatgctgctgaagccccacagcagagtgcaggtgttcgagggcgccgaggacaacctgcccgacagagacgccctgagagccgccctggccatccagcagctggccgagggcctgaccgccgacgacctgctgctggtgctgatcagcggcggcggcagcgccctgctgcccgcccccatcccccccgtgaccctggaggagaagcagaccctgaccagactgctggccgccagaggcgccaccatccaggagctgaacaccatcagaaaggccctgagccagctgaagggcggcggcctggcccaggccgcctaccccgcccaggtggtgagcctgatcctgagcgacgtggtgggcgaccccgtggaggtgatcgccagcggccccaccgtggccagcagccacaacgtgcaggactgcctgcacatcctgaacagatacggcctgagagccgccctgcccagaagcgtgaagaccgtgctgagcagagccgacagcgacccccacggcccccacacctgcggccacgtgctgaacgtgatcatcggcagcaacgtgctggccctggccgaggcccagagacaggccgaggccctgggctaccaggccgtggtgctgagcgccgccatgcagggcgacgtgaagagcatggcccagttctacggcctgctggcccacgtggccagaaccagactgacccccagcatggccggcgccagcgtggaggaggacgcccagctgcacgagctggccgccgagctgcagatccccgacctgcagctggaggaggccctggagaccatggcctggggcagaggccccgtgtgcctgctggccggcggcgagcccaccgtgcagctgcagggcagcggcagaggcggcagaaaccaggagctggccctgagagtgggcgccgagctgagaagatggcccctgggccccatcgacgtgctgttcctgagcggcggcaccgacggccaggacggccccaccgaggccgccggcgcctgggtgacccccgagctggccagccaggccgccgccgagggcctggacatcgccaccttcctggcccacaacgacagccacaccttcttctgctgcctgcagggcggcgcccacctgctgcacaccggcatgaccggcaccaacgtgatggacacccacctgctgttcctgagacccagatag

SEQ ID NO: 83352 - DNA, 852 bp, Artificial Sequence
  Description of Artificial Sequence: Synthetic coding sequence
atggagctgctgctgagccagagctgcatctggtggcccatggtgggcgagggcagaaccatcatcagctgcggcatcaaggccatggagagaagcggcaactacctgatctggctgcagaagggcgagatgctgctgaagccccacagcagagtgcaggtgttcgagggcgccgaggacaacctgcccgacagagacgccctgagagccgccctggccatccagcagctggccgagggcctgaccgccgacgacctgctgctggtgctgatcagcggcggcggcagcgccctgctgcccgcccccatcccccccgtgaccctggaggagaagcagaccctgaccagactgctggccgccagaggcgccaccatccaggagctgaacaccatcagaaaggccctgagccagctgaagggcggcggcctggcccaggccgcctaccccgcccaggtggtgagcctgatcctgagcgacgtggtgggcgaccccgtggaggtgatcgccagcggccccaccgtggccagcagccacaacgtgcaggactgcctgcacatcctgaacagatacggcctgagagccgccctgcccagaagcgtgaagaccgtgctgagcagagccgacagcgacccccacggcccccacacctgcggccacgtgctgaacgtgatcatcggcagcaacgtgctggccctggccgaggcccagagacaggccgaggccctgggctaccaggccgtggtgctgagcgccgccatgcagggctggggcacccccgccgcccacagagacgacagataccagtgccacggccacccccccctggtgcccgccgccagcgtgatggcctag

SEQ ID NO: 83353 - DNA, 723 bp, Artificial Sequence
  Description of Artificial Sequence: Synthetic coding sequence
atgctgctgaagccccacagcagagtgcaggtgttcgagggcgccgaggacaacctgcccgacagagacgccctgagagccgccctggccatccagcagctggccgagggcctgaccgccgacgacctgctgctggtgctgatcagcggcggcggcagcgccctgctgcccgcccccatcccccccgtgaccctggaggagaagcagaccctgaccagactgctggccgccagaggcgccaccatccaggagctgaacaccatcagaaaggccctgagccagctgaagggcggcggcctggcccaggccgcctaccccgcccaggtggtgagcctgatcctgagcgacgtggtgggcgaccccgtggaggtgatcgccagcggccccaccgtggccagcagccacaacgtgcaggactgcctgcacatcctgaacagatacggcctgagagccgccctgcccagaagcgtgaagaccgtgctgagcagagccgacagcgacccccacggcccccacacctgcggccacgtgctgaacgtgatcatcggcagcaacgtgctggccctggccgaggcccagagacaggccgaggccctgggctaccaggccgtggtgctgagcgccgccatgcagggctggggcacccccgccgcccacagagacgacagataccagtgccacggccacccccccctggtgcccgccgccagcgtgatggcctag

SEQ ID NO: 83354 - DNA, 618 bp, Artificial Sequence
  Description of Artificial Sequence: Synthetic coding sequence
atggccgccgccctgcaggtgctgcccagactggccagagcccccctgcaccccctgctgtggagaggcagcgtggccagactggccagcagcatggccctggccgagcaggccagacagctgttcgagagcgccgtgggcgccgtgctgcccggccccatgctgcacagagccctgagcctggaccccggcggcagacagctgaaggtgagagacagaaacttccagctgagacagaacctgtacctggtgggcttcggcaaggccgtgctgggcatggccgccgccgccgaggagctgctgggccagcacctggtgcagggcgtgatcagcgtgcccaagggcatcagagccgccatggagagagccggcaagcaggagatgctgctgaagccccacagcagagtgcaggtgttcgagggcgccgaggacaacctgcccgacagagacgccctgagagccgccctggccatccagcagctggccgagggcctgaccgccgacgacctgctgctggtgctgatcagcggctggggcacccccgccgcccacagagacgacagataccagtgccacggccacccccccctggtgcccgccgccagcgtgatggcctag

SEQ ID NO: 83355 - DNA, 705 bp, Artificial Sequence; identical to SEQ ID NO: 83349
  Description of Artificial Sequence: Synthetic coding sequence

SEQ ID NO: 83356 - DNA, 285 bp, Artificial Sequence
  Description of Artificial Sequence: Synthetic coding sequence
aagatcctggacgccatgaacagagactgcggcatccccctgagccacctgcaggtggacggcggcatgaccagcaacaagatcctgatgcagctgcaggccgacatcctgtacatccccgtggtgaagcccagcatgcccgagaccaccgccctgggcgccgccatggccgccggcgccgccgagggcgtgggcgtgtggagcctggagcccgaggacctgagcgccgtgaccatggagagattcgagccccagatcaacgccgagggcaccttcaaggagtag

SEQ ID NO: 83357 - DNA, 1662 bp, Artificial Sequence
  Description of Artificial Sequence: Synthetic coding sequence
atggccgccagcaagaaggccgtgctgggccccctggtgggcgccgtggaccagggcaccagcagcaccagattcctggtgttcaacagcaagaccgccgagctgctgagccaccaccaggtggagatcaagcaggagttccccagagagggctgggtggagcaggaccccaaggagatcctgcacagcgtgtacgagtgcatcgagaagacctgcgagaagctgggccagctgaacatcgacatcagcaacatcaaggccatcggcgtgagcaaccagagagagaccaccgtggtgtgggacaagatcaccggcgagcccctgtacaacgccgtggtgtggctggacctgagaacccagagcaccgtggagagcctgagcaagagaatccccggcaacaacaacttcgtgaagagcaagaccggcctgcccctgagcacctacttcagcgccgtgaagctgagatggctgctggacaacgtgagaaaggtgcagaaggccgtggaggagaagagagccctgttcggcaccatcgacagctggctgatctggagcctgaccggcggcgtgaacggcggcgtgcactgcaccgacgtgaccaacgccagcagaaccatgctgttcaacatccacagcctggagtgggacaagcagctgtgcgagttcttcggcatccccatggagatcctgcccaacgtgagaagcagcagcgagatctacggcctgatgaaggccggcgccctggagggcgtgcccatcagcggctgcctgggcgaccagagcgccgccctggtgggccagatgtgcttccagatcggccaggccaagaacacctacggcaccggctgcttcctgctgtgcaacaccggccacaagtgcgtgttcagcgaccacggcctgctgaccaccgtggcctacaagctgggcagagacaagcccgtgtactacgccctggagggcagcgtggccatcgccggcgccgtgatcagatggctgagagacaacctgggcatcatcaagaccagcgaggagatcgagaagctggccaaggaggtgggcaccagctacggctgctacttcgtgcccgccttcagcggcctgtacgccccctactgggagcccagcgccagaggcatcatctgcggcctgacccagttcaccaacaagtgccacatcgccttcgccgccctggaggccgtgtgcttccagaccagagagatcctggacgccatgaacagagactgcggcatccccctgagccacctgcaggtggacggcggcatgaccagcaacaagatcctgatgcagctgcaggccgacatcctgtacatccccgtggtgaagcccagcatgcccgagaccaccgccctgggcgccgccatggccgccggcgccgccgagggcgtgggcgtgtggagcctggagcccgaggacctgagcgccgtgaccatggagagattcgagccccagatcaacgccgaggagagcgagatcagatacagcacctggaagaaggccgtgatgaagagcatgggctgggtgaccacccagagccccgagagcggcgaccccagcatcttctgcagcctgcccctgggcttcttcatcgtgagcagcatggtgatgctgatcggcgccagatacatcagcggcatcccctag

SEQ ID NO: 83358 - DNA, 1575 bp, Artificial Sequence
  Description of Artificial Sequence: Synthetic coding sequence
atggccgccagcaagaaggccgtgctgggccccctggtgggcgccgtggaccagggcaccagcagcaccagattcctggtgttcaacagcaagaccgccgagctgctgagccaccaccaggtggagatcaagcaggagttccccagagagggctgggtggagcaggaccccaaggagatcctgcacagcgtgtacgagtgcatcgagaagacctgcgagaagctgggccagctgaacatcgacatcagcaacatcaaggccatcggcgtgagcaaccagagagagaccaccgtggtgtgggacaagatcaccggcgagcccctgtacaacgccgtggtgtggctggacctgagaacccagagcaccgtggagagcctgagcaagagaatccccggcaacaacaacttcgtgaagagcaagaccggcctgcccctgagcacctacttcagcgccgtgaagctgagatggctgctggacaacgtgagaaaggtgcagaaggccgtggaggagaagagagccctgttcggcaccatcgacagctggctgatctggagcctgaccggcggcgtgaacggcggcgtgcactgcaccgacgtgaccaacgccagcagaaccatgctgttcaacatccacagcctggagtgggacaagcagctgtgcgagttcttcggcatccccatggagatcctgcccaacgtgagaagcagcagcgagatctacggcctgatgaaggccggcgccctggagggcgtgcccatcagcggctgcctgggcgaccagagcgccgccctggtgggccagatgtgcttccagatcggccaggccaagaacacctacggcaccggctgcttcctgctgtgcaacaccggccacaagtgcgtgttcagcgaccacggcctgctgaccaccgtggcctacaagctgggcagagacaagcccgtgtactacgccctggagggcagcgtggccatcgccggcgccgtgatcagatggctgagagacaacctgggcatcatcaagaccagcgaggagatcgagaagctggccaaggaggtgggcaccagctacggctgctacttcgtgcccgccttcagcggcctgtacgccccctactgggagcccagcgccagaggcatcatctgcggcctgacccagttcaccaacaagtgccacatcgccttcgccgccctggaggccgtgtgcttccagaccagagagatcctggacgccatgaacagagactgcggcatccccctgagccacctgcaggtggacggcggcatgaccagcaacaagatcctgatgcagctgcaggccgacatcctgtacatccccgtggtgaagcccagcatgcccgagaccaccgccctgggcgccgccatggccgccggcgccgccgagggcgtgggcgtgtggagcctggagcccgaggacctgagcgccgtgaccatggagagattcgagccccagatcaacgccgaggagagcgagatcagatacagcacctggaagaaggccgtgatgaagagcatgggctgggtgaccacccagagccccgagagcggcatcccctag

SEQ ID NO: 83359 - DNA, 1593 bp, Artificial Sequence
  Description of Artificial Sequence: Synthetic coding sequence
atggccgccagcaagaaggccgtgctgggccccctggtgggcgccgtggaccagggcaccagcagcaccagattcctggtgttcaacagcaagaccgccgagctgctgagccaccaccaggtggagatcaagcaggagttccccagagagggctgggtggagcaggaccccaaggagatcctgcacagcgtgtacgagtgcatcgagaagacctgcgagaagctgggccagctgaacatcgacatcagcaacatcaaggccatcggcgtgagcaaccagagagagaccaccgtggtgtgggacaagatcaccggcgagcccctgtacaacgccgtggtgtggctggacctgagaacccagagcaccgtggagagcctgagcaagagaatccccggcaacaacaacttcgtgaagagcaagaccggcctgcccctgagcacctacttcagcgccgtgaagctgagatggctgctggacaacgtgagaaaggtgcagaaggccgtggaggagaagagagccctgttcggcaccatcgacagctggctgatctggagcctgaccggcggcgtgaacggcggcgtgcactgcaccgacgtgaccaacgccagcagaaccatgctgttcaacatccacagcctggagtgggacaagcagctgtgcgagttcttcggcatccccatggagatcctgcccaacgtgagaagcagcagcgagatctacggcctgatgaagatcagccacagcgtgaaggccggcgccctggagggcgtgcccatcagcggctgcctgggcgaccagagcgccgccctggtgggccagatgtgcttccagatcggccaggccaagaacacctacggcaccggctgcttcctgctgtgcaacaccggccacaagtgcgtgttcagcgaccacggcctgctgaccaccgtggcctacaagctgggcagagacaagcccgtgtactacgccctggagggcagcgtggccatcgccggcgccgtgatcagatggctgagagacaacctgggcatcatcaagaccagcgaggagatcgagaagctggccaaggaggtgggcaccagctacggctgctacttcgtgcccgccttcagcggcctgtacgccccctactgggagcccagcgccagaggcatcatctgcggcctgacccagttcaccaacaagtgccacatcgccttcgccgccctggaggccgtgtgcttccagaccagagagatcctggacgccatgaacagagactgcggcatccccctgagccacctgcaggtggacggcggcatgaccagcaacaagatcctgatgcagctgcaggccgacatcctgtacatccccgtggtgaagcccagcatgcccgagaccaccgccctgggcgccgccatggccgccggcgccgccgagggcgtgggcgtgtggagcctggagcccgaggacctgagcgccgtgaccatggagagattcgagccccagatcaacgccgaggagagcgagatcagatacagcacctggaagaaggccgtgatgaagagcatgggctgggtgaccacccagagccccgagagcggcatcccctag

SEQ ID NO: 83360 - DNA, 1065 bp, Artificial Sequence
  Description of Artificial Sequence: Synthetic coding sequence
atgctgttcaacatccacagcctggagtgggacaagcagctgtgcgagttcttcggcatccccatggagatcctgcccaacgtgagaagcagcagcgagatctacggcctgatgaagatcagccacagcgtgaaggccggcgccctggagggcgtgcccatcagcggctgcctgggcgaccagagcgccgccctggtgggccagatgtgcttccagatcggccaggccaagaacacctacggcaccggctgcttcctgctgtgcaacaccggccacaagtgcgtgttcagcgaccacggcctgctgaccaccgtggcctacaagctgggcagagacaagcccgtgtactacgccctggagggcagcgtggccatcgccggcgccgtgatcagatggctgagagacaacctgggcatcatcaagaccagcgaggagatcgagaagctggccaaggaggtgggcaccagctacggctgctacttcgtgcccgccttcagcggcctgtacgccccctactgggagcccagcgccagaggcatcatctgcggcctgacccagttcaccaacaagtgccacatcgccttcgccgccctggaggccgtgtgcttccagaccagagagatcctggacgccatgaacagagactgcggcatccccctgagccacctgcaggtggacggcggcatgaccagcaacaagatcctgatgcagctgcaggccgacatcctgtacatccccgtggtgaagcccagcatgcccgagaccaccgccctgggcgccgccatggccgccggcgccgccgagggcgtgggcgtgtggagcctggagcccgaggacctgagcgccgtgaccatggagagattcgagccccagatcaacgccgaggagagcgagatcagatacagcacctggaagaaggccgtgatgaagagcatgggctgggtgaccacccagagccccgagagcggcgaccccagcatcttctgcagcctgcccctgggcttcttcatcgtgagcagcatggtgatgctgatcggcgccagatacatcagcggcatcccctag

SEQ ID NO: 83361 - DNA, 1104 bp, Artificial Sequence
  Description of Artificial Sequence: Synthetic coding sequence
atggcctacctggacaacttcaagaccaacgccagacacttcatcctgttcgtgaacatcagcagcctgaccggcggcgtgaacggcggcgtgcactgcaccgacgtgaccaacgccagcagaaccatgctgttcaacatccacagcctggagtgggacaagcagctgtgcgagttcttcggcatccccatggagatcctgcccaacgtgagaagcagcagcgagatctacggcctgatgaagatcagccacagcgtgaaggccggcgccctggagggcgtgcccatcagcggctgcctgggcgaccagagcgccgccctggtgggccagatgtgcttccagatcggccaggccaagaacacctacggcaccggctgcttcctgctgtgcaacaccggccacaagtgcgtgttcagcgaccacggcctgctgaccaccgtggcctacaagctgggcagagacaagcccgtgtactacgccctggagggcagcgtggccatcgccggcgccgtgatcagatggctgagagacaacctgggcatcatcaagaccagcgaggagatcgagaagctggccaaggaggtgggcaccagctacggctgctacttcgtgcccgccttcagcggcctgtacgccccctactgggagcccagcgccagaggcatcatctgcggcctgacccagttcaccaacaagtgccacatcgccttcgccgccctggaggccgtgtgcttccagaccagagagatcctggacgccatgaacagagactgcggcatccccctgagccacctgcaggtggacggcggcatgaccagcaacaagatcctgatgcagctgcaggccgacatcctgtacatccccgtggtgaagcccagcatgcccgagaccaccgccctgggcgccgccatggccgccggcgccgccgagggcgtgggcgtgtggagcctggagcccgaggacctgagcgccgtgaccatggagagattcgagccccagatcaacgccgaggagagcgagatcagatacagcacctggaagaaggccgtgatgaagagcatgggctgggtgaccacccagagccccgagagcggcatcccctag

SEQ ID NO: 83362 - DNA, 1680 bp, Artificial Sequence
  Description of Artificial Sequence: Synthetic coding sequence
atggccgccagcaagaaggccgtgctgggccccctggtgggcgccgtggaccagggcaccagcagcaccagattcctggtgttcaacagcaagaccgccgagctgctgagccaccaccaggtggagatcaagcaggagttccccagagagggctgggtggagcaggaccccaaggagatcctgcacagcgtgtacgagtgcatcgagaagacctgcgagaagctgggccagctgaacatcgacatcagcaacatcaaggccatcggcgtgagcaaccagagagagaccaccgtggtgtgggacaagatcaccggcgagcccctgtacaacgccgtggtgtggctggacctgagaacccagagcaccgtggagagcctgagcaagagaatccccggcaacaacaacttcgtgaagagcaagaccggcctgcccctgagcacctacttcagcgccgtgaagctgagatggctgctggacaacgtgagaaaggtgcagaaggccgtggaggagaagagagccctgttcggcaccatcgacagctggctgatctggagcctgaccggcggcgtgaacggcggcgtgcactgcaccgacgtgaccaacgccagcagaaccatgctgttcaacatccacagcctggagtgggacaagcagctgtgcgagttcttcggcatccccatggagatcctgcccaacgtgagaagcagcagcgagatctacggcctgatgaccatccacaacagcaagaaggccggcgccctggagggcgtgcccatcagcggctgcctgggcgaccagagcgccgccctggtgggccagatgtgcttccagatcggccaggccaagaacacctacggcaccggctgcttcctgctgtgcaacaccggccacaagtgcgtgttcagcgaccacggcctgctgaccaccgtggcctacaagctgggcagagacaagcccgtgtactacgccctggagggcagcgtggccatcgccggcgccgtgatcagatggctgagagacaacctgggcatcatcaagaccagcgaggagatcgagaagctggccaaggaggtgggcaccagctacggctgctacttcgtgcccgccttcagcggcctgtacgccccctactgggagcccagcgccagaggcatcatctgcggcctgacccagttcaccaacaagtgccacatcgccttcgccgccctggaggccgtgtgcttccagaccagagagatcctggacgccatgaacagagactgcggcatccccctgagccacctgcaggtggacggcggcatgaccagcaacaagatcctgatgcagctgcaggccgacatcctgtacatccccgtggtgaagcccagcatgcccgagaccaccgccctgggcgccgccatggccgccggcgccgccgagggcgtgggcgtgtggagcctggagcccgaggacctgagcgccgtgaccatggagagattcgagccccagatcaacgccgaggagagcgagatcagatacagcacctggaagaaggccgtgatgaagagcatgggctgggtgaccacccagagccccgagagcggcgaccccagcatcttctgcagcctgcccctgggcttcttcatcgtgagcagcatggtgatgctgatcggcgccagatacatcagcggcatcccctag

SEQ ID NO: 83363 - DNA, 1662 bp, Artificial Sequence
  Description of Artificial Sequence: Synthetic coding sequence
atggccgcccccaagaccgccgccgtgggccccctggtgggcgccgtggtgcagggcaccaacagcaccagattcctggtgttcaacagcaagaccgccgagctgctgagccaccacaaggtggagctgacccaggagttccccaaggagggctgggtggagcaggaccccaaggagatcctgcagagcgtgtacgagtgcatcgccagaacctgcgagaagctggacgagctgaacatcgacatcagcaacatcaaggccgtgggcgtgagcaaccagagagagaccaccgtgatctgggacaagctgaccggcgagcccctgtacaacgccgtggtgtggctggacctgagaacccagaccaccgtggaggacctgagcaagaagatccccggcaacagcaacttcgtgaagagcaagaccggcctgcccctgagcacctacttcagcgccgtgaagctgagatggatgctggacaacgtgagaaacgtgcagaaggccgtggaggagggcagagccctgttcggcaccatcgacagctggctgatctggagcctgaccggcggcgtgaacggcggcgtgcactgcaccgacgtgaccaacgccagcagaaccatgctgttcaacatccacagcctggagtgggacaaggagctgtgcgacttcttcgagatccccatggacctgctgcccaacgtgttcagcagcagcgagatctacggcctgatcaagaccggcgccctggagggcgtgcccatcagcggctgcctgggcgaccagtgcgccgccctggtgggccagatgtgcttccaggagggccaggccaagaacacctacggcaccggctgcttcctgctgtgcaacaccggcagaaagtgcgtgttcagcgagcacggcctgctgaccaccgtggcctacaagctgggcagagagaagcccgcctactacgccctggagggcagcgtggccatcgccggcgccgtgatcagatggctgagagacaacctgggcatcatcgagaccagcggcgacatcgagagactggccaaggaggtgggcaccagctacggctgctacttcgtgcccgccttcagcggcctgtacgccccctactgggagcccagcgccagaggcatcctgtgcggcctgacccagttcaccaacaagtgccacatcgccttcgccgccctggaggccgtgtgcttccagaccagagagatcctggaggccatgaacagagactgcggcatccccctgagacacctgcaggtggacggcggcatgaccaacaacaaggtgctgatgcagctgcaggccgacatcctgcacatccccgtgatcaagcccttcatgcccgagaccaccgccctgggcgccgccatggccgccggcgccgccgagggcgtgagcgtgtggagcctggagccccaggccctgagcgtgctgagaatggagagattcgagccccagatccaggccaccgagagcgagatcagatacgccacctggaagaaggccgtgatgaagagcatgggctgggtgaccagccagagccccgagggcggcgaccccagcatcttcagcagcctgcccctgggcttcttcatcgtgagcagcatggtgatgctgatcggcgccagatacatcagcggcgtgccctag

SEQ ID NO: 83364 - DNA, 1050 bp, Artificial Sequence
  Description of Artificial Sequence: Synthetic coding sequence
atggccagcaagaaggtgtgcatcgtgggcagcggcaactggggcagcgccatcgccaagatcgtgggcggcaacgccgcccagctggcccagttcgaccccagagtgaccatgtgggtgttcgaggaggacatcggcggcaagaagctgaccgagatcatcaacacccagcacgagaacgtgaagtacctgcccggccacaagctgccccccaacgtggtggccgtgcccgacgtggtgcaggccgccgaggacgccgacatcctgatcttcgtggtgccccaccagttcatcggcaagatctgcgaccagctgaagggccacctgaaggccaacgccaccggcatcagcctgatcaagggcgtggacgagggccccaacggcctgaagctgatcagcgaggtgatcggcgagagactgggcatccccatgagcgtgctgatgggcgccaacatcgccagcgaggtggccgacgagaagttctgcgagaccaccatcggctgcaaggaccccgcccagggccagctgctgaaggagctgatgcagacccccaacttcagaatcaccgtggtgcaggaggtggacaccgtggagatctgcggcgccctgaagaacgtggtggccgtgggcgccggcttctgcgacggcctgggcttcggcgacaacaccaaggccgccgtgatcagactgggcctgatggagatgatcgccttcgccaagctgttctgcagcggccccgtgagcagcgccaccttcctggagagctgcggcgtggccgacctgatcaccacctgctacggcggcagaaacagaaaggtggccgaggccttcgccagaaccggcaagagcatcgagcagctggagaaggagctgctgaacggccagaagctgcagggccccgagaccgccagagagctgtacagcatcctgcagcacaagggcctggtggacaagttccccctgttcatggccgtgtacaaggtgtgctacgagggccagcccgtgggcgagttcatccactgcctgcagaaccaccccgagcacatgtag

SEQ ID NO: 83365 - DNA, 981 bp, Artificial Sequence
  Description of Artificial Sequence: Synthetic coding sequence
atgcagacccccaacttcagaatcaccgtggtgcaggaggtggacaccgtggagatctgcggcgccctgaaggtgagaggcgcccagagacagctgtggggcgaggagaaggcccccaaggaggtgtggctgagcagcgccagactgcaggtgctgcaggccctgaccatcgagcagtggttccccttccccaccatgagccacgcctacagaagaagctgcagaagcaaggccagagccatccaggccgactacagcagcagcgacagaggccccccctgcagctgccccatcctggccccctgcggcaccccccaccccctggcccccggcggccagggcgacaaggagatgcccagactgatgggcgacaagaccagcctgacccccagacagaccaacggccagaactacggcagctggaccgccgtggacggcctgtacaacggcatggtgagatgggaggaccagctggagagaagagtggtgttcagaaagtgccccagaggcggcagcatgggccagggcctgagaaagggcgtgcagcagggcggcaagcccagaggcggcagcagactgctgaagggccacaccctgtacctgagcagcgccgtgggcgtgaccgccgacgagatgagcatgagaggcctgcacatgggccccatcggcggcggcctgttcacctacgacctgcacagcttcaagaacgtggtggccgtgggcgccggcttctgcgacggcctgggcttcggcgacaacaccaaggccgccgtgatcagactgggcctgatggagatgatcgccttcgccaagctgttctgcagcggccccgtgagcagcgccaccttcctggagagctgcggcgtggccgacctgatcaccacctgctacggcggcagaaacagaaaggtggccgaggccttcgccagaaccggcaaggtgggccccggcagaagagagaacagaggcgccgccctgtag

SEQ ID NO: 83366 - DNA, 1056 bp, Artificial Sequence
  Description of Artificial Sequence: Synthetic coding sequence
atggccgccgcccccctgaaggtgtgcatcgtgggcagcggcaactggggcagcgccgtggccaagatcatcggcaacaacgtgaagaagctgcagaagttcgccagcaccgtgaagatgtgggtgttcgaggagaccgtgaacggcagaaagctgaccgacatcatcaacaacgaccacgagaacgtgaagtacctgcccggccacaagctgcccgagaacgtggtggccatgagcaacctgagcgaggccgtgcaggacgccgacctgctggtgttcgtgatcccccaccagttcatccacagaatctgcgacgagatcaccggcagagtgcccaagaaggccctgggcatcaccctgatcaagggcatcgacgagggccccgagggcctgaagctgatcagcgacatcatcagagagaagatgggcatcgacatcagcgtgctgatgggcgccaacatcgccaacgaggtggccgccgagaagttctgcgagaccaccatcggcagcaaggtgatggagaacggcctgctgttcaaggagctgctgcagacccccaacttcagaatcaccgtggtggacgacgccgacaccgtggagctgtgcggcgccctgaagaacatcgtggccgtgggcgccggcttctgcgacggcctgagatgcggcgacaacaccaaggccgccgtgatcagactgggcctgatggagatgatcgccttcgccagaatcttctgcaagggccaggtgagcaccgccaccttcctggagagctgcggcgtggccgacctgatcaccacctgctacggcggcagaaacagaagagtggccgaggccttcgccagaaccggcaagaccatcgaggagctggagaaggagatgctgaacggccagaagctgcagggcccccagaccagcgccgaggtgtacagaatcctgaagcagaagggcctgctggacaagttccccctgttcaccgccgtgtaccagatctgctacgagagcagacccgtgcaggagatgctgagctgcctgcagagccaccccgagcacacctag

SEQ ID NO: 83367 - DNA, 1860 bp, Artificial Sequence
  Description of Artificial Sequence: Synthetic coding sequence
atggagagcagcagcagcagcaacagctacttcagcgtgggccccaccagccccagcgccgtggtgctgctgtacagcctgagcaaggagagcctgcagagcgtggacgtgctgagagaggaggtgagcgagatcctggacgagatgagccacaagctgagactgggcgccatcagattctgcgccttcaccctgagcaaggtgttcaagcagatcttcagcaaggtgtgcgtgaacgaggagggcatccagaagctgcagagagccatccaggagcaccccgtggtgctgctgcccagccacagaagctacatcgacttcctgatgctgagcttcctgctgtacaactacgacctgcccgtgcccgtgatcgccgccggcatggacttcctgggcatgaagatggtgggcgagctgctgagaatgagcggcgccttcttcatgagaagaaccttcggcggcaacaagctgtactgggccgtgttcagcgagtacgtgaagaccatgctgagaaacggctacgcccccgtggagttcttcctggagggcaccagaagcagaagcgccaagaccctgacccccaagttcggcctgctgaacatcgtgatggagcccttcttcaagagagaggtgttcgacacctacctggtgcccatcagcatcagctacgacaagatcctggaggagaccctgtacgtgtacgagctgctgggcgtgcccaagcccaaggagagcaccaccggcctgctgaaggccagaaagatcctgagcgagaacttcggcagcatccacgtgtacttcggcgaccccgtgagcctgagaagcctggccgccggcagaatgagcagaagcagctacaacctggtgcccagatacatcccccagaagcagagcgaggacatgcacgccttcgtgaccgaggtggcctacaagatggagctgctgcagatcgagaacatggtgctgagcccctggaccctgatcgtggccgtgctgctgcagaacagacccagcatggacttcgacgccctggtggagaagaccctgtggctgaagggcctgacccaggccttcggcggcttcctgatctggcccgacaacaagcccgccgaggaggtggtgcccgccagcatcctgctgcacagcaacatcgccagcctggtgaaggaccaggtgatcctgaaggtggacagcggcgacagcgaggtggtggacggcctgatgctgcagcacatcaccctgctgatgtgcagcgcctacagaaaccagctgctgaacatcttcgtgagacccagcctggtggccgtggccctgcagatgacccccggcttcagaaaggaggacgtgtacagctgcttcagattcctgagagacgtgttcgccgacgagttcatcttcctgcccggcaacaccctgaaggacttcgaggagggctgctacctgctgtgcaagagcgaggccatccaggtgaccaccaaggacatcctggtgaccgagaagggcaacaccgtgctggagttcctggtgggcctgttcaagcccttcgtggagagctaccagatcatctgcaagtacctgctgagcgaggaggaggaccacttcagcgaggagcagtacctggccgccgtgagaaagttcaccagccagctgctggaccagggcaccagccagtgctacgacgtgctgagcagcgacgtgcagaagaacgccctggccgcctgcgtgagactgggcgtggtggagaagaagaagatcaacaacaactgcatcttcaacgtgaacgagcccgccaccaccaagctggaggagatgctgggctgcaagacccccatcggcaagcccgccaccgccaagctgtag

SEQ ID NO: 83368 - DNA, 2043 bp, Artificial Sequence
  Description of Artificial Sequence: Synthetic coding sequence
atggagagcagcagcagcagcaacagctacttcagcgtgggccccaccagccccagcgccgtggtgctgctgtacagcaaggagctgaagaagtgggacgagttcgaggacatcctggaggagagaagacacgtgagcgacctgaagttcgccatgaagtgctacacccccctggtgtacaagggcatcaccccctgcaagcccatcgacatcaagtgcagcgtgctgaacagcgaggagatccactacgtgatcaagcagctgagcaaggagagcctgcagagcgtggacgtgctgagagaggaggtgagcgagatcctggacgagatgagccacaagctgagactgggcgccatcagattctgcgccttcaccctgagcaaggtgttcaagcagatcttcagcaaggtgtgcgtgaacgaggagggcatccagaagctgcagagagccatccaggagcaccccgtggtgctgctgcccagccacagaagctacatcgacttcctgatgctgagcttcctgctgtacaactacgacctgcccgtgcccgtgatcgccgccggcatggacttcctgggcatgaagatggtgggcgagctgctgagaatgagcggcgccttcttcatgagaagaaccttcggcggcaacaagctgtactgggccgtgttcagcgagtacgtgaagaccatgctgagaaacggctacgcccccgtggagttcttcctggagggcaccagaagcagaagcgccaagaccctgacccccaagttcggcctgctgaacatcgtgatggagcccttcttcaagagagaggtgttcgacacctacctggtgcccatcagcatcagctacgacaagatcctggaggagaccctgtacgtgtacgagctgctgggcgtgcccaagcccaaggagagcaccaccggcctgctgaaggccagaaagatcctgagcgagaacttcggcagcatccacgtgtacttcggcgaccccgtgagcctgagaagcctggccgccggcagaatgagcagaagcagctacaacctggtgcccagatacatcccccagaagcagagcgaggacatgcacgccttcgtgaccgaggtggcctacaagatggagctgctgcagatcgagaacatggtgctgagcccctggaccctgatcgtggccgtgctgctgcagaacagacccagcatggacttcgacgccctggtggagaagaccctgtggctgaagggcctgacccaggccttcggcggcttcctgatctggcccgacaacaagcccgccgaggaggtggtgcccgccagcatcctgctgcacagcaacatcgccagcctggtgaaggaccaggtgatcctgaaggtggacagcggcgacagcgaggtggtggacggcctgatgctgcagcacatcaccctgctgatgtgcagcgcctacagaaaccagctgctgaacatcttcgtgagacccagcctggtggccgtggccctgcagatgacccccggcttcagaaaggaggacgtgtacagctgcttcagattcctgagagacgtgttcgccgacgagttcatcttcctgcccggcaacaccctgaaggacttcgaggagggctgctacctgctgtgcaagagcgaggccatccaggtgaccaccaaggacatcctggtgaccgagaagggcaacaccgtgctggagttcctggtgggcctgttcaagcccttcgtggagagctaccagatcatctgcaagtacctgctgagcgaggaggaggaccacttcagcgaggagcagtacctggccgccgtgagaaagttcaccagccagctgctggaccagggcaccagccagtgctacgacgtgctgagcagcgacgtgcagaagaacgccctggccgcctgcgtgagactgggcgtggtggagaagaagaagatcaacaacaactgcatcttcaacgtgaacgagcccgccaccaccaagctggaggagatgctgggctgcaagacccccatcggcaagcccgccaccgccaagctgtag

SEQ ID NO: 83369 - DNA, 1764 bp, Artificial Sequence
  Description of Artificial Sequence: Synthetic coding sequence
atggagagcagcagcagcagcaacagctacttcagcgtgggccccaccagccccagcgccgtggtgctgctgtacagcaaggagctgaagaagtgggacgagttcgaggacatcctggaggagagaagacacgtgagcgacctgaagttcgccatgaagtgctacacccccctggtgtacaagggcatcaccccctgcaagcccatcgacatcaagtgcagcgtgctgaacagcgaggagatccactacgtgatcaagcagctgagcaaggagagcctgcagagcgtggacgtgctgagagaggaggtgagcgagatcctggacgagatgagccacaagctgagactgggcgccatcagattctgcgccttcaccctgagcaaggtgttcaagcagatcttcagcaagctgcagagagccatccaggagcaccccgtggtgctgctgcccagccacagaagctacatcgacttcctgatgctgagcttcctgctgtacaactacgacctgcccgtgcccgtgatcgccgccggcatggacttcctgggcatgaagatggtgggcgagctgctgagaatgagcggcgccttcttcatgagaagaaccttcggcggcaacaagctgtactgggccgtgttcagcgagtacgtgaagaccatgctgagaaacggctacgcccccgtggagttcttcctggagggcaccagaagcagaagcgccaagaccctgacccccaagttcggcctgctgaacatcgtgatggagcccttcttcaagagagaggtgttcgacacctacctggtgcccatcagcatcagctacgacaagatcctggaggagaccctgtacgtgtacgagctgctgggcgtgcccaagcccaaggagagcaccaccggcctgctgaaggccagaaagatcctgagcgagaacttcggcagcatccacgtgtacttcggcgaccccgtgagcctgagaagcctggccgccggcagaatgagcagaagcagctacaacctggtgcccagatacatcccccagaagcagagcgaggacatgcacgccttcgtgaccgaggtggcctacaagatggagctgctgcagatcgagaacatggtgctgagcccctggaccctgatcgtggccgtgctgctgcagaacagacccagcatggacttcgacgccctggtggagaagaccctgtggctgaagggcctgacccaggccttcggcggcttcctgatctggcccgacaacaagcccgccgaggaggtggtgcccgccagcatcctgctgcacagcaacatcgccagcctggtgaaggaccaggtgatcctgaaggtggacagcggcgacagcgaggtggtggacggcctgatgctgcagcacatcaccctgctgatgtgcagcgcctacagaaaccagctgctgaacatcttcgtgagacccagcctggtggccgtggccctgcagatgacccccggcttcagaaaggaggacgtgtacagctgcttcagattcctgagagacgtgttcgccgacgagttcatcttcctgcccggcaacaccctgaaggacttcgaggagggctgctacctgctgtgcaagagcgaggccatccaggtgaccaccaaggacatcctggtgaccgagaagggcaacaccgtgctggagttcctggtgggcctgttcaagcccttcgtggagagctaccagatcatctgcaagtacctgctgagcgaggaggaggaccacttcagcgagtag

SEQ ID NO: 83370 - DNA, 669 bp, Artificial Sequence
  Description of Artificial Sequence: Synthetic coding sequence
atggagagcagcagcagcagcaacagctacttcagcgtgggccccaccagccccagcgccgtggtgctgctgtacagcctgagcaaggagagcctgcagagcgtggacgtgctgagagaggaggtgagcgagatcctggacgagatgagccacaagctgagactgggcgccatcagattctgcgccttcaccctgagcaaggtgttcaagcagatcttcagcaaggtgtgcgtgaacgaggagggcatccagaagctgcagagagccatccaggagcaccccgtggtgctgctgcccagccacagaagctacatcgacttcctgatgctgagcttcctgctgtacaactacgacctgcccgtgcccgtgatcgccgccggcatggacttcctgggcatgaagatggtgggcgagctgctgagaatgagcggcgccttcttcatgagaagaaccttcggcggcaacaagctgtactgggccgtgttcagcgagtacgtgaagaccatgctgagaaacggctacgcccccgtggagttcttcctggagggcaccagaagcagaagcgccaagaccctgacccccaagttcggcctgctgaacatcgtgatggagcccttcttcaagagagaggtgttcgacacctacctggtgcccatcagcatcagctag

SEQ ID NO: 83371 - DNA, 870 bp, Artificial Sequence
  Description of Artificial Sequence: Synthetic coding sequence
atgagcagaaacagcagaaagaccatcggcaaggtgagagtggactacatcatcatcaagcccctgcccggctacagctgcgacatgaagagcagcttcagcaagtactggaagcccagaatccccctggacgtgggccacagaggcgccggcaacagcaccaccaccgcccagctggccaaggtgcaggagaacaccatcgccagcctgagaaacgccgccagccacggcgccgccttcgtggagttcgacgtgcacctgagcaaggacttcgtgcccgtggtgtaccacgacctgacctgctgcctgaccatgaagaagaacctgtggttcagaagaaagatccccttccagaagatcagccacttcctgctgctgagatgggtgagacagaagcagaacaagtaccccatcctgttcctgacccagggcaagagcgagatctaccccgagctgatggacctgagaagcagaaccacccccatcgccatgagcttcgcccagttcgagaacctgctgggcatcaacgtgcacaccgaggacctgctgagaaaccccagctacatccaggaggccaaggccaagggcctggtgatcttctgctggggcgacgacaccaacgaccccgagaacagaagaaagctgaaggagctgggcgtgaacggcctgatctacgacagaatctacgactggatgcccgagcagcccaacatcttccaggtggagcagctggagagactgaagcaggagctgcccgagctgaagagctgcctgtgccccaccgtgagcagattcgtgcccagcagcctgtgcggcgagagcgacatccacgtggacgccaacggcatcgacaacgtggagaacgcctag

SEQ ID NO: 83372 - DNA, 2019 bp, Artificial Sequence
  Description of Artificial Sequence: Synthetic coding sequence
atgacccccagccaggtggccttcgagatcagaggcaccctgctgcccggcgaggtgttcgccatctgcggcagctgcgacgccctgggcaactggaacccccagaacgccgtggccctgctgcccgagaacgacaccggcgagagcatgctgtggaaggccaccatcgtgctgagcagaggcgtgagcgtgcagtacagatacttcaagggctacttcctggagcccaagaccatcggcggcccctgccaggtgatcgtgcacaagtgggagacccacctgcagcccagaagcatcacccccctggagagcgagatcatcatcgacgacggccagttcggcatccacaacggcgtggagaccctggacagcggctggctgacctgccagaccgagatcagactgagactgcactacagcgagaagccccccgtgagcatcaccaagaagaagctgaagaagagcagattcagagtgaagctgaccctggagggcctggaggaggacgacgacgacagagtgagccccaccgtgctgcacaagatgagcaacagcctggagatcagcctgatcagcgacaacgagttcaagtgcagacacagccagcccgagtgcggctacggcctgcagcccgacagatggaccgagtacagcatccagaccatggagcccgacaacctggagctgatcttcgacttcttcgaggaggacctgagcgagcacgtggtgcagggcgacgccctgcccggccacgtgggcaccgcctgcctgctgagcagcaccatcgccgagagcggcaagagcgccggcatcctgaccctgcccatcatgagcagaaacagcagaaagaccatcggcaaggtgagagtggactacatcatcatcaagcccctgcccggctacagctgcgacatgaagagcagcttcagcaagtactggaagcccagaatccccctggacgtgggccacagaggcgccggcaacagcaccaccaccgcccagctggccaaggtgcaggagaacaccatcgccagcctgagaaacgccgccagccacggcgccgccttcgtggagttcgacgtgcacctgagcaaggacttcgtgcccgtggtgtaccacgacctgacctgctgcctgaccatgaagaagaagttcgacgccgaccccgtggagctgttcgagatccccgtgaaggagctgaccttcgaccagctgcagctgctgaagctgacccacgtgaccgccctgaagagcaaggacagaaaggagagcgtggtgcaggaggagaacagcttcagcgagaaccagcccttccccagcctgaagatggtgctggagagcctgcccgaggacgtgggcttcaacatcgagatcaagtggatctgccagcagagagacggcatgtgggacggcaacctgagcacctacttcgacatgaacctgttcctggacatcatcctgaagaccgtgctggagaacagcggcaagagaagaatcgtgttcagcagcttcgacgccgacatctgcaccatggtgagacagaagcagaacaagtaccccatcctgttcctgacccagggcaagagcgagatctaccccgagctgatggacctgagaagcagaaccacccccatcgccatgagcttcgcccagttcgagaacctgctgggcatcaacgtgcacaccgaggacctgctgagaaaccccagctacatccaggaggccaaggccaagggcctggtgatcttctgctggggcgacgacaccaacgaccccgagaacagaagaaagctgaaggagctgggcgtgaacggcctgatctacgacagaatctacgactggatgcccgagcagcccaacatcttccaggtggagcagctggagagactgaagcaggagctgcccgagctgaagagctgcctgtgccccaccgtgagcagattcgtgcccagcagcctgtgcggcgagagcgacatccacgtggacgccaacggcatcgacaacgtggagaacgcctag

SEQ ID NO: 83373 - DNA, 795 bp, Artificial Sequence
  Description of Artificial Sequence: Synthetic coding sequence
tgatgcgacatgaagagcagcttcagcaagtactggaagcccagaatccccctggacgtgggccacagaggcgccggcaacagcaccaccaccgcccagctggccaaggtgcaggagaacaccatcgccagcctgagaaacgccgccagccacggcgccgccttcgtggagttcgacgtgcacctgagcaaggacttcgtgcccgtggtgtaccacgacctgacctgctgcctgaccatgaagaagaacctgtggttcagaagaaagatccccttccagaagatcagccacttcctgctgctgagatgggtgagacagaagcagaacaagtaccccatcctgttcctgacccagggcaagagcgagatctaccccgagctgatggacctgagaagcagaaccacccccatcgccatgagcttcgcccagttcgagaacctgctgggcatcaacgtgcacaccgaggacctgctgagaaaccccagctacatccaggaggccaaggccaagggcctggtgatcttctgctggggcgacgacaccaacgaccccgagaacagaagaaagctgaaggagctgggcgtgaacggcctgatctacgacagaatctacgactggatgcccgagcagcccaacatcttccaggtggagcagctggagagactgaagcaggagctgcccgagctgaagagctgcctgtgccccaccgtgagcagattcgtgcccagcagcctgtgcggcgagagcgacatccacgtggacgccaacggcatcgacaacgtggagaacgcctag

SEQ ID NO: 83374 - DNA, 996 bp, Artificial Sequence
  Description of Artificial Sequence: Synthetic coding sequence
atgtggctgtgggaggaccagggcggcctgctgggccccttcagcttcctgctgctggtgctgctgctggtgaccagaagccccgtgaacgcctgcctgctgaccggcagcctgttcgtgctgctgagagtgttcagcttcgagcccgtgcccagctgcagagccctgcaggtgctgaagcccagagacagaatcagcgccatcgcccacagaggcggcagccacgacgcccccgagaacaccctggccgccatcagacaggccgccaagaacggcgccaccggcgtggagctggacatcgagttcaccagcgacggcatccccgtgctgatgcacgacaacaccgtggacagaaccaccgacggcaccggcagactgtgcgacctgaccttcgagcagatcagaaagctgaaccccgccgccaaccacagactgagaaacgacttccccgacgagaagatccccaccctgagagaggccgtggccgagtgcctgaaccacaacctgaccatcttcttcgacgtgaagggccacgcccacaaggccaccgaggccctgaagaagatgtacatggagttcccccagctgtacaacaacagcgtggtgtgcagcttcctgcccgaggtgatctacaagatgagacagaccgacagagacgtgatcaccgccctgacccacagaccctggagcctgagccacaccggcgacggcaagcccagatacgacaccttctggaagcacttcatcttcgtgatgatggacatcctgctggactggagcatgcacaacatcctgtggtacctgtgcggcatcagcgccttcctgatgcagaaggacttcgtgagccccgcctacctgaagaagtggagcgccaagggcatccaggtggtgggctggaccgtgaacaccttcgacgagaagagctactacgagagccacctgggcagcagctacatcaccgacagcatggtggaggactgcgagccccacttctag

SEQ ID NO: 83375 - DNA, 1818 bp, Artificial Sequence
  Description of Artificial Sequence: Synthetic coding sequence
atggtgagacaccagcccctgcagtactacgagccccagctgtgcctgagctgcctgaccggcatctacggctgcagatggaagagataccagagaagccacgacgacaccaccccctgggagagactgtggttcctgctgctgaccttcaccttcggcctgaccctgacctggctgtacttctggtgggaggtgcacaacgactacgacgagttcaactggtacctgtacaacagaatgggctactggagcgactggcccgtgcccatcctggtgaccaccgccgccgccttcgcctacatcgccggcctgctggtgctggccctgtgccacatcgccgtgggccagcagatgaacctgcactggctgcacaagatcggcctggtggtgatcctggccagcaccgtggtggccatgagcgccgtggcccagctgtgggaggacgagtgggaggtgctgctgatcagcctgcagggcaccgcccccttcctgcacgtgggcgccgtggccgccgtgaccatgctgagctggatcgtggccggccagttcgccagagccgagagaaccagcagccaggtgaccatcctgtgcaccttcttcaccgtggtgttcgccctgtacctggcccccctgaccatcagcagcccctgcatcatggagaagaaggacctgggccccaagcccgccctgatcggccacagaggcgcccccatgctggcccccgagcacaccctgatgagcttcagaaaggccctggagcagaagctgtacggcctgcaggccgacatcaccatcagcctggacggcgtgcccttcctgatgcacgacaccaccctgagaagaaccaccaacgtggaggaggagttccccgagctggccagaagacccgccagcatgctgaactggaccaccctgcagagactgaacgccggccagtggttcctgaagaccgaccccttctggaccgccagcagcctgagccccagcgaccacagagaggcccagaaccagagcatctgcagcctggccgagctgctggagctggccaagggcaacgccaccctgctgctgaacctgagagacccccccagagagcacccctacagaagcagcttcatcaacgtgaccctggaggccgtgctgcacagcggcttcccccagcaccaggtgatgtggctgcccagcagacagagacccctggtgagaaaggtggcccccggcttccagcagaccagcggcagcaaggaggccgtggccagcctgagaagaggccacatccagagactgaacctgagatacacccaggtgagcagacaggagctgagagactacgccagctggaacctgagcgtgaacctgtacaccgtgaacgccccctggctgttcagcctgctgtggtgcgccggcgtgcccagcgtgaccagcgacaacagccacgccctgagccaggtgcccagccccctgtggatcatgccccccgacgagtactgcctgatgtgggtgaccgccgacctggtgagcttcaccctgatcgtgggcatcttcgtgctgcagaagtggagactgggcggcatcagaagctacaaccccgagcagatcatgctgagcgccgccgtgagaagaaccagcagagacgtgagcatcatgaaggagaagctgatcttcagcgagatcagcgacggcgtggaggtgagcgacgtgctgagcgtgtgcagcgacaacagctacgacacctacgccaacagcaccgccacccccgtgggccccagaggcggcggcagccacaccaagaccctgatcgagagaagcggcagatag

SEQ ID NO: 83376 - DNA, 1461 bp, Artificial Sequence
  Description of Artificial Sequence: Synthetic coding sequence
atggtgagacaccagcccctgcagtactacgagccccagctgtgcctgagctgcctgaccggcatctacggctgcagatggaagagataccagagaagccacgacgacaccacccccggcaccgcccccttcctgcacgtgggcgccgtggccgccgtgaccatgctgagctggatcgtggccggccagttcgccagagccgagagaaccagcagccaggtgaccatcctgtgcaccttcttcaccgtggtgttcgccctgtacctggcccccctgaccatcagcagcccctgcatcatggagaagaaggacctgggccccaagcccgccctgatcggccacagaggcgcccccatgctggcccccgagcacaccctgatgagcttcagaaaggccctggagcagaagctgtacggcctgcaggccgacatcaccatcagcctggacggcgtgcccttcctgatgcacgacaccaccctgagaagaaccaccaacgtggaggaggagttccccgagctggccagaagacccgccagcatgctgaactggaccaccctgcagagactgaacgccggccagtggttcctgaagaccgaccccttctggaccgccagcagcctgagccccagcgaccacagagaggcccagaaccagagcatctgcagcctggccgagctgctggagctggccaagggcaacgccaccctgctgctgaacctgagagacccccccagagagcacccctacagaagcagcttcatcaacgtgaccctggaggccgtgctgcacagcggcttcccccagcaccaggtgatgtggctgcccagcagacagagacccctggtgagaaaggtggcccccggcttccagcagaccagcggcagcaaggaggccgtggccagcctgagaagaggccacatccagagactgaacctgagatacacccaggtgagcagacaggagctgagagactacgccagctggaacctgagcgtgaacctgtacaccgtgaacgccccctggctgttcagcctgctgtggtgcgccggcgtgcccagcgtgaccagcgacaacagccacgccctgagccaggtgcccagccccctgtggatcatgccccccgacgagtactgcctgatgtgggtgaccgccgacctggtgagcttcaccctgatcgtgggcatcttcgtgctgcagaagtggagactgggcggcatcagaagctacaaccccgagcagatcatgctgagcgccgccgtgagaagaaccagcagagacgtgagcatcatgaaggagaagctgatcttcagcgagatcagcgacggcgtggaggtgagcgacgtgctgagcgtgtgcagcgacaacagctacgacacctacgccaacagcaccgccacccccgtgggccccagaggcggcggcagccacaccaagaccctgatcgagagaagcggcagatag

SEQ ID NO: 83377 - DNA, 408 bp, Artificial Sequence
  Description of Artificial Sequence: Synthetic coding sequence
atggtgagacaccagcccctgcagtactacgagccccagctgtgcctgagctgcctgaccggcatctacggctgcagatggaagagataccagagaagccacgacgacaccaccccctgggagagactgtggttcctgctgctgaccttcaccttcggcctgaccctgacctggctgtacttctggtgggaggtgcacaacgactacgacgagttcaactggtacctgtacaacagaatgggctactggagcgactggcccgtgcccatcctggtgaccaccgccgccgccttcgcctacatcgccggcctgctggtgctggccctgtgccacatcgccgtgggccagcagatgaacctgcactggctgcacaaggccagcagcggcctgcccctgagccccctgtag

SEQ ID NO: 83378 - DNA, 1404 bp, Artificial Sequence
  Description of Artificial Sequence: Synthetic coding sequence
atgagcgccgtggcccagctgtgggaggacgagtgggaggtgctgctgatcagcctgcagggcaccgcccccttcctgcacgtgggcgccgtggccgccgtgaccatgctgagctggatcgtggccggccagttcgccagagccgagagaaccagcagccaggtgaccatcctgtgcaccttcttcaccgtggtgttcgccctgtacctggcccccctgaccatcagcagcccctgcatcatggagaagaaggacctgggccccaagcccgccctgatcggccacagaggcgcccccatgctggcccccgagcacaccctgatgagcttcagaaaggccctggagcagaagctgtacggcctgcaggccgacatcaccatcagcctggacggcgtgcccttcctgatgcacgacaccaccctgagaagaaccaccaacgtggaggaggagttccccgagctggccagaagacccgccagcatgctgaactggaccaccctgcagagactgaacgccggccagtggttcctgaagaccgaccccttctggaccgccagcagcctgagccccagcgaccacagagaggcccagaaccagagcatctgcagcctggccgagctgctggagctggccaagggcaacgccaccctgctgctgaacctgagagacccccccagagagcacccctacagaagcagcttcatcaacgtgaccctggaggccgtgctgcacagcggcttcccccagcaccaggtgatgtggctgcccagcagacagagacccctggtgagaaaggtggcccccggcttccagcagaccagcggcagcaaggaggccgtggccagcctgagaagaggccacatccagagactgaacctgagatacacccaggtgagcagacaggagctgagagactacgccagctggaacctgagcgtgaacctgtacaccgtgaacgccccctggctgttcagcctgctgtggtgcgccggcgtgcccagcgtgaccagcgacaacagccacgccctgagccaggtgcccagccccctgtggatcatgccccccgacgagtactgcctgatgtgggtgaccgccgacctggtgagcttcaccctgatcgtgggcatcttcgtgctgcagaagtggagactgggcggcatcagaagctacaaccccgagcagatcatgctgagcgccgccgtgagaagaaccagcagagacgtgagcatcatgaaggagaagctgatcttcagcgagatcagcgacggcgtggaggtgagcgacgtgctgagcgtgtgcagcgacaacagctacgacacctacgccaacagcaccgccacccccgtgggccccagaggcggcggcagccacaccaagaccctgatcgagagaagcggcagatag

SEQ ID NO: 83379 - DNA, 1818 bp, Artificial Sequence; identical to SEQ ID NO: 83375
  Description of Artificial Sequence: Synthetic coding sequence

SEQ ID NO: 83380 - DNA, 222 bp, Artificial Sequence
  Description of Artificial Sequence: Synthetic coding sequence
atggtgagacaccagcccctgcagtactacgagccccagctgtgcctgagctgcctgaccggcatctacggctgcagatggaagagataccagagaagccacgacgacaccaccccctgggagagactgtggttcctgctgctgaccttcaccttcggcctgaccctgacctggctgtacttctggtgggaggtgcacaacgactacgacgagttcaactag

SEQ ID NO: 83381 - DNA, 1461 bp, Artificial Sequence; identical to SEQ ID NO: 83376
  Description of Artificial Sequence: Synthetic coding sequence

SEQ ID NO: 83382 - DNA, 1083 bp, Artificial Sequence
  Description of Artificial Sequence: Synthetic coding sequence
atgagcttcagaaaggccctggagcagaagctgtacggcctgcaggccgacatcaccatcagcctggacggcgtgcccttcctgatgcacgacaccaccctgagaagaaccaccaacgtggaggaggagttccccgagctggccagaagacccgccagcatgctgaactggaccaccctgcagagactgaacgccggccagtggttcctgaagaccgaccccttctggaccgccagcagcctgagccccagcgaccacagagaggcccagaaccagagcatctgcagcctggccgagctgctggagctggccaagggcaacgccaccctgctgctgaacctgagagacccccccagagagcacccctacagaagcagcttcatcaacgtgaccctggaggccgtgctgcacagcggcttcccccagcaccaggtgatgtggctgcccagcagacagagacccctggtgagaaaggtggcccccggcttccagcagaccagcggcagcaaggaggccgtggccagcctgagaagaggccacatccagagactgaacctgagatacacccaggtgagcagacaggagctgagagactacgccagctggaacctgagcgtgaacctgtacaccgtgaacgccccctggctgttcagcctgctgtggtgcgccggcgtgcccagcgtgaccagcgacaacagccacgccctgagccaggtgcccagccccctgtggatcatgccccccgacgagtactgcctgatgtgggtgaccgccgacctggtgagcttcaccctgatcgtgggcatcttcgtgctgcagaagtggagactgggcggcatcagaagctacaaccccgagcagatcatgctgagcgccgccgtgagaagaaccagcagagacgtgagcatcatgaaggagaagctgatcttcagcgagatcagcgacggcgtggaggtgagcgacgtgctgagcgtgtgcagcgacaacagctacgacacctacgccaacagcaccgccacccccgtgggccccagaggcggcggcagccacaccaagaccctgatcgagagaagcggcagatag

SEQ ID NO: 83383 - DNA, 1272 bp, Artificial Sequence
  Description of Artificial Sequence: Synthetic coding sequence
atgctgagagtgagatgcctgagaggcggcagcagaggcgccgaggccgtgcactacatcggcagcagactgggcagaaccctgaccggctgggtgcagagaaccttccagagcacccaggccgccaccgccagcagcagaaacagctgcgccgccgacgacaaggccaccgagcccctgcccaaggactgccccgtgagcagctacaacgagtgggaccccctggaggaggtgatcgtgggcagagccgagaacgcctgcgtgccccccttcaccatcgaggtgaaggccaacacctacgagaagtactggcccttctaccagaagcagggcggccactacttccccaaggaccacctgaagaaggccgtggccgagatcgaggagatgtgcaacatcctgaagaccgagggcgtgaccgtgagaagacccgaccccatcgactggagcctgaagtacaagacccccgacttcgagagcaccggcctgtacagcgccatgcccagagacatcctgatcgtggtgggcaacgagatcatcgaggcccccatggcctggagaagcagattcttcgagtacagagcctacagaagcatcatcaaggactacttccacagaggcgccaagtggaccaccgcccccaagcccaccatggccgacgagctgtacaaccaggactaccccatccacagcgtggaggacagacacaagctggccgcccagggcaagttcgtgaccaccgagttcgagccctgcttcgacgccgccgacttcatcagagccggcagagacatcttcgcccagagaagccaggtgaccaactacctgggcatcgagtggatgagaagacacctggcccccgactacagagtgcacatcatcagcttcaaggaccccaaccccatgcacatcgacgccaccttcaacatcatcggccccggcatcgtgctgagcaaccccgacagaccctgccaccagatcgacctgttcaagaaggccggctggaccatcatcaccccccccacccccatcatccccgacgaccaccccctgtggatgagcagcaagtggctgagcatgaacgtgctgatgctggacgagaagagagtgatggtggacgccaacgaggtgcccatccagaagatgttcgagaagctgggcatcaccaccatcaaggtgaacatcagaaacgccaacagcctgggcggcggcttccactgctggacctgcgacgtgagaagaagaggcaccctgcagagctacctggactag

SEQ ID NO: 83384 - DNA, 1176 bp, Artificial Sequence
  Description of Artificial Sequence: Synthetic coding sequence
atgctgagagtgagatgcctgagaggcggcagcagaggcgccgaggccgtgcactacatcggcagcagactgggcagaaccctgaccggctgggtgcagagaaccttccagagcacccaggccgccaccgccagcagcagaaacagctgcgccgccgacgacaaggccaccgagcccctgcccaaggactgccccgtgagcagctacaacgagtgggaccccctggaggaggtgatcgtgggcagagccgagaacgcctgcgtgccccccttcaccatcgaggtgaaggccaacacctacgagaagtactggcccttctaccagaagcagggcggccactacttccccaaggaccacctgaagaaggccgtggccgagatcgaggagatgtgcaacatcctgaagaccgagggcgtgaccgtgagaagacccgaccccatcgactggagcctgaagtacaagacccccgacttcgagagcaccggcctgtacagcgccatgcccagagacatcctgatcgtggtgggcaacgagatcatcgaggcccccatggcctggagaagcagattcttcgagtacagagcctacagaagcatcatcaaggactacttccacagaggcgccaagtggaccaccgcccccaagcccaccatggccgacgagctgtacaaccaggactaccccatccacagcgtggaggacagacacaagctggccgcccagggcaagttcgtgaccaccgagttcgagccctgcttcgacgccgccgacttcatcagagccggcagagacatcttcgcccagagaagccaggtgaccaactacctgggcatcgagtggatgagaagacacctggcccccgactacagagtgcacatcatcagcttcaaggaccccaaccccatgcacatcgacgccaccttcaacatcatcggccccggcatcgtgctgagcaaccccgacagaccctgccaccagatcgacctgttcaagaaggccggctggaccatcatcaccccccccacccccatcatccccgacgaccaccccctgtggatgagcagcaagtggctgagcatgaacgtgctgatgctggacgagaagagagtgatggtggacgccaacgaggtgcccatccagaagatgttcgagaagctgggcatgtacaacaagtag

SEQ ID NO: 83385 - DNA, 1260 bp, Artificial Sequence
  Description of Artificial Sequence: Synthetic coding sequence
atgtggcccggcaacgcctggagagccgccctgttctgggtgcccagaggcagaagagcccagagcgccctggcccagctgagaggcatcctggagggcgagctggagggcatcagaggcgccggcacctggaagagcgagagagtgatcaccagcagacagggcccccacatcagagtggacggcgtgagcggcggcatcctgaacttctgcgccaacaactacctgggcctgagcagccaccccgaggtgatccaggccggcctgcaggccctggaggagttcggcgccggcctgagcagcgtgagattcatctgcggcacccagagcatccacaagaacctggaggccaagatcgccagattccaccagagagaggacgccatcctgtaccccagctgctacgacgccaacgccggcctgttcgaggccctgctgacccccgaggacgccgtgctgagcgacgagctgaaccacgccagcatcatcgacggcatcagactgtgcaaggcccacaagtacagatacagacacctggacatggccgacctggaggccaagctgcaggaggcccagaagcacagactgagactggtggccaccgacggcgccttcagcatggacggcgacatcgcccccctgcaggagatctgctgcctggccagcagatacggcgccctggtgttcatggacgagtgccacgccaccggcttcctgggccccaccggcagaggcaccgacgagctgctgggcgtgatggaccaggtgaccatcatcaacagcaccctgggcaaggccctgggcggcgccagcggcggctacaccaccggccccggccccctggtgagcctgctgagacagagagccagaccctacctgttcagcaacagcctgccccccgccgtggtgggctgcgccagcaaggccctggacctgctgatgggcagcaacaccatcgtgcagagcatggccgccaagacccagagattcagaagcaagatggaggccgccggcttcaccatcagcggcgccagccaccccatctgccccgtgatgctgggcgacgccagactggccagcagaatggccgacgacatgctgaagagaggcatcttcgtgatcggcttcagctaccccgtggtgcccaagggcaaggccagaatcagagtgcagatcagcgccgtgcacagcgaggaggacatcgacagatgcgtggaggccttcgtggaggtgggcagactgcacggcgccctgccctag

SEQ ID NO: 83386 - DNA, 1338 bp, Artificial Sequence
  Description of Artificial Sequence: Synthetic coding sequence
atgtggcccggcaacgcctggagagccgccctgttctgggtgcccagaggcagaagagcccagagcgccctggcccagctgagaggcatcctggagggcgagctggagggcatcagaggcgccggcacctggaagagcgagagagtgatcaccagcagacagggcccccacatcagagtggacggcgtgagcggcggccccggcaccgtgatcttccccggcctgcccctgccccacctgagctgctgcatccacctgctgagcttcaccagcggcatcctgaacttctgcgccaacaactacctgggcctgagcagccaccccgaggtgatccaggccggcctgcaggccctggaggagttcggcgccggcctgagcagcgtgagattcatctgcggcacccagagcatccacaagaacctggaggccaagatcgccagattccaccagagagaggacgccatcctgtaccccagctgctacgacgccaacgccggcctgttcgaggccctgctgacccccgaggacgccgtgctgagcgacgagctgaaccacgccagcatcatcgacggcatcagactgtgcaaggcccacaagtacagatacagacacctggacatggccgacctggaggccaagctgcaggaggcccagaagcacagactgagactggtggccaccgacggcgccttcagcatggacggcgacatcgcccccctgcaggagatctgctgcctggccagcagatacggcgccctggtgttcatggacgagtgccacgccaccggcttcctgggccccaccggcagaggcaccgacgagctgctgggcgtgatggaccaggtgaccatcatcaacagcaccctgggcaaggccctgggcggcgccagcggcggctacaccaccggccccggccccctggtgagcctgctgagacagagagccagaccctacctgttcagcaacagcctgccccccgccgtggtgggctgcgccagcaaggccctggacctgctgatgggcagcaacaccatcgtgcagagcatggccgccaagacccagagattcagaagcaagatggaggccgccggcttcaccatcagcggcgccagccaccccatctgccccgtgatgctgggcgacgccagactggccagcagaatggccgacgacatgctgaagagaggcatcttcgtgatcggcttcagctaccccgtggtgcccaagggcaaggccagaatcagagtgcagatcagcgccgtgcacagcgaggaggacatcgacagatgcgtggaggccttcgtggaggtgggcagactgcacggcgccctgccctag

SEQ ID NO: 83387 - DNA, 744 bp, Artificial Sequence
  Description of Artificial Sequence: Synthetic coding sequence
atgtggcccggcaacgcctggagagccgccctgttctgggtgcccagaggcagaagagcccagagcgccctggcccagctgagaggcatcctggagggcgagctggagggcatcagaggcgccggcacctggaagagcgagagagtgatcaccagcagacagggcccccacatcagagtggacggcgtgagcggcggccccggcaccgtgatcttccccggcctgcccctgccccacctgagctgctgcatccacctgctgagcttcaccagcggcatcctgaacttctgcgccaacaactacctgggcctgagcagccaccccgaggtgatccaggccggcctgcaggccctggaggagttcggcgccggcctgagcagcgtgagattcatctgcggcacccagagcatccacaagaacctggaggccaagatcgccagattccaccagagagaggacgccatcctgtaccccagctgctacgacgccaacgccggcctgttcgaggccctgctgacccccgaggacgccgtgctgagcgacgagctgaaccacgccagcatcatcgacggcatcagactgtgcaaggcccacaagtacagatacagacacctggacatggccgacctggaggccaagctgcaggaggcccagaagcacagactgagactggtggccaccgacggcgccttccacggctggagacacagaacccccgccggcgacctgctgcccagactgtag

SEQ ID NO: 83388 - DNA, 522 bp, Artificial Sequence
  Description of Artificial Sequence: Synthetic coding sequence
atggccctgagagtggtgagaagcgtgagagccctgctgtgcaccctgagagccgtgcccagccccgccgccccctgcccccccagaccctggcagctgggcgtgggcgccgtgagaaccctgagaaccggccccgccctgctgagcgtgagaaagttcaccgagaagcacgagtgggtgaccaccgagaacggcatcggcaccgtgggcatcagcaacttcgcccaggaggccctgggcgacgtggtgtactgcagcctgcccgaggtgggcaccaagctgaacaagcaggacgagttcggcgccctggagagcgtgaaggccgccagcgagctgtacagccccctgagcggcgaggtgaccgagatcaacgaggccctggccgagaaccccggcctggtgaacaagagctgctacgaggacggctggctgatcaagatgaccctgagcaaccccagcgagctggacgagctgatgagcgaggaggcctacgagaagtacatcaagagcatcgaggagtag

SEQ ID NO: 83389 - DNA, 3063 bp, Artificial Sequence
  Description of Artificial Sequence: Synthetic coding sequence
atgcagagctgcgccagagcctggggcctgagactgggcagaggcgtgggcggcggcagaagactggccggcggcagcggcccctgctgggcccccagaagcagagacagcagcagcggcggcggcgacagcgccgccgccggcgccagcagactgctggagagactgctgcccagacacgacgacttcgccagaagacacatcggccccggcgacaaggaccagagagagatgctgcagaccctgggcctggccagcatcgacgagctgatcgagaagaccgtgcccgccaacatcagactgaagagacccctgaagatggaggaccccgtgtgcgagaacgagatcctggccaccctgcacgccatcagcagcaagaaccagatctggagaagctacatcggcatgggctactacaactgcagcgtgccccagaccatcctgagaaacctgctggagaacagcggctggatcacccagtacaccccctaccagcccgaggtgagccagggcagactggagagcctgctgaactaccagaccatggtgtgcgacatcaccggcctggacatggccaacgccagcctgctggacgagggcaccgccgccgccgaggccctgcagctgtgctacagacacaacaagagaagaaagttcctggtggaccccagatgccacccccagaccatcgccgtggtgcagaccagagccaagtacaccggcgtgctgaccgagctgaagctgccctgcgagatggacttcagcggcaaggacgtgagcggcgtgctgttccagtaccccgacaccgagggcaaggtggaggacttcaccgagctggtggagagagcccaccagagcggcagcctggcctgctgcgccaccgacctgctggccctgtgcatcctgagaccccccggcgagttcggcgtggacatcgccctgggcagcagccagagattcggcgtgcccctgggctacggcggcccccacgccgccttcttcgccgtgagagagagcctggtgagaatgatgcccggcagaatggtgggcgtgaccagagacgccaccggcaaggaggtgtacagactggccctgcagaccagagagcagcacatcagaagagacaaggccaccagcaacatctgcaccgcccaggccctgctggccaacatggccgccatgttcgccatctaccacggcagccacggcctggagcacatcgccagaagagtgcacaacgccaccctgatcctgagcgagggcctgaagagagccggccaccagctgcagcacgacctgttcttcgacaccctgaagatccagtgcggctgcagcgtgaaggaggtgctgggcagagccgcccagagacagatcaacttcagactgttcgaggacggcaccctgggcatcagcctggacgagaccgtgaacgagaaggacctggacgacctgctgtggatcttcggctgcgagagcagcgccgagctggtggccgagagcatgggcgaggagtgcagaggcatccccggcagcgtgttcaagagaaccagccccttcctgacccaccaggtgttcaacagctaccacagcgagaccaacatcgtgagatacatgaagaagctggagaacaaggacatcagcctggtgcacagcatgatccccctgggcagctgcaccatgaagctgaacagcagcagcgagctggcccccatcacctggaaggagttcgccaacatccaccccttcgtgcccctggaccaggcccagggctaccagcagctgttcagagagctggagaaggacctgtgcgagctgaccggctacgaccaggtgtgcttccagcccaacagcggcgcccagggcgagtacgccggcctggccaccatcagagcctacctgaaccagaagggcgagggccacagaaccgtgtgcctgatccccaagagcgcccacggcaccaaccccgccagcgcccacatggccggcatgaagatccagcccgtggaggtggacaagtacggcaacatcgacgccgtgcacctgaaggccatggtggacaagcacaaggagaacctggccgccatcatgatcacctaccccagcaccaacggcgtgttcgaggagaacatcagcgacgtgtgcgacctgatccaccagcacggcggccaggtgtacctggacggcgccaacatgaacgcccaggtgggcatctgcagacccggcgacttcggcagcgacgtgagccacctgaacctgcacaagaccttctgcatcccccacggcggcggcggccccggcatgggccccatcggcgtgaagaagcacctggcccccttcctgcccaaccaccccgtgatcagcctgaagagaaacgaggacgcctgccccgtgggcaccgtgagcgccgccccctggggcagcagcagcatcctgcccatcagctgggcctacatcaagatgatgggcggcaagggcctgaagcaggccaccgagaccgccatcctgaacgccaactacatggccaagagactggagacccactacagaatcctgttcagaggcgccagaggctacgtgggccacgagttcatcctggacaccagacccttcaagaagagcgccaacatcgaggccgtggacgtggccaagagactgcaggactacggcttccacgcccccaccatgagctggcccgtggccggcaccctgatggtggagcccaccgagagcgaggacaaggccgagctggacagattctgcgacgccatgatcagcatcagacaggagatcgccgacatcgaggagggcagaatcgaccccagagtgaaccccctgaagatgagcccccacagcctgacctgcgtgaccagcagccactgggacagaccctacagcagagaggtggccgccttccccctgcccttcgtgaagcccgagaacaagttctggcccaccatcgccagaatcgacgacatctacggcgaccagcacctggtgtgcacctgcccccccatggaggtgtacgagagccccttcagcgagcagaagagagccagcagctag

SEQ ID NO: 83390 - DNA, 888 bp, Artificial Sequence
  Description of Artificial Sequence: Synthetic coding sequence
atggtggacagcgtgtacagaaccagaagcctgggcgtggccgccgagggcctgcccgaccagtacgccgacggcgaggccgccagagtgtggcagctgtacatcggcgacaccagaagcagaaccgccgagtacaaggcctggctgctgggcctgctgagacagcacggctgccagagagtgctggacgtggcctgcggcaccggcgtggacagcatcatgctggtggaggagggcttcagcgtgaccagcgtggacgccagcgacaagatgctgaagtacgccctgaaggagagatggaacagaagacacgagcccgccttcgacaagtgggtgatcgaggaggccaactggatgaccctggacaaggacgtgccccagagcgccgagggcggcttcgacgccgtgatctgcctgggcaacagcttcgcccacctgcccgactgcaagggcgaccagagcgagcacagactggccctgaagaacatcgccagcatggtgagagccggcggcctgctggtgatcgaccacagaaactacgaccacatcctgagcaccggctgcgccccccccggcaagaacatctactacaagagcgacctgaccaaggacgtgaccaccagcgtgctgatcgtgaacaacaaggcccacatggtgaccctggactacaccgtgcaggtgcccggcgccggccaggacggcagccccggcctgagcaagttcagactgagctactacccccactgcctggccagcttcaccgagctgctgcaggccgccttcggcggcaagtgccagcacagcgtgctgggcgacttcaagccctacaagcccggccagacctacatcccctgctacttcatccacgtgctgaagagaaccgactag

SEQ ID NO: 83391 - DNA, 1350 bp, Artificial Sequence
  Description of Artificial Sequence: Synthetic coding sequence
atgtacagcttcaacaccctgagactgtacctgtgggagaccatcgtgttcttcagcctggccgccagcaaggaggccgaggccgccagaagcgcccccaagcccatgagccccagcgacttcctggacaagctgatgggcagaaccagcggctacgacgccagaatcagacccaacttcaagggcccccccgtgaacgtgagctgcaacatcttcatcaacagcttcggcagcatcgccgagaccaccatggactacagagtgaacatcttcctgagacagcagtggaacgaccccagactggcctacaacgagtaccccgacgacagcctggacctggaccccagcatgctggacagcatctggaagcccgacctgttcttcgccaacgagaagggcgcccacttccacgagatcaccaccgacaacaagctgctgagaatcagcagaaacggcaacgtgctgtacagcatcagaatcaccctgaccctggcctgccccatggacctgaagaacttccccatggacgtgcagacctgcatcatgcagctggagagcttcggctacaccatgaacgacctgatcttcgagtggcaggagcagggcgccgtgcaggtggccgacggcctgaccctgccccagttcatcctgaaggaggagaaggacctgagatactgcaccaagcactacaacaccggcaagttcacctgcatcgaggccagattccacctggagagacagatgggctactacctgatccagatgtacatccccagcctgctgatcgtgatcctgagctggatcagcttctggatcaacatggacgccgcccccgccagagtgggcctgggcatcaccaccgtgctgaccatgaccacccagagcagcggcagcagagccagcctgcccaaggtgagctacgtgaaggccatcgacatctggatggccgtgtgcctgctgttcgtgttcagcgccctgctggagtacgccgccgtgaacttcgtgagcagacagcacaaggagctgctgagattcagaagaaagagaagacaccacaaggaggacgaggccggcgagggcagattcaacttcagcgcctacggcatgggccccgcctgcctgcaggccaaggacggcatcagcgtgaagggcgccaacaacagcaacaccaccaaccccccccccgcccccagcaagagccccgaggagatgagaaagctgttcatccagagagccaagaagatcgacaagatcagcagaatcggcttccccatggccttcctgatcttcaacatgttctactggatcatctacaagatcgtgagaagagaggacgtgcacaaccagtag

SEQ ID NO: 83392 - DNA, 1374 bp, Artificial Sequence
  Description of Artificial Sequence: Synthetic coding sequence
atgtacagcttcaacaccctgagactgtacctgtgggagaccatcgtgttcttcagcctggccgccagcaaggaggccgaggccgccagaagcgcccccaagcccatgagccccagcgacttcctggacaagctgatgggcagaaccagcggctacgacgccagaatcagacccaacttcaagggcccccccgtgaacgtgagctgcaacatcttcatcaacagcttcggcagcatcgccgagaccaccatggactacagagtgaacatcttcctgagacagcagtggaacgaccccagactggcctacaacgagtaccccgacgacagcctggacctggaccccagcatgctggacagcatctggaagcccgacctgttcttcgccaacgagaagggcgcccacttccacgagatcaccaccgacaacaagctgctgagaatcagcagaaacggcaacgtgctgtacagcatcagaatcaccctgaccctggcctgccccatggacctgaagaacttccccatggacgtgcagacctgcatcatgcagctggagagcttcggctacaccatgaacgacctgatcttcgagtggcaggagcagggcgccgtgcaggtggccgacggcctgaccctgccccagttcatcctgaaggaggagaaggacctgagatactgcaccaagcactacaacaccggcaagttcacctgcatcgaggccagattccacctggagagacagatgggctactacctgatccagatgtacatccccagcctgctgatcgtgatcctgagctggatcagcttctggatcaacatggacgccgcccccgccagagtgggcctgggcatcaccaccgtgctgaccatgaccacccagagcagcggcagcagagccagcctgcccaaggtgagctacgtgaaggccatcgacatctggatggccgtgtgcctgctgttcgtgttcagcgccctgctggagtacgccgccgtgaacttcgtgagcagacagcacaaggagctgctgagattcagaagaaagagaagacaccacaagagccccatgctgaacctgttccaggaggacgaggccggcgagggcagattcaacttcagcgcctacggcatgggccccgcctgcctgcaggccaaggacggcatcagcgtgaagggcgccaacaacagcaacaccaccaaccccccccccgcccccagcaagagccccgaggagatgagaaagctgttcatccagagagccaagaagatcgacaagatcagcagaatcggcttccccatggccttcctgatcttcaacatgttctactggatcatctacaagatcgtgagaagagaggacgtgcacaaccagtag

SEQ ID NO: 83393 - DNA, 1101 bp, Artificial Sequence
  Description of Artificial Sequence: Synthetic coding sequence
atggactacagagtgaacatcttcctgagacagcagtggaacgaccccagactggcctacaacgagtaccccgacgacagcctggacctggaccccagcatgctggacagcatctggaagcccgacctgttcttcgccaacgagaagggcgcccacttccacgagatcaccaccgacaacaagctgctgagaatcagcagaaacggcaacgtgctgtacagcatcagaatcaccctgaccctggcctgccccatggacctgaagaacttccccatggacgtgcagacctgcatcatgcagctggagagcttcggctacaccatgaacgacctgatcttcgagtggcaggagcagggcgccgtgcaggtggccgacggcctgaccctgccccagttcatcctgaaggaggagaaggacctgagatactgcaccaagcactacaacaccggcaagttcacctgcatcgaggccagattccacctggagagacagatgggctactacctgatccagatgtacatccccagcctgctgatcgtgatcctgagctggatcagcttctggatcaacatggacgccgcccccgccagagtgggcctgggcatcaccaccgtgctgaccatgaccacccagagcagcggcagcagagccagcctgcccaaggtgagctacgtgaaggccatcgacatctggatggccgtgtgcctgctgttcgtgttcagcgccctgctggagtacgccgccgtgaacttcgtgagcagacagcacaaggagctgctgagattcagaagaaagagaagacaccacaaggaggacgaggccggcgagggcagattcaacttcagcgcctacggcatgggccccgcctgcctgcaggccaaggacggcatcagcgtgaagggcgccaacaacagcaacaccaccaaccccccccccgcccccagcaagagccccgaggagatgagaaagctgttcatccagagagccaagaagatcgacaagatcagcagaatcggcttccccatggccttcctgatcttcaacatgttctactggatcatctacaagatcgtgagaagagaggacgtgcacaaccagtag

SEQ ID NO: 83394 - DNA, 309 bp, Artificial Sequence
  Description of Artificial Sequence: Synthetic coding sequence
atgagcgccagagtgagaagcagaagcagaggcagaggcgacggccaggaggcccccgacgtggtggccttcgtggcccccggcgagagccagcaggaggagccccccaccgacaaccaggacatcgagcccggccaggagagagagggcaccccccccatcgaggagagaaaggtggagggcgactgccaggagatggacctggagaagaccagaagcgagagaggcgacggcagcgacgtgaaggagaagaccccccccaaccccaagcacgccaagaccaaggaggccggcgacggccagccctag

SEQ ID NO: 83395 - DNA, 1359 bp, Artificial Sequence
  Description of Artificial Sequence: Synthetic coding sequence
atgaacagacagctggtgaacatcctgaccgccctgttcgccttcttcctggagaccaaccacttcagaaccgccttctgcaaggaccacgacagcagaagcggcaagcagcccagccagaccctgagccccagcgacttcctggacaagctgatgggcagaaccagcggctacgacgccagaatcagacccaacttcaagggcccccccgtgaacgtgacctgcaacatcttcatcaacagcttcggcagcatcgccgagaccaccatggactacagagtgaacatcttcctgagacagcagtggaacgacagcagactggcctacagcgagtaccccgacgacagcctggacctggaccccagcatgctggacagcatctggaagcccgacctgttcttcgccaacgagaagggcgccaacttccacgacgtgaccaccgacaacaagctgctgagaatcagcaagaacggcaaggtgctgtacagcatcagactgaccctgaccctgagctgccccatggacctgaagaacttccccatggacgtgcagacctgcaccatgcagctggagagcttcggctacaccatgaacgacctgatcttcgagtggctgagcgacggccccgtgcaggtggccgagggcctgaccctgccccagttcatcctgaaggaggagaaggagctgggctactgcaccaagcactacaacaccggcaagttcacctgcatcgaggtgaagttccacctggagagacagatgggctactacctgatccagatgtacatccccagcctgctgatcgtgatcctgagctgggtgagcttctggatcaacatggacgccgcccccgccagagtggccctgggcatcaccaccgtgctgaccatgaccacccagagcagcggcagcagagccagcctgcccaaggtgagctacgtgaaggccatcgacatctggatggccgtgtgcctgctgttcgtgttcgccgccctgctggagtacgccgccgtgaacttcgtgagcagacagcacaaggagttcctgagactgagaagaagacagaagagacagaacaaggaggaggacgtgaccagagagagcagattcaacttcagcggctacggcatgggccactgcctgcaggtgaaggacggcaccgccgtgaaggccacccccgccaaccccctgccccagccccccaaggacggcgacgccatcaagaagaagttcgtggacagagccaagagaatcgacaccatcagcagagccgccttccccctggccttcctgatcttcaacatcttctactggatcacctacaagatcatcagacacgaggacgtgcacaagaagtag

SEQ ID NO: 83396 - DNA, 648 bp, Artificial Sequence
  Description of Artificial Sequence: Synthetic coding sequence
atgaacctgcacatgagaatgaccgccttctgcaaggaccacgacagcagaagcggcaagcagcccagccagaccctgagccccagcgacttcctggacaagctgatgggcagaaccagcggctacgacgccagaatcagacccaacttcaagggcccccccgtgaacgtgacctgcaacatcttcatcaacagcttcggcagcgtgaccgagaccaccatggactacagagtgaacatcttcctgagacagcagtggaacgacagcagactggcctacagcgagtaccccgacgacagcctggacctggaccccagcatgctggacagcatctggaagcccgacctgttcttcgccaacgagaagggcgccaacttccacgacgtgaccaccgacaacaagctgctgagaatcagcaagaacggcaaggtgctgtacagcatcagactgaccctgaccctgagctgccccatggacctgaagaacttccccatggacgtgcagacctgcaccatgcagctggagagcttcggctacaccatgaacgacctgatcttcgagtggctgagcgacggccccgtgcaggtggccgagggcctgaccctgccccagttcatcctgaaggaggagaaggagctgggctactag

SEQ ID NO: 83397 - DNA, 1092 bp, Artificial Sequence
  Description of Artificial Sequence: Synthetic coding sequence
atggactacagagtgaacatcttcctgagacagcagtggaacgacagcagactggcctacagcgagtaccccgacgacagcctggacctggaccccagcatgctggacagcatctggaagcccgacctgttcttcgccaacgagaagggcgccaacttccacgacgtgaccaccgacaacaagctgctgagaatcagcaagaacggcaaggtgctgtacagcatcagactgaccctgaccctgagctgccccatggacctgaagaacttccccatggacgtgcagacctgcaccatgcagctggagagcttcggctacaccatgaacgacctgatcttcgagtggctgagcgacggccccgtgcaggtggccgagggcctgaccctgccccagttcatcctgaaggaggagaaggagctgggctactgcaccaagcactacaacaccggcaagttcacctgcatcgaggtgaagttccacctggagagacagatgggctactacctgatccagatgtacatccccagcctgctgatcgtgatcctgagctgggtgagcttctggatcaacatggacgccgcccccgccagagtggccctgggcatcaccaccgtgctgaccatgaccacccagagcagcggcagcagagccagcctgcccaaggtgagctacgtgaaggccatcgacatctggatggccgtgtgcctgctgttcgtgttcgccgccctgctggagtacgccgccgtgaacttcgtgagcagacagcacaaggagttcctgagactgagaagaagacagaagagacagaacaaggaggaggacgtgaccagagagagcagattcaacttcagcggctacggcatgggccactgcctgcaggtgaaggacggcaccgccgtgaaggccacccccgccaaccccctgccccagccccccaaggacggcgacgccatcaagaagaagttcgtggacagagccaagagaatcgacaccatcagcagagccgccttccccctggccttcctgatcttcaacatcttctactggatcacctacaagatcatcagacacgaggacgtgcacaagaagtag

SEQ ID NO: 83398 - DNA, 1395 bp, Artificial Sequence
  Description of Artificial Sequence: Synthetic coding sequence
atggcccacgtgagacacttcagaaccctggtgagcggcttctacttctgggaggccgccctgctgctgagcctggtggccaccaaggagaccgacagcgccagaagcagaagcgcccccatgagccccagcgacttcctggacaagctgatgggcagaaccagcggctacgacgccagaatcagacccaacttcaagggcccccccgtgaacgtgacctgcaacatcttcatcaacagcttcggcagcatcgccgagaccaccatggactacagagtgaacatcttcctgagacagaagtggaacgaccccagactggcctacagcgagtaccccgacgacagcctggacctggaccccagcatgctggacagcatctggaagcccgacctgttcttcgccaacgagaagggcgccaacttccacgaggtgaccaccgacaacaagctgctgagaatcttcaagaacggcaacgtgctgtacagcatcagactgaccctgaccctgagctgccccatggacctgaagaacttccccatggacgtgcagacctgcatcatgcagctggagagcttcggctacaccatgaacgacctgatcttcgagtggcaggacgaggcccccgtgcaggtggccgagggcctgaccctgccccagttcctgctgaaggaggagaaggacctgagatactgcaccaagcactacaacaccggcaagttcacctgcatcgaggtgagattccacctggagagacagatgggctactacctgatccagatgtacatccccagcctgctgatcgtgatcctgagctgggtgagcttctggatcaacatggacgccgcccccgccagagtggccctgggcatcaccaccgtgctgaccatgaccacccagagcagcggcagcagagccagcctgcccaaggtgagctacgtgaaggccatcgacatctggatggccgtgtgcctgctgttcgtgttcagcgccctgctggagtacgccgccgtgaacttcgtgagcagacagcacaaggagctgctgagattcagaagaaagagaaagaacaagaccgaggccttcgccctggagaagttctacagattcagcgacatggacgacgaggtgagagagagcagattcagcttcaccgcctacggcatgggcccctgcctgcaggccaaggacggcatgacccccaagggccccaaccaccccgtgcaggtgatgcccaagagccccgacgagatgagaaaggtgttcatcgacagagccaagaagatcgacaccatcagcagagcctgcttccccctggccttcctgatcttcaacatcttctactgggtgatctacaagatcctgagacacgaggacatccaccagcagcaggactag

SEQ ID NO: 83399 - DNA, 1350 bp, Artificial Sequence
  Description of Artificial Sequence: Synthetic coding sequence
atggcccacgtgagacacttcagaaccctggtgagcggcttctacttctgggaggccgccctgctgctgagcctggtggccaccaaggagaccgacagcgccagaagcagaagcgcccccatgagccccagcgacttcctggacaagctgatgggcagaaccagcggctacgacgccagaatcagacccaacttcaagggcccccccgtgaacgtgacctgcaacatcttcatcaacagcttcggcagcatcgccgagaccaccatggactacagagtgaacatcttcctgagacagaagtggaacgaccccagactggcctacagcgagtaccccgacgacagcctggacctggaccccagcatgctggacagcatctggaagcccgacctgttcttcgccaacgagaagggcgccaacttccacgaggtgaccaccgacaacaagctgctgagaatcttcaagaacggcaacgtgctgtacagcatcagactgaccctgaccctgagctgccccatggacctgaagaacttccccatggacgtgcagacctgcatcatgcagctggagagcttcggctacaccatgaacgacctgatcttcgagtggcaggacgaggcccccgtgcaggtggccgagggcctgaccctgccccagttcctgctgaaggaggagaaggacctgagatactgcaccaagcactacaacaccggcaagttcacctgcatcgaggtgagattccacctggagagacagatgggctactacctgatccagatgtacatccccagcctgctgatcgtgatcctgagctgggtgagcttctggatcaacatggacgccgcccccgccagagtggccctgggcatcaccaccgtgctgaccatgaccacccagagcagcggcagcagagccagcctgcccaaggtgagctacgtgaaggccatcgacatctggatggccgtgtgcctgctgttcgtgttcagcgccctgctggagtacgccgccgtgaacttcgtgagcagacagcacaaggagctgctgagattcagaagaaagagaaagaacaaggacgacgaggtgagagagagcagattcagcttcaccgcctacggcatgggcccctgcctgcaggccaaggacggcatgacccccaagggccccaaccaccccgtgcaggtgatgcccaagagccccgacgagatgagaaaggtgttcatcgacagagccaagaagatcgacaccatcagcagagcctgcttccccctggccttcctgatcttcaacatcttctactgggtgatctacaagatcctgagacacgaggacatccaccagcagcaggactag

SEQ ID NO: 83400 - DNA, 1494 bp, Artificial Sequence
  Description of Artificial Sequence: Synthetic coding sequence
atgaagttcctgctgaccaccgccttcctgatcctgatcagcctgtgggtggaggaggcctacagcaaggagaagagcagcaagaagggcaagggcaagaagaagcagtacctgtgccccagccagcagagcgccgaggacctggccagagtgcccgccaacagcaccagcaacatcctgaacagactgctggtgagctacgaccccagaatcagacccaacttcaagggcatccccgtggacgtggtggtgaacatcttcatcaacagcttcggcagcatccaggagaccaccatggactacagagtgaacatcttcctgagacagaagtggaacgaccccagactgaagctgcccagcgacttcagaggcagcgacgccctgaccgtggaccccaccatgtacaagtgcctgtggaagcccgacctgttcttcgccaacgagaagagcgccaacttccacgacgtgacccaggagaacatcctgctgttcatcttcagagacggcgacgtgctggtgagcatgagactgagcatcaccctgagctgccccctggacctgaccctgttccccatggacacccagagatgcaagatgcagctggagagcttcggctacaccaccgacgacctgagattcatctggcagagcggcgaccccgtgcagctggagaagatcgccctgccccagttcgacatcaagaaggaggacatcgagtacggcaactgcaccaagtactacaagggcaccggctactacacctgcgtggaggtgatcttcaccctgagaagacaggtgggcttctacatgatgggcgtgtacgcccccaccctgctgatcgtggtgctgagctggctgagcttctggatcaaccccgacgccagcgccgccagagtgcccctgggcatcttcagcgtgctgagcctggccagcgagtgcaccaccctggccgccgagctgcccaaggtgagctacgtgaaggccctggacgtgtggctgatcgcctgcctgctgttcggcttcgccagcctggtggagtacgccgtggtgcaggtgatgctgaacaaccccaagagagtggaggccgagaaggccagaatcgccaaggccgagcaggccgacggcaagggcggcaacgtggccaagaagaacaccgtgaacggcaccggcacccccgtgcacatcagcaccctgcaggtgggcgagaccagatgcaagaaggtgtgcaccagcaagagcgacctgagaagcaacgacttcagcatcgtgggcagcctgcccagagacttcgagctgagcaactacgactgctacggcaagcccatcgaggtgaacaacggcctgggcaagagccaggccaagaacaacaagaagcccccccccgccaagcccgtgatccccaccgccgccaagagaatcgacctgtacgccagagccctgttccccttctgcttcctgttcttcaacgtgatctactggagcatctacctgtag

SEQ ID NO: 83401 - DNA, 1494 bp, Artificial Sequence; identical to SEQ ID NO: 83400
  Description of Artificial Sequence: Synthetic coding sequence

SEQ ID NO: 83402 - DNA, 912 bp, Artificial Sequence
  Description of Artificial Sequence: Synthetic coding sequence
atgaagttcctgctgaccaccgccttcctgatcctgatcagcctgtgggtggaggaggcctacagcaaggagaagagcagcaagaagggcaagggcaagaagaagcagtacctgtgccccagccagcagagcgccgaggacctggccagagtgcccgccaacagcaccagcaacatcctgaacagactgctggtgagctacgaccccagaatcagacccaacttcaagggcatccccgtggacgtggtggtgaacatcttcatcaacagcttcggcagcatccaggagaccaccatggactacagagtgaacatcttcctgagacagaagtggaacgaccccagactgaagctgcccagcgacttcagaggcagcgacgccctgaccgtggaccccaccatgtacaagtgcctgtggaagcccgacctgttcttcgccaacgagaagagcgccaacttccacgacgtgacccaggagaacatcctgctgttcatcttcagagacggcgacgtgctggtgagcatgagactgagcatcaccctgagctgccccctggacctgaccctgttccccatggacacccagagatgcaagatgcagctggagagcttcggctacaccaccgacgacctgagattcatctggcagagcggcgaccccgtgcagctggagaagatcgccctgccccagttcgacatcaagaaggaggacatcgagtacggcaactgcaccaagtactacaagggcaccggctactacacctgcgtggaggtgatcttcaccctgagaagacaggtgggcttctacatgatgggcgtgtacgcccccaccctgctgatcgtggtgctgagctggctgagcttctggatcaaccccgacgccagcgccgccagagtgcccctgggctggtag

SEQ ID NO: 83403 - DNA, 492 bp, Artificial Sequence
  Description of Artificial Sequence: Synthetic coding sequence
atgatgctgcccctgcagggcgcccagatgctgcagatgctggagaagagcctgagaaagagcctgcccgccagcctgaaggtgtacggcaccgtgttccacatcaaccacggcaaccccttcaacctgaaggccgtggtggacaagtggcccgacttcaacaccgtggtggtgtgcccccaggagcaggacatgaccgacgacctggaccactacaccaacacctaccagatctacagcaaggacccccagaactgccaggagttcctgggcagccccgagctgatcaactggaagcagcacctgcagatccagagcagccagcccagcctgaacgaggccatccagaacctggccgccatcaagagcttcaaggtgaagcagacccagagaatcctgtacatggccgccgagaccgccaaggagctgacccccttcctgctgaagagcaagatcctgagccccaacggcggcaagcccaaggccatgtag

SEQ ID NO: 83404 - DNA, 891 bp, Artificial Sequence
  Description of Artificial Sequence: Synthetic coding sequence
atgatgctgcccctgcagggcgcccagatgctgcagatgctggagaagagcctgagaaagagcctgcccgccagcctgaaggtgtacggcaccgtgttccacatcaaccacggcaaccccttcaacctgaaggccgtggtggacaagtggcccgacttcaacaccgtggtggtgtgcccccaggagcaggacatgaccgacgacctggaccactacaccaacacctaccagatctacagcaaggacccccagaactgccaggagttcctgggcagccccgagctgatcaactggaagcagcacctgcagatccagagcagccagcccagcctgaacgaggccatccagaacctggccgccatcaagagcttcaaggtgaagcagacccagagaatcctgtacatggccgccgagaccgccaaggagctgacccccttcctgctgaagagcaagatcctgagccccaacggcggcaagcccaaggccatcaaccaggagatgttcaagctgagcagcatggacgtgacccacgcccacctggtgaacaagttctggcacttcggcggcaacgagagaagccagagattcatcgagagatgcatccagaccttccccacctgctgcctgctgggccccgagggcacccccgtgtgctgggacctgatggaccagaccggcgagatgagaatggccggcaccctgcccgagtacagactgcacggcctggtgacctacgtgatctacagccacgcccagaagctgggcaagctgggcttccccgtgtacagccacgtggactacagcaacgaggccatgcagaagatgagctacaccctgcagcacgtgcccatccccagaagctggaaccagtggaactgcgtgcccctgtag

SEQ ID NO: 83405 - DNA, 891 bp, Artificial Sequence; identical to SEQ ID NO: 83404
  Description of Artificial Sequence: Synthetic coding sequence

SEQ ID NO: 83406 - DNA, 2022 bp, Artificial Sequence
  Description of Artificial Sequence: Synthetic coding sequence
atgcccctgaacagaaccctgagcatgagcagcctgcccggcctggaggactgggaggacgagttcgacctggagaacgccgtgctgttcgaggtggcctgggaggtggccaacaaggtgggcggcatctacaccgtgctgcagaccaaggccaaggtgaccggcgacgagtggggcgacaactacttcctggtgggcccctacaccgagcagggcgtgagaacccaggtggagctgctggaggcccccacccccgccctgaagagaaccctggacagcatgaacagcaagggctgcaagttcctggcccagagcgaggagaagccccacgtggtggcccacttccacgagtggctggccggcgtgggcctgtgcctgtgcagagccagaagactgcccgtggccaccatcttcaccacccacgccaccctgctgggcagatacctgtgcgccggcgccgtggacttctacaacaacctggagaacttcaacgtggacaaggaggccggcgagagacagatctaccacagatactgcatggagagagccgccgcccactgcgcccacgtgttcaccaccgtgagccagatcaccgccatcgaggcccagcacctgctgaagagaaagcccgacatcgtgacccccaacggcctgaacgtgaagaagttcagcgccatgcacgagttccagaacctgcacgcccagagcaaggccagaatccaggagttcgtgagaggccacttctacggccacctggacttcaacctggacaagaccctgtacttcttcatcgccggcagatacgagttcagcaacaagggcgccgacgtgttcctggaggccctggccagactgaactacctgctgagagtgaacggcagcgagcagaccgtggtggccttcttcatcatgcccgccagaaccaacaacttcaacgtggagaccctgaagggccaggccgtgagaaagcagctgtgggacaccgccaacaccgtgaaggagaagttcggcagaaagctgtacgagagcctgctggtgggcagcctgcccgacatgaacaagatgctggacaaggaggacttcaccatgatgaagagagccatcttcgccacccagagacagagcttcccccccgtgtgcacccacaacatgctggacgacagcagcgaccccatcctgaccaccatcagaagaatcggcctgttcaacagcagcgccgacagagtgaaggtgatcttccaccccgagttcctgagcagcaccagccccctgctgcccgtggactacgaggagttcgtgagaggctgccacctgggcgtgttccccagctactacgagccctggggctacacccccgccgagtgcaccgtgatgggcatccccagcatcagcaccaacctgagcggcttcggctgcttcatggaggagcacatcgccgaccccagcgcctacggcatctacatcctggacagaagattcagaagcctggacgacagctgcagccagctgaccagcttcctgtacagcttctgccagcagagcagaagacagagaatcatccagagaaacagaaccgagagactgagcgacctgctggactggaagtacctgggcagatactacatgagcgccagacacatggccctgagcaaggccttccccgagcacttcacctacgagcccaacgaggccgacgccgcccagggctacagataccccagacccgccagcgtgccccccagccccagcctgagcagacacagcagcccccaccagagcgaggacgaggaggaccccagaaacggccccctggaggaggacggcgagagatacgacgaggacgaggaggccgccaaggacagaagaaacatcagagcccccgagtggcccagaagagccagctgcaccagcagcaccagcggcagcaagagaaacagcgtggacaccgccaccagcagcagcctgagcacccccagcgagcccctgagccccaccagcagcctgggcgaggagagaaactag

SEQ ID NO: 83407 - DNA, 2214 bp, Artificial Sequence
  Description of Artificial Sequence: Synthetic coding sequence
atgcccctgaacagaaccctgagcatgagcagcctgcccggcctggaggactgggaggacgagttcgacctggagaacgccgtgctgttcgaggtggcctgggaggtggccaacaaggtgggcggcatctacaccgtgctgcagaccaaggccaaggtgaccggcgacgagtggggcgacaactacttcctggtgggcccctacaccgagcagggcgtgagaacccaggtggagctgctggaggcccccacccccgccctgaagagaaccctggacagcatgaacagcaagggctgcaaggtgtacttcggcagatggctgatcgagggcggccccctggtggtgctgctggacgtgggcgccagcgcctgggccctggagagatggaagggcgagctgtgggacacctgcaacatcggcgtgccctggtacgacagagaggccaacgacgccgtgctgttcggcttcctgaccacctggttcctgggcgagttcctggcccagagcgaggagaagccccacgtggtggcccacttccacgagtggctggccggcgtgggcctgtgcctgtgcagagccagaagactgcccgtggccaccatcttcaccacccacgccaccctgctgggcagatacctgtgcgccggcgccgtggacttctacaacaacctggagaacttcaacgtggacaaggaggccggcgagagacagatctaccacagatactgcatggagagagccgccgcccactgcgcccacgtgttcaccaccgtgagccagatcaccgccatcgaggcccagcacctgctgaagagaaagcccgacatcgtgacccccaacggcctgaacgtgaagaagttcagcgccatgcacgagttccagaacctgcacgcccagagcaaggccagaatccaggagttcgtgagaggccacttctacggccacctggacttcaacctggacaagaccctgtacttcttcatcgccggcagatacgagttcagcaacaagggcgccgacgtgttcctggaggccctggccagactgaactacctgctgagagtgaacggcagcgagcagaccgtggtggccttcttcatcatgcccgccagaaccaacaacttcaacgtggagaccctgaagggccaggccgtgagaaagcagctgtgggacaccgccaacaccgtgaaggagaagttcggcagaaagctgtacgagagcctgctggtgggcagcctgcccgacatgaacaagatgctggacaaggaggacttcaccatgatgaagagagccatcttcgccacccagagacagagcttcccccccgtgtgcacccacaacatgctggacgacagcagcgaccccatcctgaccaccatcagaagaatcggcctgttcaacagcagcgccgacagagtgaaggtgatcttccaccccgagttcctgagcagcaccagccccctgctgcccgtggactacgaggagttcgtgagaggctgccacctgggcgtgttccccagctactacgagccctggggctacacccccgccgagtgcaccgtgatgggcatccccagcatcagcaccaacctgagcggcttcggctgcttcatggaggagcacatcgccgaccccagcgcctacggcatctacatcctggacagaagattcagaagcctggacgacagctgcagccagctgaccagcttcctgtacagcttctgccagcagagcagaagacagagaatcatccagagaaacagaaccgagagactgagcgacctgctggactggaagtacctgggcagatactacatgagcgccagacacatggccctgagcaaggccttccccgagcacttcacctacgagcccaacgaggccgacgccgcccagggctacagataccccagacccgccagcgtgccccccagccccagcctgagcagacacagcagcccccaccagagcgaggacgaggaggaccccagaaacggccccctggaggaggacggcgagagatacgacgaggacgaggaggccgccaaggacagaagaaacatcagagcccccgagtggcccagaagagccagctgcaccagcagcaccagcggcagcaagagaaacagcgtggacaccgccaccagcagcagcctgagcacccccagcgagcccctgagccccaccagcagcctgggcgaggagagaaactag

SEQ ID NO: 83408 - DNA, 708 bp, Artificial Sequence
  Description of Artificial Sequence: Synthetic coding sequence
atgaacagcacctggagaacccagtgcagcagcaagtggcccggcagatggctgaccagagtgtacttcggcagatggctgatcgagggcggccccctggtggtgctgctggacgtgggcgccagcgcctgggccctggagagatggaagggcgagctgtgggacacctgcaacatcggcgtgccctggtacgacagagaggccaacgacgccgtgctgttcggcttcctgaccacctggttcctgggcgagttcctggcccagagcgaggagaagccccacgtggtggcccacttccacgagtggctggccggcgtgggcctgtgcctgtgcagagccagaagactgcccgtggccaccatcttcaccacccacgccaccctgctgggcagatacctgtgcgccggcgccgtggacttctacaacaacctggagaacttcaacgtggacaaggaggccggcgagagacagatctaccacagatactgcatggagagagccgccgcccactgcgcccacgtgttcaccaccgtgagccagatcaccgccatcgaggcccagcacctgctgaagagaaagcccggcatctggaccagcacctggaccagaccctacaccagcctgagccccgccgccatgagcagccccaccagagtgctgaccagcagctggagacactggctgggcagcaccatctgcagcgagtag

SEQ ID NO: 83409 - DNA, 1974 bp, Artificial Sequence
  Description of Artificial Sequence: Synthetic coding sequence
atgaacagcacctggagaacccagtgcagcagcaagtggcccggcagatggctgaccagagtgtacttcggcagatggctgatcgagggcggccccctggtggtgctgctggacgtgggcgccagcgcctgggccctggagagatggaagggcgagctgtgggacacctgcaacatcggcgtgccctggtacgacagagaggccaacgacgccgtgctgttcggcttcctgaccacctggttcctgggcgagttcctggcccagagcgaggagaagccccacgtggtggcccacttccacgagtggctggccggcgtgggcctgtgcctgtgcagagccagaagactgcccgtggccaccatcttcaccacccacgccaccctgctgggcagatacctgtgcgccggcgccgtggacttctacaacaacctggagaacttcaacgtggacaaggaggccggcgagagacagatctaccacagatactgcatggagagagccgccgcccactgcgcccacgtgttcaccaccgtgagccagatcaccgccatcgaggcccagcacctgctgaagagaaagcccgacatcgtgacccccaacggcctgaacgtgaagaagttcagcgccatgcacgagttccagaacctgcacgcccagagcaaggccagaatccaggagttcgtgagaggccacttctacggccacctggacttcaacctggacaagaccctgtacttcttcatcgccggcagatacgagttcagcaacaagggcgccgacgtgttcctggaggccctggccagactgaactacctgctgagagtgaacggcagcgagcagaccgtggtggccttcttcatcatgcccgccagaaccaacaacttcaacgtggagaccctgaagggccaggccgtgagaaagcagctgtgggacaccgccaacaccgtgaaggagaagttcggcagaaagctgtacgagagcctgctggtgggcagcctgcccgacatgaacaagatgctggacaaggaggacttcaccatgatgaagagagccatcttcgccacccagagacagagcttcccccccgtgtgcacccacaacatgctggacgacagcagcgaccccatcctgaccaccatcagaagaatcggcctgttcaacagcagcgccgacagagtgaaggtgatcttccaccccgagttcctgagcagcaccagccccctgctgcccgtggactacgaggagttcgtgagaggctgccacctgggcgtgttccccagctactacgagccctggggctacacccccgccgagtgcaccgtgatgggcatccccagcatcagcaccaacctgagcggcttcggctgcttcatggaggagcacatcgccgaccccagcgcctacggcatctacatcctggacagaagattcagaagcctggacgacagctgcagccagctgaccagcttcctgtacagcttctgccagcagagcagaagacagagaatcatccagagaaacagaaccgagagactgagcgacctgctggactggaagtacctgggcagatactacatgagcgccagacacatggccctgagcaaggccttccccgagcacttcacctacgagcccaacgaggccgacgccgcccagggctacagataccccagacccgccagcgtgccccccagccccagcctgagcagacacagcagcccccaccagagcgaggacgaggaggaccccagaaacggccccctggaggaggacggcgagagatacgacgaggacgaggaggccgccaaggacagaagaaacatcagagcccccgagtggcccagaagagccagctgcaccagcagcaccagcggcagcaagagaaacagcgtggacaccgccaccagcagcagcctgagcacccccagcgagcccctgagccccaccagcagcctgggcgaggagagaaactag

SEQ ID NO: 83410 - DNA, 1113 bp, Artificial Sequence
  Description of Artificial Sequence: Synthetic coding sequence
atgcccgccagaaccaacaacttcaacgtggagaccctgaagggccaggccgtgagaaagcagctgtgggacaccgccaacaccgtgaaggagaagttcggcagaaagctgtacgagagcctgctggtgggcagcctgcccgacatgaacaagatgctggacaaggaggacttcaccatgatgaagagagccatcttcgccacccagagacagagcttcccccccgtgtgcacccacaacatgctggacgacagcagcgaccccatcctgaccaccatcagaagaatcggcctgttcaacagcagcgccgacagagtgaaggtgatcttccaccccgagttcctgagcagcaccagccccctgctgcccgtggactacgaggagttcgtgagaggctgccacctgggcgtgttccccagctactacgagccctggggctacacccccgccgagtgcaccgtgatgggcatccccagcatcagcaccaacctgagcggcttcggctgcttcatggaggagcacatcgccgaccccagcgcctacggcatctacatcctggacagaagattcagaagcctggacgacagctgcagccagctgaccagcttcctgtacagcttctgccagcagagcagaagacagagaatcatccagagaaacagaaccgagagactgagcgacctgctggactggaagtacctgggcagatactacatgagcgccagacacatggccctgagcaaggccttccccgagcacttcacctacgagcccaacgaggccgacgccgcccagggctacagataccccagacccgccagcgtgccccccagccccagcctgagcagacacagcagcccccaccagagcgaggacgaggaggaccccagaaacggccccctggaggaggacggcgagagatacgacgaggacgaggaggccgccaaggacagaagaaacatcagagcccccgagtggcccagaagagccagctgcaccagcagcaccagcggcagcaagagaaacagcgtggacaccgccaccagcagcagcctgagcacccccagcgagcccctgagccccaccagcagcctgggcgaggagagaaactag

SEQ ID NO: 83411 - DNA, 1002 bp, Artificial Sequence
  Description of Artificial Sequence: Synthetic coding sequence
atgaccgaccaggccttcgtgaccctgaccaccaacgacgcctacgccaagggcgccctggtgctgggcagcagcctgaagcagcacagaaccaccagaagactggtggtgctggccaccccccaggtgagcgacagcatgagaaaggtgctggagaccgtgttcgacgaggtgatcatggtggacgtgctggacagcggcgacagcgcccacctgaccctgatgaagagacccgagctgggcgtgaccctgaccaagctgcactgctggagcctgacccagtacagcaagtgcgtgttcatggacgccgacaccctggtgctggccaacatcgacgacctgttcgacagagaggagctgagcgccgcccccgaccccggctggcccgactgcttcaacagcggcgtgttcgtgtaccagcccagcgtggagacctacaaccagctgctgcacctggccagcgagcagggcagcttcgacggcggcgaccagggcatcctgaacaccttcttcagcagctgggccaccaccgacatcagaaagcacctgcccttcatctacaacctgagcagcatcagcatctacagctacctgcccgccttcaaggtgttcggcgccagcgccaaggtggtgcacttcctgggcagagtgaagccctggaactacacctacgaccccaagaccaagagcgtgaagagcgaggcccacgaccccaacatgacccaccccgagttcctgatcctgtggtggaacatcttcaccaccaacgtgctgcccctgctgcagcagttcggcctggtgaaggacacctgcagctacgtgaacgtggaggacgtgagcggcgccatcagccacctgagcctgggcgagatccccgccatggcccagcccttcgtgagcagcgaggagagaaaggagagatgggagcagggccaggccgactacatgggcgccgacagcttcgacaacatcaagagaaagctggacacctacctgcagtag

SEQ ID NO: 83412 - DNA, 1053 bp, Artificial Sequence
  Description of Artificial Sequence: Synthetic coding sequence
atgaccgaccaggccttcgtgaccctgaccaccaacgacgcctacgccaagggcgccctggtgctgggcagcagcctgaagcagcacagaaccaccagaagactggtggtgctggccaccccccaggtgagcgacagcatgagaaaggtgctggagaccgtgttcgacgaggtgatcatggtggacgtgctggacagcggcgacagcgcccacctgaccctgatgaagagacccgagctgggcgtgaccctgaccaagctgcactgctggagcctgacccagtacagcaagtgcgtgttcatggacgccgacaccctggtgctggccaacatcgacgacctgttcgacagagaggagctgagcgccgcccccgaccccggctggcccgactgcttcaacagcggcgtgttcgtgtaccagcccagcgtggagacctacaaccagctgctgcacctggccagcgagcagggcagcttcgacggcggcgaccagggcatcctgaacaccttcttcagcagctgggccaccaccgacatcagaaagcacctgcccttcatctacaacctgagcagcatcagcatctacagctacctgcccgccttcaaggtgttcggcgccagcgccaaggtggtgcacttcctgggcagagtgaagccctggaactacacctacgaccccaagaccaagagcgtgaagagcgaggcccacgaccccaacatgacccaccccgagttcctgatcctgtggtggaacatcttcaccaccaacgtgctgcccctgctgcagcagttcggcctggtgaaggacacctgcagctacgtgaacgtgctgagcgacctggtgtacaccctggccttcagctgcggcttctgcagaaaggaggacgtgagcggcgccatcagccacctgagcctgggcgagatccccgccatggcccagcccttcgtgagcagcgaggagagaaaggagagatgggagcagggccaggccgactacatgggcgccgacagcttcgacaacatcaagagaaagctggacacctacctgcagtag

SEQ ID NO: 83413 - DNA, 840 bp, Artificial Sequence
  Description of Artificial Sequence: Synthetic coding sequence
atgaccgaccaggccttcgtgaccctgaccaccaacgacgcctacgccaagggcgccctggtgctgggcagcagcctgaagcagcacagaaccaccagaagactggtggtgctggccaccccccaggtgagcgacagcatgagaaaggtgctggagaccgtgttcgacgaggtgatcatggtggacgtgctggacagcggcgacagcgcccacctgaccctgatgaagagacccgagctgggcgtgaccctgaccaagctgcactgctggagcctgacccagtacagcaagtgcgtgttcatggacgccgacaccctggtgctggccaacatcgacgacctgttcgacagagaggagctgagcgccgcccccgaccccggctggcccgactgcttcaacagcggcgtgttcgtgtaccagcccagcgtggagacctacaaccagctgctgcacctggccagcgagcagggcagcttcgacggcggcgaccagggcatcctgaacaccttcttcagcagctgggccaccaccgacatcagaaagcacctgcccttcatctacaacctgagcagcatcagcatctacagctacctgcccgccttcaaggtgaagatgagccaggagccctaccacatctgccccctgggcagaagccagctgtggcacagcagactgtaccccagaaagaacggcagaaacgacggcaacagagccagactgatcatctgggagcagatccccctgaccaccagcagaggcaacctgaccctgaccagcagcagaaacaccgccttcttctgcgagcacatccacttcaccagcctggtgagcgacacctag

SEQ ID NO: 83414 - DNA, 1398 bp, Artificial Sequence
  Description of Artificial Sequence: Synthetic coding sequence
atgagcgagaccgagttccaccacggcgcccaggccggcctggagctgctgagaagcagcaacagccccaccagcgccagccagagcgccggcatgaccgtgaccgaccaggccttcgtgaccctggccaccaacgacatctactgccagggcgccctggtgctgggccagagcctgagaagacacagactgaccagaaagctggtggtgctgatcaccccccaggtgagcagcctgctgagagtgatcctgagcaaggtgttcgacgaggtgatcgaggtgaacctgatcgacagcgccgactacatccacctggccttcctgaagagacccgagctgggcctgaccctgaccaagctgcactgctggaccctgacccactacagcaagtgcgtgttcctggacgccgacaccctggtgctgagcaacgtggacgagctgttcgacagaggcgagttcagcgccgcccccgaccccggctggcccgactgcttcaacagcggcgtgttcgtgttccagcccagcctgcacacccacaagctgctgctgcagcacgccatggagcacggcagcttcgacggcgccgaccagggcctgctgaacagcttcttcagaaactggagcaccaccgacatccacaagcacctgcccttcatctacaacctgagcagcaacaccatgtacacctacagccccgccttcaagcagttcggcagcagcgccaaggtggtgcacttcctgggcagcatgaagccctggaactacaagtacaacccccagagcggcagcgtgctggagcagggcagcgccagcagcagccagcaccaggccgccttcctgcacctgtggtggaccgtgtaccagaacaacgtgctgcccctgtacaagagcgtgcaggccggcgaggccagagccagccccggccacaccctgtgccacagcgacgtgggcggcccctgcgccgacagcgccagcggcgtgggcgagccctgcgagaacagcacccccagcgccggcgtgccctgcgccaacagccccctgggcagcaaccagcccgcccagggcctgcccgagcccacccagatcgtggacgagaccctgagcctgcccgagggcagaagaagcgaggacatgatcgcctgccccgagaccgagacccccgccgtgatcacctgcgaccccctgagccagcccagcccccagcccgccgacttcaccgagaccgagaccatcctggtggacctggccgtgagcgtgagccagatcagcatcgaggagaaggtgaaggagctgagccccgaggaggagagaagaaagtgggaggagggcagaatcgactacatgggcaaggacgccttcgccagaatccaggagaagctggacagattcctgcagtag

SEQ ID NO: 83415 - DNA, 1506 bp, Artificial Sequence
  Description of Artificial Sequence: Synthetic coding sequence
atgagcgagaccgagttccaccacggcgcccaggccggcctggagctgctgagaagcagcaacagccccaccagcgccagccagagcgccggcatgaccgtgaccgaccaggccttcgtgaccctggccaccaacgacatctactgccagggcgccctggtgctgggccagagcctgagaagacacagactgaccagaaagctggtggtgctgatcaccccccaggtgagcagcctgctgagagtgatcctgagcaaggtgttcgacgaggtgatcgaggtgaacctgatcgacagcgccgactacatccacctggccttcctgaagagacccgagctgggcctgaccctgaccaagctgcactgctggaccctgacccactacagcaagtgcgtgttcctggacgccgacaccctggtgctgagcaacgtggacgagctgttcgacagaggcgagttcagcgccgcccccgaccccggctggcccgactgcttcaacagcggcgtgttcgtgttccagcccagcctgcacacccacaagctgctgctgcagcacgccatggagcacggcagcttcgacggcgccgaccagggcctgctgaacagcttcttcagaaactggagcaccaccgacatccacaagcacctgcccttcatctacaacctgagcagcaacaccatgtacacctacagccccgccttcaagcagttcggcagcagcgccaaggtggtgcacttcctgggcagcatgaagccctggaactacaagtacaacccccagagcggcagcgtgctggagcagggcagcgccagcagcagccagcaccaggccgccttcctgcacctgtggtggaccgtgtaccagaacaacgtgctgcccctgtacaagagcgtgcaggccggcgaggccagagccagccccggccacaccctgtgccacagcgacgtgggcggcccctgcgccgacagcgccagcggcgtgggcgagccctgcgagaacagcacccccagcgccggcgtgccctgcgccaacagccccctgggcagcaaccagcccgcccagggcctgcccgagcccacccagatcgtggacgagaccctgagcctgcccgagggcagaagaagcgaggacatgatcgcctgccccgagaccgagacccccgccgtgatcacctgcgaccccctgagccagcccagcccccagcccgccgacttcaccgagaccgagaccatcctgcagcccgccaacaaggtggagagcgtgagcagcgaggagaccttcgagcccagccaggagctgcccgccgaggccctgagagaccccagcctgcaggacgccctggaggtggacctggccgtgagcgtgagccagatcagcatcgaggagaaggtgaaggagctgagccccgaggaggagagaagaaagtgggaggagggcagaatcgactacatgggcaaggacgccttcgccagaatccaggagaagctggacagattcctgcagtag

SEQ ID NO: 83416 - DNA, 1413 bp, Artificial Sequence
  Description of Artificial Sequence: Synthetic coding sequence
atgagcgtgaccgaccaggccttcgtgaccctggccaccaacgacatctactgccagggcgccctggtgctgggccagagcctgagaagacacagactgaccagaaagctggtggtgctgatcaccccccaggtgagcagcctgctgagagtgatcctgagcaaggtgttcgacgaggtgatcgaggtgaacctgatcgacagcgccgactacatccacctggccttcctgaagagacccgagctgggcctgaccctgaccaagctgcactgctggaccctgacccactacagcaagtgcgtgttcctggacgccgacaccctggtgctgagcaacgtggacgagctgttcgacagaggcgagttcagcgccgcccccgaccccggctggcccgactgcttcaacagcggcgtgttcgtgttccagcccagcctgcacacccacaagctgctgctgcagcacgccatggagcacggcagcttcgacggcgccgaccagggcctgctgaacagcttcttcagaaactggagcaccaccgacatccacaagcacctgcccttcatctacaacctgagcagcaacaccatgtacacctacagccccgccttcaagcagttcggcagcagcgccaaggtggtgcacttcctgggcagcatgaagccctggaactacaagtacaacccccagagcggcagcgtgctggagcagggcagcgccagcagcagccagcaccaggccgccttcctgcacctgtggtggaccgtgtaccagaacaacgtgctgcccctgtacaagagcgtgcaggccggcgaggccagagccagccccggccacaccctgtgccacagcgacgtgggcggcccctgcgccgacagcgccagcggcgtgggcgagccctgcgagaacagcacccccagcgccggcgtgccctgcgccaacagccccctgggcagcaaccagcccgcccagggcctgcccgagcccacccagatcgtggacgagaccctgagcctgcccgagggcagaagaagcgaggacatgatcgcctgccccgagaccgagacccccgccgtgatcacctgcgaccccctgagccagcccagcccccagcccgccgacttcaccgagaccgagaccatcctgcagcccgccaacaaggtggagagcgtgagcagcgaggagaccttcgagcccagccaggagctgcccgccgaggccctgagagaccccagcctgcaggacgccctggaggtggacctggccgtgagcgtgagccagatcagcatcgaggagaaggtgaaggagctgagccccgaggaggagagaagaaagtgggaggagggcagaatcgactacatgggcaaggacgccttcgccagaatccaggagaagctggacagattcctgcagtag

SEQ ID NO: 83417 - DNA, 417 bp, Artificial Sequence
  Description of Artificial Sequence: Synthetic coding sequence
atgagcgtgaccgaccaggccttcgtgaccctggccaccaacgacatctactgccagggcgccctggtgctgggccagagcctgagaagacacagactgaccagaaagctggtggtgctgatcaccccccaggtgagcagcctgctgagagtgatcctgagcaaggtgttcgacgaggtgatcgaggtgaacctgatcgacagcgccgactacatccacctggccttcctgaagagacccgagctgggcctgaccctgaccaagctgcactgctggaccctgacccactacagcaagtgcgtgttcctggacgccgacaccctggtgctgagcaacgtggacgagctgttcgacagaggcgagttcagcgccgcccccgaccccggctggcccgactgcttcaacagcggcgtgtag

SEQ ID NO: 83418 - DNA, 1293 bp, Artificial Sequence
  Description of Artificial Sequence: Synthetic coding sequence
atgagcgagaccgagttccaccacggcgcccaggccggcctggagctgctgagaagcagcaacagccccaccagcgccagccagagcgccggcatgaccgtgaccgaccaggccttcgtgaccctggccaccaacgacatctactgccagggcgccctggtgctgggccagagcctgagaagacacagactgaccagaaagctggtggtgctgatcaccccccaggtgagcagcctgctgagagtgatcctgagcaaggtgttcgacgaggtgatcgaggtgaacctgatcgacagcgccgactacatccacctggccttcctgaagagacccgagctgggcctgaccctgaccaagctgcactgctggaccctgacccactacagcaagtgcgtgttcctggacgccgacaccctggtgctgagcaacgtggacgagctgttcgacagaggcgagttcagcgccgcccccgaccccggctggcccgactgcttcaacagcggcgtgttcgtgttccagcccagcctgcacacccacaagctgctgctgcagcacgccatggagcacggcagcttcgacggcgccgaccagggcctgctgaacagcttcttcagaaactggagcaccaccgacatccacaagcacctgcccttcatctacaacctgagcagcaacaccatgtacacctacagccccgccttcaagcagttcggcagcagcgccaaggtggtgcacttcctgggcagcatgaagccctggaactacaagtacaacccccagagcggcagcgtgctggagcagggcagcgccagcagcagccagcaccaggccgccttcctgcacctgtggtggaccgtgtaccagaacaacgtgctgcccctgtacaagagcgtgcaggccggcgaggccagagccagccccggccacaccctgtgccacagcgacgtgggcggcccctgcgccgacagcgccagcggcgtgggcgagccctgcgagaacagcacccccagcgccggcgtgccctgcgccaacagccccctgggcagcaaccagcccgcccagggcctgcccgagcccacccagatcgtggacgagaccctgagcctgcccgagggcagaagaagcgaggacgtggacctggccgtgagcgtgagccagatcagcatcgaggagaaggtgaaggagctgagccccgaggaggagagaagaaagtgggaggagggcagaatcgactacatgggcaaggacgccttcgccagaatccaggagaagctggacagattcctgcagtag

SEQ ID NO: 83419 - DNA, 354 bp, Artificial Sequence
  Description of Artificial Sequence: Synthetic coding sequence
atgtacggcaagatcatcttcgtgctgctgctgagcgacacccacaagagagacacctacgccgccacccccagagcccacgaggtgagcgagatcagcgtgagaaccgtgtacccccccgaggaggagaccggcgagagagtgcagctggcccaccacttcagcgagcccgagatcaccctgatcatcttcggcgtgatggccggcgtgatcggcaccatcctgctgatcagctacggcatcagaagactgatcaagaagagccccagcgacgtgaagcccctgcccagccccgacaccgacgtgcccctgagcagcgtggagatcgagaaccccgagaccagcgaccagtag

SEQ ID NO: 83420 - DNA, 453 bp, Artificial Sequence
  Description of Artificial Sequence: Synthetic coding sequence
atgtacggcaagatcatcttcgtgctgctgctgagcgagatcgtgagcatcagcgccctgagcaccaccgaggtggccatgcacaccagcaccagcagcagcgtgaccaagagctacatcagcagccagaccaacgacacccacaagagagacacctacgccgccacccccagagcccacgaggtgagcgagatcagcgtgagaaccgtgtacccccccgaggaggagaccggcgagagagtgcagctggcccaccacttcagcgagcccgagatcaccctgatcatcttcggcgtgatggccggcgtgatcggcaccatcctgctgatcagctacggcatcagaagactgatcaagaagagccccagcgacgtgaagcccctgcccagccccgacaccgacgtgcccctgagcagcgtggagatcgagaaccccgagaccagcgaccagtag

SEQ ID NO: 83421 - DNA, 189 bp, Artificial Sequence
  Description of Artificial Sequence: Synthetic coding sequence
atgtacggcaagatcatcttcgtgctgctgctgagcgagatcgtgagcatcagcgccctgagcaccaccgaggtggccatgcacaccagcaccagcagcagcgtgaccaagagctacatcagcagccagaccaacggcgagagagtgcagctggcccaccacttcagcgagcccgacttccacaactag

SEQ ID NO: 83422 - DNA, 357 bp, Artificial Sequence
  Description of Artificial Sequence: Synthetic coding sequence
atgtacggcaagatcatcttcgtgctgctgctgagcgagatcgtgagcatcagcgccctgagcaccaccgaggtggccatgcacaccagcaccagcagcagcgtgaccaagagctacatcagcagccagaccaacggcgagagagtgcagctggcccaccacttcagcgagcccgagatcaccctgatcatcttcggcgtgatggccggcgtgatcggcaccatcctgctgatcagctacggcatcagaagactgatcaagaagagccccagcgacgtgaagcccctgcccagccccgacaccgacgtgcccctgagcagcgtggagatcgagaaccccgagaccagcgaccagtag

SEQ ID NO: 83423 - DNA, 414 bp, Artificial Sequence
  Description of Artificial Sequence: Synthetic coding sequence
atgtacggcaagatcatcttcgtgctgctgctgagcgagatcgtgagcatcagcgccctgagcaccaccgaggtggccatgcacaccagcaccagcagcagcgtgaccaagagctacatcagcagccagaccaacgacacccacaagagagacacctacgccgccacccccagagcccacgaggtgagcgagatcagcgtgagaaccgtgtacccccccgaggaggagaccgagatcaccctgatcatcttcggcgtgatggccggcgtgatcggcaccatcctgctgatcagctacggcatcagaagactgatcaagaagagccccagcgacgtgaagcccctgcccagccccgacaccgacgtgcccctgagcagcgtggagatcgagaaccccgagaccagcgaccagtag

SEQ ID NO: 83424 - DNA, 258 bp, Artificial Sequence
  Description of Artificial Sequence: Synthetic coding sequence
atgtacggcaagatcatcttcgtgctgctgctgagcggcgagagagtgcagctggcccaccacttcagcgagcccgagatcaccctgatcatcttcggcgtgatggccggcgtgatcggcaccatcctgctgatcagctacggcatcagaagactgatcaagaagagccccagcgacgtgaagcccctgcccagccccgacaccgacgtgcccctgagcagcgtggagatcgagaaccccgagaccagcgaccagtag

SEQ ID NO: 83425 - DNA, 375 bp, Artificial Sequence
  Description of Artificial Sequence: Synthetic coding sequence
atgcacaccagcaccagcagcagcgtgaccaagagctacatcagcagccagaccaacgacacccacaagagagacacctacgccgccacccccagagcccacgaggtgagcgagatcagcgtgagaaccgtgtacccccccgaggaggagaccggcgagagagtgcagctggcccaccacttcagcgagcccgagatcaccctgatcatcttcggcgtgatggccggcgtgatcggcaccatcctgctgatcagctacggcatcagaagactgatcaagaagagccccagcgacgtgaagcccctgcccagccccgacaccgacgtgcccctgagcagcgtggagatcgagaaccccgagaccagcgaccagtag

SEQ ID NO: 83426 - DNA, 276 bp, Artificial Sequence
  Description of Artificial Sequence: Synthetic coding sequence
atgtacggcaagatcatcttcgtgctgctgctgagcgagatcgtgagcatcagcgccctgagcaccaccgaggtggccatgcacaccagcaccagcagcagcgtgaccaagagctacatcagcagccagaccaacggcgagaccggccagctggtgcacagattcaccgtgcccgcccccgtggtgatcatcctgatcatcctgtgcgtgatggccggcatcatcggcaccatcctgctgatcagctacagcatcagaagactgatcaaggcctag

SEQ ID NO: 83427 - DNA, 276 bp, Artificial Sequence; identical to SEQ ID NO: 83426
  Description of Artificial Sequence: Synthetic coding sequence

SEQ ID NO: 83428 - DNA, 177 bp, Artificial Sequence
  Description of Artificial Sequence: Synthetic coding sequence
atgtacggcaagatcatcttcgtgctgctgctgagcggcgagaccggccagctggtgcacagattcaccgtgcccgcccccgtggtgatcatcctgatcatcctgtgcgtgatggccggcatcatcggcaccatcctgctgatcagctacagcatcagaagactgatcaaggcctag

SEQ ID NO: 83429 - DNA, 387 bp, Artificial Sequence
  Description of Artificial Sequence: Synthetic coding sequence
atgtggagcaccagaagccccaacagcaccgcctggcccctgagcctggagcccgaccccggcatggccagcgccagcaccaccatgcacaccaccaccatcgccgagcccgaccccggcatgagcggctggcccgacggcagaatggagaccagcacccccaccatcatggacatcgtggtgatcgccggcgtgatcgccgccgtggccatcgtgctggtgagcctgctgttcgtgatgctgagatacatgtacagacacaagggcacctaccacaccaacgaggccaagggcaccgagttcgccgagagcgccgacgccgccctgcagggcgaccccgccctgcaggacgccggcgacagcagcagaaaggagtacttcatctag

SEQ ID NO: 83430 - DNA, 324 bp, Artificial Sequence
  Description of Artificial Sequence: Synthetic coding sequence
atggccagcgccagcaccaccatgcacaccaccaccatcgccgagcccgaccccggcatgagcggctggcccgacggcagaatggagaccagcacccccaccatcatggacatcgtggtgatcgccggcgtgatcgccgccgtggccatcgtgctggtgagcctgctgttcgtgatgctgagatacatgtacagacacaagggcacctaccacaccaacgaggccaagggcaccgagttcgccgagagcgccgacgccgccctgcagggcgaccccgccctgcaggacgccggcgacagcagcagaaaggagtacttcatctag

SEQ ID NO: 83431 - DNA, 330 bp, Artificial Sequence
  Description of Artificial Sequence: Synthetic coding sequence
atgtggagcaccagaagccccaacagcaccgcctggcccctgagcctggagcccgaccccggcatgagcggctggcccgacggcagaatggagaccagcacccccaccatcatggacatcgtggtgatcgccggcgtgatcgccgccgtggccatcgtgctggtgagcctgctgttcgtgatgctgagatacatgtacagacacaagggcacctaccacaccaacgaggccaagggcaccgagttcgccgagagcgccgacgccgccctgcagggcgaccccgccctgcaggacgccggcgacagcagcagaaaggagtacttcatctag

SEQ ID NO: 83432 - DNA, 237 bp, Artificial Sequence
  Description of Artificial Sequence: Synthetic coding sequence
atgtacggcaagatcatcttcgtgctgctgctgagcggcatcgtgagcatcagcgccagcagcaccaccggcgtggccatgcacaccagcaccagcagcagcgtgaccaagagctacatcagcagccagaccaacggcatcaccctgatcaactggtgggccatggccagagtgatcttcgaggtgatgctggtggtggtgggcatgatcatcctgatcagctactgcatcagatag

SEQ ID NO: 83433 - DNA, 168 bp, Artificial Sequence
  Description of Artificial Sequence: Synthetic coding sequence
atgtacggcaagatcatcttcgtgctgctgctgagcggcatcgtgagcatcagcgccagcagcaccaccggcgtggccatgcacaccagcaccagcagcagcgtgaccaagagctacatcagcagccagaccaacggcgagagaggccagctggtgcacagattctag

SEQ ID NO: 83434 - DNA, 237 bp, Artificial Sequence; identical to SEQ ID NO: 83432
  Description of Artificial Sequence: Synthetic coding sequence

SEQ ID NO: 83435 - DNA, 180 bp, Artificial Sequence
  Description of Artificial Sequence: Synthetic coding sequence
atgtacggcaagatcatcttcgtgctgctgctgagcggcatcgtgagcatcagcgccagcagcaccaccggcgtggccatgcacaccagcaccagcagcagcgtgaccaagagctacatcagcagccagaccaacggctgcgtgatcggcaacatcatctgcagcgacaagagcaagtag

SEQ ID NO: 83436 - DNA, 1605 bp, Artificial Sequence
  Description of Artificial Sequence: Synthetic coding sequence
atgccccacctgatggagagaatggtgggcagcggcctgctgtggctggccctggtgagctgcatcctgacccaggccagcgccgtgcagagaggctacggcaaccccatcgaggccagcagctacggcctggacctggactgcggcgcccccggcacccccgaggcccacgtgtgcttcgacccctgccagaactacaccctgctggacgagcccttcagaagcaccgagaacagcgccggcagccagggctgcgacaagaacatgagcggctggtacagattcgtgggcgagggcggcgtgagaatgagcgagacctgcgtgcaggtgcacagatgccagaccgacgcccccatgtggctgaacggcacccaccccgccctgggcgacggcatcaccaaccacaccgcctgcgcccactggagcggcaactgctgcttctggaagaccgaggtgctggtgaaggcctgccccggcggctaccacgtgtacagactggagggcaccccctggtgcaacctgagatactgcaccgaccccagcaccgtggaggacaagtgcgagaaggcctgcagacccgaggaggagtgcctggccctgaacagcacctggggctgcttctgcagacaggacctgaacagcagcgacgtgcacagcctgcagccccagctggactgcggccccagagagatcaaggtgaaggtggacaagtgcctgctgggcggcctgggcctgggcgaggaggtgatcgcctacctgagagaccccaactgcagcagcatcctgcagaccgaggagagaaactgggtgagcgtgaccagccccgtgcaggccagcgcctgcagaaacatcctggagagaaaccagacccacgccatctacaagaacaccctgagcctggtgaacgacttcatcatcagagacaccatcctgaacatcaacttccagtgcgcctaccccctggacatgaaggtgagcctgcaggccgccctgcagcccatcgtgagcagcctgaacgtgagcgtggacggcaacggcgagttcatcgtgagaatggccctgttccaggaccagaactacaccaacccctacgagggcgacgccgtggagctgagcgtggagagcgtgctgtacgtgggcgccatcctggagcagggcgacaccagcagattcaacctggtgctgagaaactgctacgccacccccaccgaggacaaggccgacctggtgaagtacttcatcatcagaaacagctgcagcaaccagagagacagcaccatccacgtggaggagaacggccagagcagcgagagcagattcagcgtgcagatgttcatgttcgccggccactacgacctggtgttcctgcactgcgagatccacctgtgcgacagcctgaacgagcagtgccagcccagctgcagcagaagccaggtgagaagcgaggtgcccgccatcgacctggccagagtgctggacctgggccccatcaccagaagaggcgcccagagccccggcgtgatgaacggcacccccagcaccgccggcttcctggtggcctggcccatggtgctgctgaccgtgctgctggcctggctgttctag

SEQ ID NO: 83437 - DNA, 1164 bp, Artificial Sequence
  Description of Artificial Sequence: Synthetic coding sequence
atgccccacctgatggagagaatggtgggcagcggcctgctgtggctggccctggtgagctgcatcctgacccaggccagcgccgtgcagagagaccccagcaccgtggaggacaagtgcgagaaggcctgcagacccgaggaggagtgcctggccctgaacagcacctggggctgcttctgcagacaggacctgaacagcagcgacgtgcacagcctgcagccccagctggactgcggccccagagagatcaaggtgaaggtggacaagtgcctgctgggcggcctgggcctgggcgaggaggtgatcgcctacctgagagaccccaactgcagcagcatcctgcagaccgaggagagaaactgggtgagcgtgaccagccccgtgcaggccagcgcctgcagaaacatcctggagagaaaccagacccacgccatctacaagaacaccctgagcctggtgaacgacttcatcatcagagacaccatcctgaacatcaacttccagtgcgcctaccccctggacatgaaggtgagcctgcaggccgccctgcagcccatcgtgagcagcctgaacgtgagcgtggacggcaacggcgagttcatcgtgagaatggccctgttccaggaccagaactacaccaacccctacgagggcgacgccgtggagctgagcgtggagagcgtgctgtacgtgggcgccatcctggagcagggcgacaccagcagattcaacctggtgctgagaaactgctacgccacccccaccgaggacaaggccgacctggtgaagtacttcatcatcagaaacagctgcagcaaccagagagacagcaccatccacgtggaggagaacggccagagcagcgagagcagattcagcgtgcagatgttcatgttcgccggccactacgacctggtgttcctgcactgcgagatccacctgtgcgacagcctgaacgagcagtgccagcccagctgcagcagaagccaggtgagaagcgaggtgcccgccatcgacctggccagagtgctggacctgggccccatcaccagaagaggcgcccagagccccggcgtgatgaacggcacccccagcaccgccggcttcctggtggcctggcccatggtgctgctgaccgtgctgctggcctggctgttctag

SEQ ID NO: 83438 - DNA, 1173 bp, Artificial Sequence
  Description of Artificial Sequence: Synthetic coding sequence
atgccccacctgatggagagaatggtgggcagcggcctgctgtggctggccctggtgagctgcatcctgacccaggccagcgccgtgcagagagtgcccagagaccccagcaccgtggaggacaagtgcgagaaggcctgcagacccgaggaggagtgcctggccctgaacagcacctggggctgcttctgcagacaggacctgaacagcagcgacgtgcacagcctgcagccccagctggactgcggccccagagagatcaaggtgaaggtggacaagtgcctgctgggcggcctgggcctgggcgaggaggtgatcgcctacctgagagaccccaactgcagcagcatcctgcagaccgaggagagaaactgggtgagcgtgaccagccccgtgcaggccagcgcctgcagaaacatcctggagagaaaccagacccacgccatctacaagaacaccctgagcctggtgaacgacttcatcatcagagacaccatcctgaacatcaacttccagtgcgcctaccccctggacatgaaggtgagcctgcaggccgccctgcagcccatcgtgagcagcctgaacgtgagcgtggacggcaacggcgagttcatcgtgagaatggccctgttccaggaccagaactacaccaacccctacgagggcgacgccgtggagctgagcgtggagagcgtgctgtacgtgggcgccatcctggagcagggcgacaccagcagattcaacctggtgctgagaaactgctacgccacccccaccgaggacaaggccgacctggtgaagtacttcatcatcagaaacagctgcagcaaccagagagacagcaccatccacgtggaggagaacggccagagcagcgagagcagattcagcgtgcagatgttcatgttcgccggccactacgacctggtgttcctgcactgcgagatccacctgtgcgacagcctgaacgagcagtgccagcccagctgcagcagaagccaggtgagaagcgaggtgcccgccatcgacctggccagagtgctggacctgggccccatcaccagaagaggcgcccagagccccggcgtgatgaacggcacccccagcaccgccggcttcctggtggcctggcccatggtgctgctgaccgtgctgctggcctggctgttctag

SEQ ID NO: 83439 - DNA, 1614 bp, Artificial Sequence
  Description of Artificial Sequence: Synthetic coding sequence
atgccccacctgatggagagaatggtgggcagcggcctgctgtggctggccctggtgagctgcatcctgacccaggccagcgccgtgcagagaggctacggcaaccccatcgaggccagcagctacggcctggacctggactgcggcgcccccggcacccccgaggcccacgtgtgcttcgacccctgccagaactacaccctgctggacgagcccttcagaagcaccgagaacagcgccggcagccagggctgcgacaagaacatgagcggctggtacagattcgtgggcgagggcggcgtgagaatgagcgagacctgcgtgcaggtgcacagatgccagaccgacgcccccatgtggctgaacggcacccaccccgccctgggcgacggcatcaccaaccacaccgcctgcgcccactggagcggcaactgctgcttctggaagaccgaggtgctggtgaaggcctgccccggcggctaccacgtgtacagactggagggcaccccctggtgcaacctgagatactgcaccgtgcccagagaccccagcaccgtggaggacaagtgcgagaaggcctgcagacccgaggaggagtgcctggccctgaacagcacctggggctgcttctgcagacaggacctgaacagcagcgacgtgcacagcctgcagccccagctggactgcggccccagagagatcaaggtgaaggtggacaagtgcctgctgggcggcctgggcctgggcgaggaggtgatcgcctacctgagagaccccaactgcagcagcatcctgcagaccgaggagagaaactgggtgagcgtgaccagccccgtgcaggccagcgcctgcagaaacatcctggagagaaaccagacccacgccatctacaagaacaccctgagcctggtgaacgacttcatcatcagagacaccatcctgaacatcaacttccagtgcgcctaccccctggacatgaaggtgagcctgcaggccgccctgcagcccatcgtgagcagcctgaacgtgagcgtggacggcaacggcgagttcatcgtgagaatggccctgttccaggaccagaactacaccaacccctacgagggcgacgccgtggagctgagcgtggagagcgtgctgtacgtgggcgccatcctggagcagggcgacaccagcagattcaacctggtgctgagaaactgctacgccacccccaccgaggacaaggccgacctggtgaagtacttcatcatcagaaacagctgcagcaaccagagagacagcaccatccacgtggaggagaacggccagagcagcgagagcagattcagcgtgcagatgttcatgttcgccggccactacgacctggtgttcctgcactgcgagatccacctgtgcgacagcctgaacgagcagtgccagcccagctgcagcagaagccaggtgagaagcgaggtgcccgccatcgacctggccagagtgctggacctgggccccatcaccagaagaggcgcccagagccccggcgtgatgaacggcacccccagcaccgccggcttcctggtggcctggcccatggtgctgctgaccgtgctgctggcctggctgttctag

SEQ ID NO: 83440 - DNA, 1548 bp, Artificial Sequence
  Description of Artificial Sequence: Synthetic coding sequence
atgaagatcaagtgcgagaagagcagaacccagagcagcgcccagcacgtgcagcacagcgcccacagcaccatcgtgtgcagaaagcacagccacaacgccgagaccgccggcagagtggacatcgtgagaggcggccccttcttccaccaccccctgagaaagtggctgatcagcccccccctgaacaagcccagcgtgtggcccagaacccccatcatccccgtgcaccagctgagaagagacacctgggtgggcaactgcaacaagaagaccgcccacagcagactgcacagccacggctggcccgaggaggagagattcgtgttcagcagcgagctgcacggcaagagcgcctacagcaaggtgacctgcatgccccacctgatggagagaatggtgggcagcggcctgctgtggctggccctggtgagctgcatcctgacccaggccagcgccgtgcagagagaccacctggaccccagcaccgtggaggacaagtgcgagaaggcctgcagacccgaggaggagtgcctggccctgaacagcacctggggctgcttctgcagacaggacctgaacagcagcgacgtgcacagcctgcagccccagctggactgcggccccagagagatcaaggtgaaggtggacaagtgcctgctgggcggcctgggcctgggcgaggaggtgatcgcctacctgagagaccccaactgcagcagcatcctgcagaccgaggagagaaactgggtgagcgtgaccagccccgtgcaggccagcgcctgcagaaacatcctggagagaaaccagacccacgccatctacaagaacaccctgagcctggtgaacgacttcatcatcagagacaccatcctgaacatcaacttccagtgcgcctaccccctggacatgaaggtgagcctgcaggccgccctgcagcccatcgtgagcagcctgaacgtgagcgtggacggcaacggcgagttcatcgtgagaatggccctgttccaggaccagaactacaccaacccctacgagggcgacgccgtggagctgagcgtggagagcgtgctgtacgtgggcgccatcctggagcagggcgacaccagcagattcaacctggtgctgagaaactgctacgccacccccaccgaggacaaggccgacctggtgaagtacttcatcatcagaaacagctgcagcaaccagagagacagcaccatccacgtggaggagaacggccagagcagcgagagcagattcagcgtgcagatgttcatgttcgccggccactacgacctggtgttcctgcactgcgagatccacctgtgcgacagcctgaacgagcagtgccagcccagctgcagcagaagccaggtgagaagcgaggtgcccgccatcgacctggccagagtgctggacctgggccccatcaccagaagaggcgcccagagccccggcgtgatgaacggcacccccagcaccgccggcttcctggtggcctggcccatggtgctgctgaccgtgctgctggcctggctgttctag

SEQ ID NO: 83441 - DNA, 1959 bp, Artificial Sequence
  Description of Artificial Sequence: Synthetic coding sequence
atgcccctgctgctgctgctgctgctgctgcccagccccctgcacccccaccccatctgcgaggtgagcaaggtggccagccacctggaggtgaactgcgacaagagaaacctgaccgccctgccccccgacctgcccaaggacaccaccatcctgcacctgagcgagaacctgctgtacaccttcagcctggccaccctgatgccctacaccagactgacccagctgaacctggacagatgcgagctgaccaagctgcaggtggacggcaccctgcccgtgctgggcaccctggacctgagccacaaccagctgcagagcctgcccctgctgggccagaccctgcccgccctgaccgtgctggacgtgagcttcaacagactgaccagcctgcccctgggcgccctgagaggcctgggcgagctgcaggagctgtacctgaagggcaacgagctgaagaccctgccccccggcctgctgacccccacccccaagctggagaagctgagcctggccaacaacaacctgaccgagctgcccgccggcctgctgaacggcctggagaacctggacaccctgctgctgcaggagaacagcctgtacaccatccccaagggcttcttcggcagccacctgctgcccttcgccttcctgcacggcaacccctggctgtgcaactgcgagatcctgtacttcagaagatggctgcaggacaacgccgagaacgtgtacgtgtggaagcagggcgtggacgtgaaggccatgaccagcaacgtggccagcgtgcagtgcgacaacagcgacaagttccccgtgtacaagtaccccggcaagggctgccccaccctgggcgacgagggcgacaccgacctgtacgactactaccccgaggaggacaccgagggcgacaaggtgagagccaccagaaccgtggtgaagttccccaccaaggcccacaccaccccctggggcctgttctacagctggagcaccgccagcctggacagccagatgcccagcagcctgcaccccacccaggagagcaccaaggagcagaccaccttcccccccagatggacccccaacttcaccctgcacatggagagcatcaccttcagcaagacccccaagagcaccaccgagcccacccccagccccaccaccagcgagcccgtgcccgagcccgcccccaacatgaccaccctggagcccacccccagccccaccacccccgagcccaccagcgagcccgcccccagccccaccacccccgagcccaccagcgagcccgcccccagccccaccacccccgagcccaccagcgagcccgcccccagccccaccacccccgagcccacccccatccccaccatcgccaccagccccaccatcctggtgagcgccaccagcctgatcacccccaagagcaccttcctgaccaccaccaagcccgtgagcctgctggagagcaccaagaagaccatccccgagctggaccagccccccaagctgagaggcgtgctgcagggccacctggagagcagcagaaacgaccccttcctgcaccccgacttctgctgcctgctgcccctgggcttctacgtgctgggcctgttctggctgctgttcgccagcgtggtgctgatcctgctgctgagctgggtgggccacgtgaagccccaggccctggacagcggccagggcgccgccctgaccaccgccacccagaccacccacctggagctgcagagaggcagacaggtgaccgtgcccagagcctggctgctgttcctgagaggcagcctgcccaccttcagaagcagcctgttcctgtgggtgagacccaacggcagagtgggccccctggtggccggcagaagacccagcgccctgagccagggcagaggccaggacctgctgagcaccgtgagcatcagatacagcggccacagcctgtag

SEQ ID NO: 83442 - DNA, 1881 bp, Artificial Sequence
  Description of Artificial Sequence: Synthetic coding sequence
atgcccctgctgctgctgctgctgctgctgcccagccccctgcacccccaccccatctgcgaggtgagcaaggtggccagccacctggaggtgaactgcgacaagagaaacctgaccgccctgccccccgacctgcccaaggacaccaccatcctgcacctgagcgagaacctgctgtacaccttcagcctggccaccctgatgccctacaccagactgacccagctgaacctggacagatgcgagctgaccaagctgcaggtggacggcaccctgcccgtgctgggcaccctggacctgagccacaaccagctgcagagcctgcccctgctgggccagaccctgcccgccctgaccgtgctggacgtgagcttcaacagactgaccagcctgcccctgggcgccctgagaggcctgggcgagctgcaggagctgtacctgaagggcaacgagctgaagaccctgccccccggcctgctgacccccacccccaagctggagaagctgagcctggccaacaacaacctgaccgagctgcccgccggcctgctgaacggcctggagaacctggacaccctgctgctgcaggagaacagcctgtacaccatccccaagggcttcttcggcagccacctgctgcccttcgccttcctgcacggcaacccctggctgtgcaactgcgagatcctgtacttcagaagatggctgcaggacaacgccgagaacgtgtacgtgtggaagcagggcgtggacgtgaaggccatgaccagcaacgtggccagcgtgcagtgcgacaacagcgacaagttccccgtgtacaagtaccccggcaagggctgccccaccctgggcgacgagggcgacaccgacctgtacgactactaccccgaggaggacaccgagggcgacaaggtgagagccaccagaaccgtggtgaagttccccaccaaggcccacaccaccccctggggcctgttctacagctggagcaccgccagcctggacagccagatgcccagcagcctgcaccccacccaggagagcaccaaggagcagaccaccttcccccccagatggacccccaacttcaccctgcacatggagagcatcaccttcagcaagacccccaagagcaccaccgagcccacccccagccccaccaccagcgagcccgtgcccgagcccgcccccaacatgaccaccctggagcccacccccagccccaccacccccgagcccaccagcgagcccgcccccagccccaccacccccgagcccacccccatccccaccatcgccaccagccccaccatcctggtgagcgccaccagcctgatcacccccaagagcaccttcctgaccaccaccaagcccgtgagcctgctggagagcaccaagaagaccatccccgagctggaccagccccccaagctgagaggcgtgctgcagggccacctggagagcagcagaaacgaccccttcctgcaccccgacttctgctgcctgctgcccctgggcttctacgtgctgggcctgttctggctgctgttcgccagcgtggtgctgatcctgctgctgagctgggtgggccacgtgaagccccaggccctggacagcggccagggcgccgccctgaccaccgccacccagaccacccacctggagctgcagagaggcagacaggtgaccgtgcccagagcctggctgctgttcctgagaggcagcctgcccaccttcagaagcagcctgttcctgtgggtgagacccaacggcagagtgggccccctggtggccggcagaagacccagcgccctgagccagggcagaggccaggacctgctgagcaccgtgagcatcagatacagcggccacagcctgtag

SEQ ID NO: 83443 - DNA, 621 bp, Artificial Sequence
  Description of Artificial Sequence: Synthetic coding sequence
atgggcagcggccccagaggcgccctgagcctgctgctgctgctgctggccccccccagcagacccgccgccggctgccccgccccctgcagctgcgccggcaccctggtggactgcggcagaagaggcctgacctgggccagcctgcccaccgccttccccgtggacaccaccgagctggtgctgaccggcaacaacctgaccgccctgccccccggcctgctggacgccctgcccgccctgagaaccgcccacctgggcgccaacccctggagatgcgactgcagactggtgcccctgagagcctggctggccggcagacccgagagagccccctacagagacctgagatgcgtggccccccccgccctgagaggcagactgctgccctacctggccgaggacgagctgagagccgcctgcgcccccggccccctgtgctggggcgccctggccgcccagctggccctgctgggcctgggcctgctgcacgccctgctgctggtgctgctgctgtgcagactgagaagactgagagccagagccagagccagagccgccgccagactgagcctgaccgaccccctggtggccgagagagccggcaccgacgagagctag

SEQ ID NO: 83444 - DNA, 1230 bp, Artificial Sequence
  Description of Artificial Sequence: Synthetic coding sequence
atgatccccagcagacacaccatgctgagattcctgcccgtgaacgccgccagctgccccggcgacagaagaaccatgctggtgaacgtggccgccggcgtgagagtgctgagagtgcccctgagagccggcggcagcggcagcctgagcggcctgagaccccccgccatcgtgtgctacctgcccctgcagagagccagcgccagcggcctgttcctggccagaccccagcactgcggcagatgcggcagaggcagaggcggcgccgccctgagcctgggcagccccgcctacgccagcagatgcagagtgagcagagccgccgtgttcagcccctgggcccccgtgagcctggagagcggcagagcccccggctgcagcctgggcagacccggcctgagaggcgccctggtggtgtggctgcagctgggcgagacctgggtgagactgagaggcgacttccagcccgcctgcggcgtggtgagagtggagagactggccggctacagagacgccggccaccagggcctggacggcgccggccccgccgtgtgggtgctgagagacgtggcccaggtgcccgccgacagaagcgcctactgcggcgccagcctggccggccccagaggcgccctgagcctgctgctgctgctgctggccccccccagcagacccgccgccggctgccccgccccctgcagctgcgccggcaccctggtggactgcggcagaagaggcctgacctgggccagcctgcccaccgccttccccgtggacaccaccgagctggtgctgaccggcaacaacctgaccgccctgccccccggcctgctggacgccctgcccgccctgagaaccgcccacctgggcgccaacccctggagatgcgactgcagactggtgcccctgagagcctggctggccggcagacccgagagagccccctacagagacctgagatgcgtggccccccccgccctgagaggcagactgctgccctacctggccgaggacgagctgagagccgcctgcgcccccggccccctgtgctggggcgccctggccgcccagctggccctgctgggcctgggcctgctgcacgccctgctgctggtgctgctgctgtgcagactgagaagactgagagccagagccagagccagagccgccgccagactgagcctgaccgaccccctggtggccgagagagccggcaccgacgagagctag

SEQ ID NO: 83445 - DNA, 534 bp, Artificial Sequence
  Description of Artificial Sequence: Synthetic coding sequence
atgcccgcctggggcgccctgttcctgctgtgggccaccgccgaggccaccaaggactgccccagcccctgcacctgcagagccctggagaccatgggcctgtgggtggactgcagaggccacggcctgaccgccctgcccgccctgcccgccagaaccagacacctgctgctggccaacaacagcctgcagagcgtgccccccggcgccttcgaccacctgccccagctgcagaccctggacgtgacccagaacccctggcactgcgactgcagcctgacctacctgagactgtggctggaggacagaacccccgaggccctgctgcaggtgagatgcgccagccccagcctggccgcccacggccccctgggcagactgaccggctaccagctgggcagctgcggctggcagctgcaggccagctgggtgagacccggcgtgctgtgggacgtggccctggtggccgtggccgccctgggcctggccctgctggccggcctgctgtgcgccaccaccgaggccctggactag

SEQ ID NO: 83446 - DNA, 987 bp, Artificial Sequence
  Description of Artificial Sequence: Synthetic coding sequence
atgaagcccgccatggagaccgccgccgaggagaacaccgagcagagccaggagagaaaggtgaacagcagagccgagatggagatcggcagataccactggatgtaccccggcagcaagaaccaccagtaccaccccgtgcccaccctgggcgacagagccagccccctgagcagccccggctgcttcgagtgctgcatcaagtgcctgggcggcgtgccctacgccagcctggtggccaccatcctgtgcttcagcggcgtggccctgttctgcggctgcggccacgtggccctggccggcaccgtggccatcctggagcagcacttcagcaccaacgccagcgaccacgccctgctgagcgaggtgatccagctgatgcagtacgtgatctacggcatcgccagcttcttcttcctgtacggcatcatcctgctggccgagggcttctacaccaccagcgccgtgaaggagctgcacggcgagttcaagaccaccgcctgcggcagatgcatcagcggcatgttcgtgttcctgacctacgtgctgggcgtggcctggctgggcgtgttcggcttcagcgccgtgcccgtgttcatgttctacaacatctggagcacctgcgaggtgatcaagagcccccagaccaacggcaccaccggcgtggagcagatctgcgtggacatcagacagtacggcatcatcccctggaacgccttccccggcaagatctgcggcagcgccctggagaacatctgcaacaccaacgagttctacatgagctaccacctgttcatcgtggcctgcgccggcgccggcgccaccgtgatcgccctgatccacttcctgatgatcctgagcagcaactgggcctacctgaaggacgccagcaagatgcaggcctaccaggacatcaaggccaaggaggagcaggagctgcaggacatccagagcagaagcaaggagcagctgaacagctacacctag

SEQ ID NO: 83447 - DNA, 918 bp, Artificial Sequence
  Description of Artificial Sequence: Synthetic coding sequence
atgaagcccgccatggagaccgccgccgaggagaacaccgagcagagccaggagagaaaggtgaacagcagagccgagatggagatcggcagataccactggatgtaccccggcagcaagaaccaccagtaccaccccgtgcccaccctgggcgacagagccagccccctgagcagccccggctgcttcgagtgctgcatcaagtgcctgggcggcgtgccctacgccagcctggtggccaccatcctgtgcttcagcggcgtggccctgttctgcggctgcggccacgtggccctggccggcaccgtggccatcctggagcagcacttcagcaccaacgccagcgaccacgccctgctgagcgaggtgatccagctgatgcagtacgtgatctacggcatcgccagcttcttcttcctgtacggcatcatcctgctggccgagggcttctacaccaccagcgccgtgaaggagctgcacggcgagttcaagaccaccgcctgcggcagatgcatcagcggcatgttcgtgttcctgacctacgtgctgggcgtggcctggctgggcgtgttcggcttcagcgccgtgcccgtgttcatgttctacaacatctggagcacctgcgaggtgatcaagagcccccagaccaacggcaccaccggcgtggagcagatctgcgtggacatcagacagtacggcatcatcccctggaacgccttccccggcaagatctgcggcagcgccctggagaacatctgcaacaccaacgagttctacatgagctaccacctgttcatcgtggcctgcgccggcgccggcgccaccgtgatcgccctgctgatctacatgatggccaccacctacaactacgccgtgctgaagttcaagagcagagaggactgctgcaccaagttctag

SEQ ID NO: 83448 - DNA, 798 bp, Artificial Sequence
  Description of Artificial Sequence: Synthetic coding sequence
atgaagcccgccatggagaccgccgccgaggagaacaccgagcagagccaggagagaaagggctgcttcgagtgctgcatcaagtgcctgggcggcgtgccctacgccagcctggtggccaccatcctgtgcttcagcggcgtggccctgttctgcggctgcggccacgtggccctggccggcaccgtggccatcctggagcagcacttcagcaccaacgccagcgaccacgccctgctgagcgaggtgatccagctgatgcagtacgtgatctacggcatcgccagcttcttcttcctgtacggcatcatcctgctggccgagggcttctacaccaccagcgccgtgaaggagctgcacggcgagttcaagaccaccgcctgcggcagatgcatcagcggcatgttcgtgttcctgacctacgtgctgggcgtggcctggctgggcgtgttcggcttcagcgccgtgcccgtgttcatgttctacaacatctggagcacctgcgaggtgatcaagagcccccagaccaacggcaccaccggcgtggagcagatctgcgtggacatcagacagtacggcatcatcccctggaacgccttccccggcaagatctgcggcagcgccctggagaacatctgcaacaccaacgagttctacatgagctaccacctgttcatcgtggcctgcgccggcgccggcgccaccgtgatcgccctgctgatctacatgatggccaccacctacaactacgccgtgctgaagttcaagagcagagaggactgctgcaccaagttctag

SEQ ID NO: 83449 - DNA, 540 bp, Artificial Sequence
  Description of Artificial Sequence: Synthetic coding sequence
atgcagtacgtgatctacggcatcgccagcttcttcttcctgtacggcatcatcctgctggccgagggcttctacaccaccagcgccgtgaaggagctgcacggcgagttcaagaccaccgcctgcggcagatgcatcagcggcatgttcgtgttcctgacctacgtgctgggcgtggcctggctgggcgtgttcggcttcagcgccgtgcccgtgttcatgttctacaacatctggagcacctgcgaggtgatcaagagcccccagaccaacggcaccaccggcgtggagcagatctgcgtggacatcagacagtacggcatcatcccctggaacgccttccccggcaagatctgcggcagcgccctggagaacatctgcaacaccaacgagttctacatgagctaccacctgttcatcgtggcctgcgccggcgccggcgccaccgtgatcgccctgctgatctacatgatggccaccacctacaactacgccgtgctgaagttcaagagcagagaggactgctgcaccaagttctag

SEQ ID NO: 83450 - DNA, 741 bp, Artificial Sequence
  Description of Artificial Sequence: Synthetic coding sequence
atgggctgcttcgagtgctgcatcaagtgcctgggcggcgtgccctacgccagcctggtggccaccatcctgtgcttcagcggcgtggccctgttctgcggctgcggccacgtggccctggccggcaccgtggccatcctggagcagcacttcagcaccaacgccagcgaccacgccctgctgagcgaggtgatccagctgatgcagtacgtgatctacggcatcgccagcttcttcttcctgtacggcatcatcctgctggccgagggcttctacaccaccagcgccgtgaaggagctgcacggcgagttcaagaccaccgcctgcggcagatgcatcagcggcatgttcgtgttcctgacctacgtgctgggcgtggcctggctgggcgtgttcggcttcagcgccgtgcccgtgttcatgttctacaacatctggagcacctgcgaggtgatcaagagcccccagaccaacggcaccaccggcgtggagcagatctgcgtggacatcagacagtacggcatcatcccctggaacgccttccccggcaagatctgcggcagcgccctggagaacatctgcaacaccaacgagttctacatgagctaccacctgttcatcgtggcctgcgccggcgccggcgccaccgtgatcgccctgctgatctacatgatggccaccacctacaactacgccgtgctgaagttcaagagcagagaggactgctgcaccaagttctag

SEQ ID NO: 83451 - DNA, 324 bp, Artificial Sequence
  Description of Artificial Sequence: Synthetic coding sequence
atgaagcccgccatggagaccgccgccgaggagaacaccgagcagagccaggagagaaagggctgcttcgagtgctgcatcaagtgcctgggcggcgtgccctacgccagcctggtggccaccatcctgtgcttcagcggcgtggccctgttctgcggctgcggccacgtggccctggccggcaccgtggccatcctggagcagcacttcagcaccaacgccagcgaccacgccctgctgagcgaggtgatccagctgatgcagtacgtgatctacggcatcgccagcttcttcttcctgtacggcatcatcctgctggcctag

SEQ ID NO: 83452 - DNA, 909 bp, Artificial Sequence
  Description of Artificial Sequence: Synthetic coding sequence
atggagatcggcagataccactggatgtaccccggcagcaagaaccaccagtaccaccccgtgcccaccctgggcgacagagccagccccctgagcagccccggctgcttcgagtgctgcatcaagtgcctgggcggcgtgccctacgccagcctggtggccaccatcctgtgcttcagcggcgtggccctgttctgcggctgcggccacgtggccctggccggcaccgtggccatcctggagcagcacttcagcaccaacgccagcgaccacgccctgctgagcgaggtgatccagctgatgcagtacgtgatctacggcatcgccagcttcttcttcctgtacggcatcatcctgctggccgagggcttctacaccaccagcgccgtgaaggagctgcacggcgagttcaagaccaccgcctgcggcagatgcatcagcggcatgttcgtgttcctgacctacgtgctgggcgtggcctggctgggcgtgttcggcttcagcgccgtgcccgtgttcatgttctacaacatctggagcacctgcgaggtgatcaagagcccccagaccaacggcaccaccggcgtggagcagatctgcgtggacatcagacagtacggcatcatcccctggaacgccttccccggcaagatctgcggcagcgccctggagaacatctgcaacaccaacgagttctacatgagctaccacctgttcatcgtggcctgcgccggcgccggcgccaccgtgatcgccctgatccacttcctgatgatcctgagcagcaactgggcctacctgaaggacgccagcaagatgcaggcctaccaggacatcaaggccaaggaggagcaggagctgcaggacatccagagcagaagcaaggagcagctgaacagctacacctag

SEQ ID NO: 83453 - DNA, 1863 bp, Artificial Sequence
  Description of Artificial Sequence: Synthetic coding sequence
atgagccccagccccaccgccctgttctgcctgggcctgtgcctgggcagagtgcccgcccagagcggccccctgcccaagcccagcctgcaggccctgcccagcagcctggtgcccctggagaagcccgtgaccctgagatgccagggcccccccggcgtggacctgtacagactggagaagctgagcagcagcagataccaggaccaggccgtgctgttcatccccgccatgaagagaagcctggccggcagatacagatgcagctaccagaacggcagcctgtggagcctgcccagcgaccagctggagctggtggccaccggcgtgttcgccaagcccagcctgagcgcccagcccggccccgccgtgagcagcggcggcgacgtgaccctgcagtgccagaccagatacggcttcgaccagttcgccctgtacaaggagggcgaccccgccccctacaagaaccccgagagatggtacagagccagcttccccatcatcaccgtgaccgccgcccacagcggcacctacagatgctacagcttcagcagcagagacccctacctgtggagcgcccccagcgaccccctggagctggtggtgaccggcaccagcgtgacccccagcagactgcccaccgagccccccagccccgtggccgagttcagcgaggccaccgccgagctgaccgtgagcttcaccaacgaggtgttcaccaccgagaccagcagaagcatcaccgccagccccaaggagagcgacagccccgccggcgagagctgcccccccgtgctgcaccagggccagcccggccccgacatgcccagaggctgcgaccccaacaaccccggcggcgtgagcggcagaggcctggcccagcccgaggaggcccccgccgcccagggccagggctgcgccgaggccgccagcgccccccccgccccccccgccgaccccgagatcaagagaggcagcggctggagacccaccggctgcagccagcccagagtgatgttcatgaccgccgagccccaggccagaagctaccccagagagggcagctggcacggcagaagactgaaggactggagagtgtggagcgtggaggccggcggccagagactgcagctgtggaagagaggccacgccgccagcagctggtgcagcatcagagagcccttcggccagtgcctgagcgtgtgcctgcccctgtgcctgagagcccccagcatctgggacggcagaaacctgtggagaccccacccccccccctgcaccctgtggatgacctggtaccccggctggaccacctactggcccctgagcagcaccagcctgatctgggcccccgacggcagcctgagattccccgccctgagagtggacagcgtgcccagcagcgtgcagaacccccccgtgctgcccttcggccccctgtgcagctgcctggtgttccccagaaacagccacccccacagcatcagccactgcggcctgaccaacctgctgagcagcctgagaaccggcctggccggcagcctgggcatgagcttcatcttcctgagcgtgaagctggccagatgccccctgcccttcaccctggagaacaagatcagcctgtgcaacatggtgaagccccacctgtaccagcagaacaagaagacccagaagctggccagatgcggcggcgccagcctgtacagccagcagctgagaggcctgagatgggagaacggcctgagcctgggcggcagaggctgcagcgagctgagaagccaccactgcaccctggccagagtgaccaagcccgacttcgtgagcaagaacaccggcatgaacatgagcatcaccctgatctag

SEQ ID NO: 83454 - DNA, 966 bp, Artificial Sequence
  Description of Artificial Sequence: Synthetic coding sequence
atgagccccagccccaccgccctgttctgcctgggcctgtgcctgggcagagtgcccgcccagagcggccccctgcccaagcccagcctgcaggccctgcccagcagcctggtgcccctggagaagcccgtgaccctgagatgccagggcccccccggcgtggacctgtacagactggagaagctgagcagcagcagataccaggaccaggccgtgctgttcatccccgccatgaagagaagcctggccggcagatacagatgcagctaccagaacggcagcctgtggagcctgcccagcgaccagctggagctggtggccaccggcgtgttcgccaagcccagcctgagcgcccagcccggccccgccgtgagcagcggcggcgacgtgaccctgcagtgccagaccagatacggcttcgaccagttcgccctgtacaaggagggcgaccccgccccctacaagaaccccgagagatggtacagagccagcttccccatcatcaccgtgaccgccgcccacagcggcacctacagatgctacagcttcagcagcagagacccctacctgtggagcgcccccagcgaccccctggagctggtggtgaccgagttcagcgaggccaccgccgagctgaccgtgagcttcaccaacgaggtgttcaccaccgagaccagcagaagcatcaccgccagccccaaggagagcgacagccccgccggccccgccagacagtactacaccaagggcaacctggtgagaatctgcctgggcgccgtgatcctgatcatcctggccggcttcctggccgaggactggcacagcagaagaaagagactgagacacagaggcagagccgtgcagagacccctgccccccctgccccccctgcccctgaccagaaagagcaacggcggccaggacggcggcagacaggacgtgcacagcagaggcctgtgcagctag

SEQ ID NO: 83455 - DNA, 1020 bp, Artificial Sequence
  Description of Artificial Sequence: Synthetic coding sequence
atgagccccagccccaccgccctgttctgcctgggcctgtgcctgggcagagtgcccgcccagagcggccccctgcccaagcccagcctgcaggccctgcccagcagcctggtgcccctggagaagcccgtgaccctgagatgccagggcccccccggcgtggacctgtacagactggagaagctgagcagcagcagataccaggaccaggccgtgctgttcatccccgccatgaagagaagcctggccggcagatacagatgcagctaccagaacggcagcctgtggagcctgcccagcgaccagctggagctggtggccaccggcgtgttcgccaagcccagcctgagcgcccagcccggccccgccgtgagcagcggcggcgacgtgaccctgcagtgccagaccagatacggcttcgaccagttcgccctgtacaaggagggcgaccccgccccctacaagaaccccgagagatggtacagagccagcttccccatcatcaccgtgaccgccgcccacagcggcacctacagatgctacagcttcagcagcagagacccctacctgtggagcgcccccagcgaccccctggagctggtggtgaccggcaccagcgtgacccccagcagactgcccaccgagccccccagccccgtggccgagttcagcgaggccaccgccgagctgaccgtgagcttcaccaacgaggtgttcaccaccgagaccagcagaagcatcaccgccagccccaaggagagcgacagccccgccggccccgccagacagtactacaccaagggcaacctggtgagaatctgcctgggcgccgtgatcctgatcatcctggccggcttcctggccgaggactggcacagcagaagaaagagactgagacacagaggcagagccgtgcagagacccctgccccccctgccccccctgcccctgaccagaaagagcaacggcggccaggacggcggcagacaggacgtgcacagcagaggcctgtgcagctag

SEQ ID NO: 83456 - DNA, 1866 bp, Artificial Sequence
  Description of Artificial Sequence: Synthetic coding sequence
atgggcctgctgagcgaccccgtgagaagaagagccctggccagactggtgctgagactgaacgcccccctgtgcgtgctgagctacgtggccggcatcgcctggttcctggccctggtgttcccccccctgacccagagaacctacatgagcgagaacgccatgggcagcaccatggtggaggagcagttcgccggcggcgacagagccagagccttcgccagagacttcgccgcccacagaaagaagagcggcgccctgcccgtggcctggctggagagaaccatgagaagcgtgggcctggaggtgtacacccagagcttcagcagaaagctgcccttccccgacgagacccacgagagatacatggtgagcggcaccaacgtgtacggcatcctgagagcccccagagccgccagcaccgagagcctggtgctgaccgtgccctgcggcagcgacagcaccaacagccaggccgtgggcctgctgctggccctggccgcccacttcagaggccagatctactgggccaaggacatcgtgttcctggtgaccgagcacgacctgctgggcaccgaggcctggctggaggcctaccacgacgtgaacgtgaccggcatgcagagcagccccctgcagggcagagccggcgccatccaggccgccgtggccctggagctgagcagcgacgtggtgaccagcctggacgtggccgtggagggcctgaacggccagctgcccaacctggacctgctgaacctgttccagaccttctgccagaagggcggcctgctgtgcaccctgcagggcaagctgcagcccgaggactggaccagcctggacggccccctgcagggcctgcagaccctgctgctgatggtgctgagacaggccagcggcagaccccacggcagccacggcctgttcctgagatacagagtggaggccctgaccctgagaggcatcaacagcttcagacagtacaagtacgacctggtggccgtgggcaaggccctggagggcatgttcagaaagctgaaccacctgctggagagactgcaccagagcttcttcctgtacctgctgcccggcctgagcagattcgtgagcatcggcctgtacatgcccgccgtgggcttcctgctgctggtgctgggcctgaaggccctggagctgtggatgcagctgcacgaggccggcatgggcctggaggagcccggcggcgcccccggccccagcgtgcccctgccccccagccagggcgtgggcctggccagcctggtggcccccctgctgatcagccaggccatgggcctggccctgtacgtgctgcccgtgctgggccagcacgtggccacccagcacttccccgtggccgaggccgaggccgtggtgctgaccctgctggccatctacgccgccggcctggccctgccccacaacacccacagagtggtgagcacccaggcccccgacagaggctggatggccctgaagctggtggccctgatctacctggccctgcagctgggctgcatcgccctgaccaacttcagcctgggcttcctgctggccaccaccatggtgcccaccgccgccctggccaagccccacggccccagaaccctgtacgccgccctgctggtgctgaccagccccgccgccaccctgctgggcagcctgttcctgtggagagagctgcaggaggcccccctgagcctggccgagggctggcagctgttcctggccgccctggcccagggcgtgctggagcaccacacctacggcgccctgctgttccccctgctgagcctgggcctgtacccctgctggctgctgttctggaacgtgctgttctggaagtag

SEQ ID NO: 83457 - DNA, 1686 bp, Artificial Sequence
  Description of Artificial Sequence: Synthetic coding sequence
atgggcctgctgagcgaccccgtgagaagaagagccctggccagactggtgctgagactgaacgcccccctgtgggccctgcccgtggcctggctggagagaaccatgagaagcgtgggcctggaggtgtacacccagagcttcagcagaaagctgcccttccccgacgagacccacgagagatacatggtgagcggcaccaacgtgtacggcatcctgagagcccccagagccgccagcaccgagagcctggtgctgaccgtgccctgcggcagcgacagcaccaacagccaggccgtgggcctgctgctggccctggccgcccacttcagaggccagatctactgggccaaggacatcgtgttcctggtgaccgagcacgacctgctgggcaccgaggcctggctggaggcctaccacgacgtgaacgtgaccggcatgcagagcagccccctgcagggcagagccggcgccatccaggccgccgtggccctggagctgagcagcgacgtggtgaccagcctggacgtggccgtggagggcctgaacggccagctgcccaacctggacctgctgaacctgttccagaccttctgccagaagggcggcctgctgtgcaccctgcagggcaagctgcagcccgaggactggaccagcctggacggccccctgcagggcctgcagaccctgctgctgatggtgctgagacaggccagcggcagaccccacggcagccacggcctgttcctgagatacagagtggaggccctgaccctgagaggcatcaacagcttcagacagtacaagtacgacctggtggccgtgggcaaggccctggagggcatgttcagaaagctgaaccacctgctggagagactgcaccagagcttcttcctgtacctgctgcccggcctgagcagattcgtgagcatcggcctgtacatgcccgccgtgggcttcctgctgctggtgctgggcctgaaggccctggagctgtggatgcagctgcacgaggccggcatgggcctggaggagcccggcggcgcccccggccccagcgtgcccctgccccccagccagggcgtgggcctggccagcctggtggcccccctgctgatcagccaggccatgggcctggccctgtacgtgctgcccgtgctgggccagcacgtggccacccagcacttccccgtggccgaggccgaggccgtggtgctgaccctgctggccatctacgccgccggcctggccctgccccacaacacccacagagtggtgagcacccaggcccccgacagaggctggatggccctgaagctggtggccctgatctacctggccctgcagctgggctgcatcgccctgaccaacttcagcctgggcttcctgctggccaccaccatggtgcccaccgccgccctggccaagccccacggccccagaaccctgtacgccgccctgctggtgctgaccagccccgccgccaccctgctgggcagcctgttcctgtggagagagctgcaggaggcccccctgagcctggccgagggctggcagctgttcctggccgccctggcccagggcgtgctggagcaccacacctacggcgccctgctgttccccctgctgagcctgggcctgtacccctgctggctgctgttctggaacgtgctgttctggaagtag

SEQ ID NO: 83458 - DNA, 555 bp, Artificial Sequence
  Description of Artificial Sequence: Synthetic coding sequence
atgaaggccctgggcgccgtgctgctggccctgctgctgtgcggcagacccggcagaggccagacccagcaggaggaggaggaggaggacgaggaccacggccccgacgactacgacgaggaggacgaggacgaggtggaggaggaggagaccaacagactgcccggcggcagaagcagagtgctgctgagatgctacacctgcaagagcctgcccagagacgagagatgcaacctgacccagaactgcagccacggccagacctgcaccaccctgatcgcccacggcaacaccgagagcggcctgctgaccacccacagcacctggtgcaccgacagctgccagcccatcaccaagaccgtggagggcacccaggtgaccatgacctgctgccagagcagcctgtgcaacgtgcccccctggcagagcagcagagtgcaggaccccaccggcaagggcgccggcggccccagaggcagcagcgagaccgtgggcgccgccctgctgctgaacctgctggccggcctgggcgccatgggcgccagaagaccctag

SEQ ID NO: 83459 - DNA, 582 bp, Artificial Sequence
  Description of Artificial Sequence: Synthetic coding sequence
atgggcaagcagaacagcaagctgagacccgaggtgatgcaggacctgctggagagcaccgacttcaccgagcacgagatccaggagtggtacaagggcttcctgagagactgccccagcggccacctgagcatggaggagttcaagaagatctacggcaacttcttcccctacggcgacgccagcaagttcgccgagcacgtgttcagaaccttcgacgccaacggcgacggcaccatcgacttcagagagttcatcatcgccctgagcgtgaccagcagaggcaagctggagcagaagctgaagtgggccttcagcatgtacgacctggacggcaacggctacatcagcaaggccgagatgctggagatcgtgcaggccatctacaagatggtgagcagcgtgatgaagatgcccgaggacgagagcacccccgagaagagaaccgagaagatcttcagacagatggacaccaacagagacggcaagctgagcctggaggagttcatcagaggcgccaagagcgaccccagcatcgtgagactgctgcagtgcgaccccagcagcgccggccagttctag

SEQ ID NO: 83460 - DNA, 756 bp, Artificial Sequence
  Description of Artificial Sequence: Synthetic coding sequence
atgagcgcctacggcatgcccatgtacaagagcggcgacctggtgttcgccaagctgaagggctacgcccactggcccgccagaatcgagcacatgacccagcccaacagataccaggtgttcttcttcggcacccacgagaccgccttcctgagccccaagagactgttcccctacaaggagtgcaaggagaagttcggcaagcccaacaagagaagaggcttcagcgccggcctgtgggagatcgagaacaaccccaccgtgcaggccagcgactgccccctggccagcgagaagggcagcggcgacggcccctggcccgagcccgaggccgccgagggcgacgaggacaagcccacccacgccggcggcggcggcgacgagctgggcaagcccgacgacgacaagcccaccgaggaggagaagggccccctgaagagaagcgccggcgacccccccgaggacgcccccaagagacccaaggaggccgcccccgaccaggaggaggaggccgaggccgagagagccgccgaggccgagagagccgccgccgccgccgccgccaccgccgtggacgaggagagccccttcctggtggccgtggagaacggcagcgcccccagcgagcccggcctggtgtgcgagcccccccagcccgaggaggaggagctgagagaggaggaggtggccgacgaggaggccagccaggagtggcacgccgaggcccccggcggcggcgacagagacagcctgtag

SEQ ID NO: 83461 - DNA, 531 bp, Artificial Sequence
  Description of Artificial Sequence: Synthetic coding sequence
atgagcgccttcagactgtggcccggcctgctgatcatgctgggcagcctgtgccacagaggcagcccctgcggcctgagcacccacgtggagatcggccacagagccctggagttcctgcagctgcacaacggcagagtgaactacagagagctgctgctggagcaccaggacgcctaccaggccggcatcgtgttccccgactgcttctaccccagcatctgcaagggcggcaagttccacgacgtgagcgagagcacccactggacccccttcctgaacgccagcgtgcactacatcagagagaactaccccctgccctgggagaaggacaccgagaagctggtggccttcctgttcggcatcaccagccacatggccgccgacgtgagctggcacagcctgggcctggagcagggcttcctgagaaccatgggcgccatcgacttccacggcagctacagcgaggcccacagcgccggcgacttcggcaccgtgtacctgcacctgctgaacttcctggtggtgtag

SEQ ID NO: 83462 - DNA, 831 bp, Artificial Sequence
  Description of Artificial Sequence: Synthetic coding sequence
atgaacagcaagagaatgctgctgctggtgctgttcgccttcagcctgatgctggtggagagatacttcagaaaccaccaggtggaggagctgagactgagcgactggttccaccccagaaagagacccgacgtgatcaccaagaccgactggctggcccccgtgctgtgggagggcaccttcgacagaagagtgctggagaagcactacagaagaagaaacatcaccgtgggcctggccgtgttcgccaccggcagattcgccgaggagtacctgagacccttcctgcacagcgccaacaagcacttcatgaccggctacagagtgatcttctacatcatggtggacgccttcttcaagctgcccgacatcgagcccagccccctgagaaccttcaaggccttcaaggtgggcaccgagagatggtggctggacggccccctggtgcacgtgaagagcctgggcgagcacatcgccagccacatccaggacgaggtggacttcctgttcagcatggccgccaaccaggtgttccagaacgagttcggcgtggagaccctgggccccctggtggcccagctgcacgcctggtggtacttcagaaacaccaagaacttcccctacgagagaagacccaccagcgccgcctgcatccccttcggccagggcgacttctactacggcaacctgatggtgggcggcaccccccacaacatcctggacttcatcaaggagtacctgaacggcgtgatccacgacatcaagaacggcctgaacagcacctacgagaagcacctgaacaagtacttctacctgaacaagcccacctag

SEQ ID NO: 83463 - DNA, 2166 bp, Artificial Sequence
  Description of Artificial Sequence: Synthetic coding sequence
atgctgcccagaggcagacccagagccctgggcgccgccgccctgctgctgctgctgctgctgctgggcttcctgctgttcggcggcgacctgggctgcgagagaagagagcccggcggcagagccggcgcccccggctgcttccccggccccctgatgcccagagtgccccccgacggcagactgagaagagccgccgccctggacggcgaccccggcgccggccccggcgaccacaacagaagcgactgcggcccccagcccccccccccccccaagtgcgagctgctgcacgtggccatcgtgtgcgccggccacaacagcagcagagacgtgatcaccctggtgaagagcatgctgttctacagaaagaaccccctgcacctgcacctggtgaccgacgccgtggccagaaacatcctggagaccctgttccacacctggatggtgcccgccgtgagagtgagcttctaccacgccgaccagctgaagccccaggtgagctggatccccaacaagcactacagcggcctgtacggcctgatgaagctggtgctgcccagcgccctgcccgccgagctggccagagtgatcgtgctggacaccgacgtgaccttcgccagcgacatcagcgagctgtgggccctgttcgcccacttcagcgacacccaggccatcggcctggtggagaaccagagcgactggtacctgggcaacctgtggaagaaccacagaccctggcccgccctgggcagaggcttcaacaccggcgtgatcctgctgagactggacagactgagacaggccggctgggagcagatgtggagactgaccgccagaagagagctgctgagcctgcccgccaccagcctggccgaccaggacatcttcaacgccgtgatcaaggagcaccccggcctggtgcagagactgccctgcgtgtggaacgtgcagctgagcgaccacaccctggccgagagatgctacagcgaggccagcgacctgaaggtgatccactggaacagccccaagaagctgagagtgaagaacaagcacgtggagttcttcagaaacttctacctgaccttcctggagtacgacggcaacctgctgagaagagagctgttcgtgtgccccagccagcccccccccggcgccgagcagctgcagcaggccctggcccagctggacgaggaggacccctgcttcgagttcagacagcagcagctgaccgtgcacagagtgcacgtgaccttcctgccccacgagccccccccccccagaccccacgacgtgaccctggtggcccagctgagcatggacagactgcagatgctggaggccctgtgcagacactggcccggccccatgagcctggccctgtacctgaccgacgccgaggcccagcagttcctgcacttcgtggaggccagccccgtgctggccgccagacaggacgtggcctaccacgtggtgtacagagagggccccctgtaccccgtgaaccagctgagaaacgtggccctggcccaggccctgaccccctacgtgttcctgagcgacatcgacttcctgcccgcctacagcctgtacgactacctgagagccagcatcgagcagctgggcctgggcagcagaagaaaggccgccctggtggtgcccgccttcgagaccctgagatacagattcagcttcccccacagcaaggtggagctgctggccctgctggacgccggcaccctgtacaccttcagataccacgagtggcccagaggccacgcccccaccgactacgccagatggagagaggcccaggccccctacagagtgcagtgggccgccaactacgagccctacgtggtggtgcccagagactgccccagatacgaccccagattcgtgggcttcggctggaacaaggtggcccacatcgtggagctggacgcccaggagtacgagctgctggtgctgcccgaggccttcaccatccacctgccccacgcccccagcctggacatcagcagattcagaagcagccccacctacagagactgcctgcaggccctgaaggacgagttccaccaggacctgagcagacaccacggcgccgccgccctgaagtacctgcccgccctgcagcagccccagagccccgccagaggctag

SEQ ID NO: 83464 - DNA, 870 bp, Artificial Sequence
  Description of Artificial Sequence: Synthetic coding sequence
atgtggagactgaccgccagaagagagctgctgagcctgcccgccaccagcctggccgaccaggacatcttcaacgccgtgatcaaggagcaccccggcctggtgcagagactgccctgcgtgtggaacgtgcagctgagcgaccacaccctggccgagagatgctacagcgaggccagcgacctgaaggtgatccactggaacagccccaagaagctgagagtgaagaacaagcacgtggagttcttcagaaacttctacctgaccttcctggagtacgacggcaacctgctgagaagagagctgttcgtgtgccccagccagcccccccccggcgccgagcagctgcagcaggccctggcccagctggacgaggaggacccctgcttcgagttcagacagcagcagctgaccgtgcacagagtgcacgtgaccttcctgccccacgagccccccccccccagaccccacgacgtgaccctggtggcccagctgagcatggacagactgcagatgctggaggccctgtgcagacactggcccggccccatgagcctggccctgtacctgaccgacgccgaggcccagcagttcctgcacttcgtggaggccagccccgtgctggccgccagacaggacgtggcctaccacgtggtgtacagagagggccccctgtaccccgtgaaccagctgagaaacgtggccctggcccaggccctgaccccctacgtgttcctgagcgacatcgacttcctgcccgcctacagcctgtacgactacctgagagaggccagagccggcttcaacagcagcagcacctgcggctgcgcccaccccagccaccaggccagatggcccatggtggtgtag

SEQ ID NO: 83465 - DNA, 2166 bp, Artificial Sequence; identical to SEQ ID NO: 83463
  Description of Artificial Sequence: Synthetic coding sequence

SEQ ID NO: 83466 - DNA, 2166 bp, Artificial Sequence; identical to SEQ ID NO: 83463
  Description of Artificial Sequence: Synthetic coding sequence

SEQ ID NO: 83467 - DNA, 2073 bp, Artificial Sequence
  Description of Artificial Sequence: Synthetic coding sequence
atgctgcccagaggcagacccagagccctgggcgccgccgccctgctgctgctgctgctgctgctgggcttcctgctgttcgacggcagactgagaagagccgccgccctggacggcgaccccggcgccggccccggcgaccacaacagaagcgactgcggcccccagcccccccccccccccaagtgcgagctgctgcacgtggccatcgtgtgcgccggccacaacagcagcagagacgtgatcaccctggtgaagagcatgctgttctacagaaagaaccccctgcacctgcacctggtgaccgacgccgtggccagaaacatcctggagaccctgttccacacctggatggtgcccgccgtgagagtgagcttctaccacgccgaccagctgaagccccaggtgagctggatccccaacaagcactacagcggcctgtacggcctgatgaagctggtgctgcccagcgccctgcccgccgagctggccagagtgatcgtgctggacaccgacgtgaccttcgccagcgacatcagcgagctgtgggccctgttcgcccacttcagcgacacccaggccatcggcctggtggagaaccagagcgactggtacctgggcaacctgtggaagaaccacagaccctggcccgccctgggcagaggcttcaacaccggcgtgatcctgctgagactggacagactgagacaggccggctgggagcagatgtggagactgaccgccagaagagagctgctgagcctgcccgccaccagcctggccgaccaggacatcttcaacgccgtgatcaaggagcaccccggcctggtgcagagactgccctgcgtgtggaacgtgcagctgagcgaccacaccctggccgagagatgctacagcgaggccagcgacctgaaggtgatccactggaacagccccaagaagctgagagtgaagaacaagcacgtggagttcttcagaaacttctacctgaccttcctggagtacgacggcaacctgctgagaagagagctgttcgtgtgccccagccagcccccccccggcgccgagcagctgcagcaggccctggcccagctggacgaggaggacccctgcttcgagttcagacagcagcagctgaccgtgcacagagtgcacgtgaccttcctgccccacgagccccccccccccagaccccacgacgtgaccctggtggcccagctgagcatggacagactgcagatgctggaggccctgtgcagacactggcccggccccatgagcctggccctgtacctgaccgacgccgaggcccagcagttcctgcacttcgtggaggccagccccgtgctggccgccagacaggacgtggcctaccacgtggtgtacagagagggccccctgtaccccgtgaaccagctgagaaacgtggccctggcccaggccctgaccccctacgtgttcctgagcgacatcgacttcctgcccgcctacagcctgtacgactacctgagagccagcatcgagcagctgggcctgggcagcagaagaaaggccgccctggtggtgcccgccttcgagaccctgagatacagattcagcttcccccacagcaaggtggagctgctggccctgctggacgccggcaccctgtacaccttcagataccacgagtggcccagaggccacgcccccaccgactacgccagatggagagaggcccaggccccctacagagtgcagtgggccgccaactacgagccctacgtggtggtgcccagagactgccccagatacgaccccagattcgtgggcttcggctggaacaaggtggcccacatcgtggagctggacgcccaggagtacgagctgctggtgctgcccgaggccttcaccatccacctgccccacgcccccagcctggacatcagcagattcagaagcagccccacctacagagactgcctgcaggccctgaaggacgagttccaccaggacctgagcagacaccacggcgccgccgccctgaagtacctgcccgccctgcagcagccccagagccccgccagaggctag

SEQ ID NO: 83468 - DNA, 1122 bp, Artificial Sequence
  Description of Artificial Sequence: Synthetic coding sequence
atgagcatcctgatcatcgaggccttctacggcggcagccacaagcagctggtggacctgctgcaggaggagctgggcgactgcgtggtgtacaccctgcccgccaagaagtggcactggagagccagaaccagcgccctgtacttcagccagaccatccccatcagcgagcactacagaaccctgttcgccagcagcgtgctgaacctgaccgagctggccgccctgagacccgacctgggcaagctgaagaagatcctgtacttccacgagaaccagctgatctaccccgtgaagaagtgccaggagagagacttccagtacggctacaaccagatcctgagctgcctggtggccgacgtggtggtgttcaacagcgtgttcaacatggagagcttcctgaccagcatgggcaagttcatgaagctgatccccgaccacagacccaaggacctggagagcatcatcagacccaagtgccaggtgatctacttccccatcagattccccgacgtgagcagattcatgcccaagcacaagaccacccacctgaagaagatgctgggcctgaagggcaacggcggcgccgtgctgagcatggccctgcccttccagcccgagcagagagacagcgaggacctgctgaagaacttcaacagcgagtgcgacacccactgcggcctggacaccgccagacaggagtacctgggcaacagcctgagacaggagagcgacctgaagaagagcaccagcagcgacaacagcagcagccaccacggcgagaacaagcagaacctgaccgtggacccctgcgacatcctgggcggcgtggacaaccagcagagactgctgcacatcgtgtggccccacagatggctggaggccgtgtactgcggctgctaccccctgtgccccaaggacctggtgtaccccgagatcttccccgccgagtacctgtacagcacccccgagcagctgagcaagagactgcagaacttctgcaagagacccgacatcatcagaaagcacctgtacaagggcgagatcgcccccttcagctgggccgccctgcacggcaagttcagaagcctgctgaccaccgagcccagagaggacctgtag

SEQ ID NO: 83469 - DNA, 1377 bp, Artificial Sequence
  Description of Artificial Sequence: Synthetic coding sequence
atgagcatcctgatcatcgaggccttctacggcggcagccacaagcagctggtggacctgctgcaggaggagctgggcgactgcgtggtgtacaccctgcccgccaagaagtggcactggagagccagaaccagcgccctgtacttcagccagaccatccccatcagcgagcactacagaaccctgttcgccagcagcgtgctgaacctgaccgagctggccgccctgagacccgacctgggcaagctgaagaagatcctgtacttccacgagaaccagctgatctaccccgtgaagaagtgccaggagagagacttccagtacggctacaaccagatcctgagctgcctggtggccgacgtggtggtgttcaacagcgtgttcaacatggagagcttcctgaccagcatgggcaagttcatgaagctgatccccgaccacagacccaaggacctggagagcatcatcagacccaagtgccaggtgatctacttccccatcagattccccgacgtgagcagattcatgcccaagcacaagaccacccacctgaagaagatgctgggcctgaagggcaacggcggcgccgtgctgagcatggccctgcccttccagcccgagcagagagacagcgaggacctgctgaagaacttcaacagcgagtgcgacacccactgcggcctggacaccgccagacaggagtacctgggcaacagcctgagacaggagagcgacctgaagaagagcaccagcagcgacaacagcagcagccaccacggcgagaacaagcagaacctgaccgtggacccctgcgacatcctgggcggcgtggacaaccagcagagactgctgcacatcgtgtggccccacagatgggagcacgacaaggaccccgagagcttcttcaaggtgctgatgcacctgaaggacctgggcctgaacttccacgtgagcgtgctgggcgagaccttcaccgacgtgcccgacatcttcagcgaggccaagaaggccctgggcagcagcgtgctgcactggggctacctgcccagcaaggacgactacttccaggtgctgtgcatggccgacgtggtgatcagcaccgccaagcacgagttcttcggcgtggccatgctggaggccgtgtactgcggctgctaccccctgtgccccaaggacctggtgtaccccgagatcttccccgccgagtacctgtacagcacccccgagcagctgagcaagagactgcagaacttctgcaagagacccgacatcatcagaaagcacctgtacaagggcgagatcgcccccttcagctgggccgccctgcacggcaagttcagaagcctgctgaccaccgagcccagagaggacctgtag

SEQ ID NO: 83470 - DNA, 1122 bp, Artificial Sequence; identical to SEQ ID NO: 83468
  Description of Artificial Sequence: Synthetic coding sequence

SEQ ID NO: 83471 - DNA, 1377 bp, Artificial Sequence; identical to SEQ ID NO: 83469
  Description of Artificial Sequence: Synthetic coding sequence

SEQ ID NO: 83472 - DNA, 1377 bp, Artificial Sequence; identical to SEQ ID NO: 83469
  Description of Artificial Sequence: Synthetic coding sequence

SEQ ID NO: 83473 - DNA, 300 bp, Artificial Sequence
  Description of Artificial Sequence: Synthetic coding sequence
atgagcatcctgatcatcgaggccttctacggcggcagccacaagcagctggtggacctgctgcaggaggagctgggcgactgcgtggtgtacaccctgcccgccaagaagtggcactggagagccagaaccagcgccctgtacttcagccagaccatccccatcagcgagcactacagaaccctgttcgccagcagcgtgctgaacctgaccgagctggccgccctgagacccgacctgggcaagctgaagaagatcctgtacttccacgagaaccagctgatctaccccgtgaagtag

SEQ ID NO: 83474 - DNA, 522 bp, Artificial Sequence
  Description of Artificial Sequence: Synthetic coding sequence
atgagcatcctgatcatcgaggccttctacggcggcagccacaagcagctggtggacctgctgcaggaggagctgggcgactgcgtggtgtacaccctgcccgccaagaagtggcactggagagccagaaccagcgccctgtacttcagccagaccatccccatcagcgagcactacagaaccctgttcgccagcagcgtgctgaacctgaccgagctggccgccctgagacccgacctgggcaagctgaagaagatcctgtacttccacgagaaccagctgatctaccccgtgaagaagtgccaggagagagacttccagtacggctacaaccagatcctgagctgcctggtggccgacgtggtggtgttcaacagcgtgttcaacatggagagcttcctgaccagcatgggcaagttcatgaagctgatccccgaccacagacccaaggacctggagagcatcatcagacccaagtgccaggtgatctacttccccatcagattccccgacgtgagctag

SEQ ID NO: 83475 - DNA, 1377 bp, Artificial Sequence; identical to SEQ ID NO: 83469
  Description of Artificial Sequence: Synthetic coding sequence

SEQ ID NO: 83476 - DNA, 2220 bp, Artificial Sequence
  Description of Artificial Sequence: Synthetic coding sequence
atgcccagccccagacccgtgctgctgagaggcgccagagccgccctgctgctgctgctgccccccagactgctggccagacccagcctgctgctgagaagaagcctgagcgccgccagctgcccccccatcagcctgcccgccgccgccagcagaagcagcatggacggcgccggcgccgaggaggtgctggcccccctgagactggccgtgagacagcagggcgacctggtgagaaagctgaaggaggacaaggccccccaggtggacgtggacaaggccgtggccgagctgaaggccagaaagagagtgctggaggccaaggagctggccctgcagcccaaggacgacatcgtggacagagccaagatggaggacaccctgaagagaagattcttctacgaccaggccttcgccatctacggcggcgtgagcggcctgtacgacttcggccccgtgggctgcgccctgaagaacaacatcatccagacctggagacagcacttcatccaggaggagcagatcctggagatcgactgcaccatgctgacccccgagcccgtgctgaagaccagcggccacgtggacaagttcgccgacttcatggtgaaggacgtgaagaacggcgagtgcttcagagccgaccacctgctgaaggcccacctgcagaagctgatgagcgacaagaagtgcagcgtggagaagaagagcgagatggagagcgtgctggcccagctggacaactacggccagcaggagctggccgacctgttcgtgaactacaacgtgaagagccccatcaccggcaacgacctgagcccccccgtgagcttcaacctgatgttcaagaccttcatcggccccggcggcaacatgcccggctacctgagacccgagaccgcccagggcatcttcctgaacttcaagagactgctggagttcaaccagggcaagctgcccttcgccgccgcccagatcggcaacagcttcagaaacgagatcagccccagaagcggcctgatcagagtgagagagttcaccatggccgagatcgagcacttcgtggaccccagcgagaaggaccaccccaagttccagaacgtggccgacctgcacctgtacctgtacagcgccaaggcccaggtgagcggccagagcgccagaaagatgagactgggcgacgccgtggagcagggcgtgatcaacaacaccgtgctgggctacttcatcggcagaatctacctgtacctgaccaaggtgggcatcagccccgacaagctgagattcagacagcacatggagaacgagatggcccactacgcctgcgactgctgggacgccgagagcaagaccagctacggctggatcgagatcgtgggctgcgccgacagaagctgctacgacctgagctgccacgccagagccaccaaggtgcccctggtggccgagaagcccctgaaggagcccaagaccgtgaacgtggtgcagttcgagcccagcaagggcgccatcggcaaggcctacaagaaggacgccaagctggtgatggagtacctggccatctgcgacgagtgctacatcaccgagatggagatgctgctgaacgagaagggcgagttcaccatcgagaccgagggcaagaccttccagctgaccaaggacatgatcaacgtgaagagattccagaagaccctgtacgtggaggaggtggtgcccaacgtgatcgagcccagcttcggcctgggcagaatcatgtacaccgtgttcgagcacaccttccacgtgagagagggcgacgagcagagaaccttcttcagcttccccgccgtggtggcccccttcaagtgcagcgtgctgcccctgagccagaaccaggagttcatgcccttcgtgaaggagctgagcgaggccctgaccagacacggcgtgagccacaaggtggacgacagcagcggcagcatcggcagaagatacgccagaaccgacgagatcggcgtggccttcggcgtgaccatcgacttcgacaccgtgaacaagaccccccacaccgccaccctgagagacagagacagcatgagacagatcagagccgagatcagcgagctgcccagcatcgtgcaggacctggccaacggcaacatcacctgggccgacgtggaggccagataccccctgttcgagggccaggagaccggcaagaaggagaccatcgaggagtag

SEQ ID NO: 83477 - DNA, 555 bp, Artificial Sequence
  Description of Artificial Sequence: Synthetic coding sequence
atggccgagccccagccccccagcggcggcctgaccgacgaggccgccctgagctgctgcagcgacgccgaccccagcaccaaggacttcctgctgcagcagaccatgctgagagtgaaggaccccaagaagagcctggacttctacaccagagtgctgggcatgaccctgatccagaagtgcgacttccccatcatgaagttcagcctgtacttcctggcctacgaggacaagaacgacatccccaaggagaaggacgagaagatcgcctgggccctgagcagaaaggccaccctggagctgacccacaactggggcaccgaggacgacgagacccagagctaccacaacggcaacagcgaccccagaggcttcggccacatcggcatcgccgtgcccgacgtgtacagcgcctgcaagagattcgaggagctgggcgtgaagttcgtgaagaagcccgacgacggcaagatgaagggcctggccttcatccaggaccccgacggctactggatcgagatcctgaaccccaacaagatggccaccctgatgtag

SEQ ID NO: 83478 - DNA, 987 bp, Artificial Sequence
  Description of Artificial Sequence: Synthetic coding sequence
atgagacccgtgagactgatgaaggtgttcgtgaccagaagaatccccgccgagggcagagtggccctggccagagccgccgactgcgaggtggagcagtgggacagcgacgagcccatccccgccaaggagctggagagaggcgtggccggcgcccacggcctgctgtgcctgctgagcgaccacgtggacaagagaatcctggacgccgccggcgccaacctgaaggtgatcagcaccatgagcgtgggcatcgaccacctggccctggacgagatcaagaagagaggcatcagagtgggctacacccccgacgtgctgaccgacaccaccgccgagctggccgtgagcctgctgctgaccacctgcagaagactgcccgaggccatcgaggaggtgaagaacggcggctggaccagctggaagcccctgtggctgtgcggctacggcctgacccagagcaccgtgggcatcatcggcctgggcagaatcggccaggccatcgccagaagactgaagcccttcggcgtgcagagattcctgtacaccggcagacagcccagacccgaggaggccgccgagttccaggccgagttcgtgagcacccccgagctggccgcccagagcgacttcatcgtggtggcctgcagcctgacccccgccaccgagggcctgtgcaacaaggacttcttccagaagatgaaggagaccgccgtgttcatcaacatcagcagaggcgacgtggtgaaccaggacgacctgtaccaggccctggccagcggcaagatcgccgccgccggcctggacgtgaccagccccgagcccctgcccaccaaccaccccctgctgaccctgaagaactgcgtgatcctgccccacatcggcagcgccacccacagaaccagaaacaccatgagcctgctggccgccaacaacctgctggccggcctgagaggcgagcccatgcccagcgagctgaagctgtag

SEQ ID NO: 83479 - DNA, 1188 bp, Artificial Sequence
  Description of Artificial Sequence: Synthetic coding sequence
atgagacccgtgagactgatgaaggtgttcgtgaccagaagaatccccgccgagggcagagtggccctggccagagccgccgactgcgaggtggagcagtgggacagcgacgagcccatccccgccaaggagctggagagaggcgtggccggcgcccacggcctgctgtgcctgctgagcgaccacgtggacaagagaatcctggacgccgccggcgccaacctgaaggtgatcagcaccatgagcgtgggcatcgaccacctggccctggacgagatcaagaagagaggcatcagagtgggctacacccccgacgtgctgaccgacaccaccgccgagctggccgtgagcctgctgctgaccacctgcagaagactgcccgaggccatcgaggaggtgaagaacggcggctggaccagctggaagcccctgtggctgtgcggctacggcctgacccagagcaccgtgggcatcatcggcctgggcagaatcggccaggccatcgccagaagactgaagcccttcggcgtgcagagattcctgtacaccggcagacagcccagacccgaggaggccgccgagttccaggccgagttcgtgagcacccccgagctggccgcccagagcgacttcatcgtggtggcctgcagcctgacccccgccaccgagggcctgtgcaacaaggacttcttccagaagatgaaggagaccgccgtgttcatcaacatcagcagataccccagagccaccctgcccagcaagcccggcgaggagcccagccccctgctgcccagcggcgacttcctgcccagaggcctgctggtgagaccccaggccgagctggccggcttccacaagcccaacaaccagctgagaaacagctgggagtacaccagacccccctacagagaggaggagcccagcgagtgggcctggcccgtgtgcttcagcgccgtggcccccaccagaagaggcctggcccacagcagcgtggccagcggcagcgtgcccagagagcccctgcaggcccactacccccccccccagagagccggcctggaggacctgaagggccccctggaggccgccagccacaccgccgagcccggcttcgtgtggctgtggttcagcgacaccctgaacctgatgctgctgggcggccagaccctgaagctgacctggagctag

SEQ ID NO: 83480 - DNA, 759 bp, Artificial Sequence
  Description of Artificial Sequence: Synthetic coding sequence
atgctgggcggcgtgcccaccctgtgcggcaccggcaacgagacctggaccctgctggccctgggccaggccatcgccagaagactgaagcccttcggcgtgcagagattcctgtacaccggcagacagcccagacccgaggaggccgccgagttccaggccgagttcgtgagcacccccgagctggccgcccagagcgacttcatcgtggtggcctgcagcctgacccccgccaccgagggcctgtgcaacaaggacttcttccagaagatgaaggagaccgccgtgttcatcaacatcagcagataccccagagccaccctgcccagcaagcccggcgaggagcccagccccctgctgcccagcggcgacttcctgcccagaggcctgctggtgagaccccaggccgagctggccggcttccacaagcccaacaaccagctgagaaacagctgggagtacaccagacccccctacagagaggaggagcccagcgagtgggcctggcccgtgtgcttcagcgccgtggcccccaccagaagaggcctggcccacagcagcgtggccagcggcagcgtgcccagagagcccctgcaggcccactacccccccccccagagagccggcctggaggacctgaagggccccctggaggccgccagccacaccgccgagcccggcttcgtgtggctgtggttcagcgacaccctgaacctgatgctgctgggcggccagaccctgaagctgacctggagctag

SEQ ID NO: 83481 - DNA, 1677 bp, Artificial Sequence
  Description of Artificial Sequence: Synthetic coding sequence
atggagctgagagccagaggctggtggctgctgtgcgccgccgccgccctggtggcctgcgccagaggcgaccccgccagcaagagcagaagctgcggcgaggtgagacagatctacggcgccaagggcttcagcctgagcgacgtgccccaggccgagatcagcggcgagcacctgagaatctgcccccagggctacacctgctgcaccagcgagatggaggagaacctggccaacagaagccacgccgagctggagaccgccctgagagacagcagcagagtgctgcaggccatgctggccacccagctgagaagcttcgacgaccacttccagcacctgctgaacgacagcgagagaaccctgcaggccaccttccccggcgccttcggcgagctgtacacccagaacgccagagccttcagagacctgtacagcgagctgagactgtactacagaggcgccaacctgcacctggaggagaccctggccgagttctgggccagactgctggagagactgttcaagcagctgcacccccagctgctgctgcccgacgactacctggactgcctgggcaagcaggccgaggccctgagacccttcggcgaggcccccagagagctgagactgagagccaccagagccttcgtggccgccagaagcttcgtgcagggcctgggcgtggccagcgacgtggtgagaaaggtggcccaggtgcccctgggccccgagtgcagcagagccgtgatgaagctggtgtactgcgcccactgcctgggcgtgcccggcgccagaccctgccccgactactgcagaaacgtgctgaagggctgcctggccaaccaggccgacctggacgccgagtggagaaacctgctggacagcatggtgctgatcaccgacaagttctggggcaccagcggcgtggagagcgtgatcggcagcgtgcacacctggctggccgaggccatcaacgccctgcaggacaacagagacaccctgaccgccaaggtgatccagggctgcggcaaccccaaggtgaacccccagggccccggccccgaggagaagagaagaagaggcaagctggcccccagagagagaccccccagcggcaccctggagaagctggtgagcgaggccaaggcccagctgagagacgtgcaggacttctggatcagcctgcccggcaccctgtgcagcgagaagatggccctgagcaccgccagcgacgacagatgctggaacggcatggccagaggcagatacctgcccgaggtgatgggcgacggcctggccaaccagatcaacaaccccgaggtggaggtggacatcaccaagcccgacatgaccatcagacagcagatcatgcagctgaagatcatgaccaacagactgagaagcgcctacaacggcaacgacgtggacttccaggacgccagcgacgacggcagcggcagcggcagcggcgacggctgcctggacgacctgtgcagcagaaaggtgagcagaaagagcagcagcagcagaacccccctgacccacgccctgcccggcctgagcgagcaggagggccagaagaccagcgccgccagctgcccccagccccccaccttcctgctgcccctgctgctgttcctggccctgaccgtggccagacccagatggagatag

SEQ ID NO: 83482 - DNA, 1743 bp, Artificial Sequence
  Description of Artificial Sequence: Synthetic coding sequence
atggccggcaccgtgagaaccgcctgcctggtggtggccatgctgctgagcctggacttccccggccaggcccagccccccccccccccccccgacgccacctgccaccaggtgagaagcttcttccagagactgcagcccggcctgaagtgggtgcccgagacccccgtgcccggcagcgacctgcaggtgtgcctgcccaagggccccacctgctgcagcagaaagatggaggagaagtaccagctgaccgccagactgaacatggagcagctgctgcagagcgccagcatggagctgaagttcctgatcatccagaacgccgccgtgttccaggaggccttcgagatcgtggtgagacacgccaagaactacaccaacgccatgttcaagaacaactaccccagcctgaccccccaggccttcgagttcgtgggcgagttcttcaccgacgtgagcctgtacatcctgggcagcgacatcaacgtggacgacatggtgaacgagctgttcgacagcctgttccccgtgatctacacccagctgatgaaccccggcctgcccgacagcgccctggacatcaacgagtgcctgagaggcgccagaagagacctgaaggtgttcggcaacttccccaagctgatcatgacccaggtgagcaagagcctgcaggtgaccagaatcttcctgcaggccctgaacctgggcatcgaggtgatcaacaccaccgaccacctgaagttcagcaaggactgcggcagaatgctgaccagaatgtggtactgcagctactgccagggcctgatgatggtgaagccctgcggcggctactgcaacgtggtgatgcagggctgcatggccggcgtggtggagatcgacaagtactggagagagtacatcctgagcctggaggagctggtgaacggcatgtacagaatctacgacatggagaacgtgctgctgggcctgttcagcaccatccacgacagcatccagtacgtgcagaagaacgccggcaagctgaccaccaccatcggcaagctgtgcgcccacagccagcagagacagtacagaagcgcctactaccccgaggacctgttcatcgacaagaaggtgctgaaggtggcccacgtggagcacgaggagaccctgagcagcagaagaagagagctgatccagaagctgaagagcttcatcagcttctacagcgccctgcccggctacatctgcagccacagccccgtggccgagaacgacaccctgtgctggaacggccaggagctggtggagagatacagccagaaggccgccagaaacggcatgaagaaccagttcaacctgcacgagctgaagatgaagggccccgagcccgtggtgagccagatcatcgacaagctgaagcacatcaaccagctgctgagaaccatgagcatgcccaagggcagagtgctggacaagaacctggacgaggagggcttcgagagcggcgactgcggcgacgacgaggacgagtgcatcggcggcagcggcgacggcatgatcaaggtgaagaaccagctgagattcctggccgagctggcctacgacctggacgtggacgacgcccccggcaacagccagcaggccacccccaaggacaacgagatcagcaccttccacaacctgggcaacgtgcacagccccctgaagctgctgaccagcatggccatcagcgtggtgtgcttcttcttcctggtgcactag

SEQ ID NO: 83483 - DNA, 1812 bp, Artificial Sequence
  Description of Artificial Sequence: Synthetic coding sequence
atggccggcaccgtgagaaccgcctgcctggtggtggccatgctgctgagcctggacttccccggccaggcccagccccccccccccccccccgacgccacctgccaccaggtgagaagcttcttccagagactgcagcccggcctgaagtgggtgcccgagacccccgtgcccggcagcgacctgcaggtgtgcctgcccaagggccccacctgctgcagcagaaagatggaggagaagtaccagctgaccgccagactgaacatggagcagctgctgcagagcgccagcatggagctgaagttcctgatcatccagaacgccgccgtgttccaggaggccttcgagatcgtggtgagacacgccaagaactacaccaacgccatgttcaagaacaactaccccagcctgaccccccaggccttcgagttcgtgggcgagttcttcaccgacgtgagcctgtacatcctgggcagcgacatcaacgtggacgacatggtgaacgagctgttcgacagcctgttccccgtgatctacacccagctgatgaaccccggcctgcccgacagcgccctggacatcaacgagtgcctgagaggcgccagaagagacctgaaggtgttcggcaacttccccaagctgatcatgacccaggtgagcaagagcctgcaggtgaccagaatcttcctgcaggccctgaacctgggcatcgaggtgatcaacaccaccgaccacctgaagttcagcaaggactgcggcagaatgctgaccagaatgtggtactgcagctactgccagggcctgatgatggtgaagccctgcggcggctactgcaacgtggtgatgcagggctgcatggccggcgtggtggagatcgacaagtactggagagagtacatcctgagcctggaggagctggtgaacggcatgtacagaatctacgacatggagaacgtgctgctgggcctgttcagcaccatccacgacagcatccagtacgtgcagaagaacgccggcaagctgaccaccaccgagaccgagaagaagatctggcacttcaagtaccccatcttcttcctgtgcatcggcctggacctgcagatcggcaagctgtgcgcccacagccagcagagacagtacagaagcgcctactaccccgaggacctgttcatcgacaagaaggtgctgaaggtggcccacgtggagcacgaggagaccctgagcagcagaagaagagagctgatccagaagctgaagagcttcatcagcttctacagcgccctgcccggctacatctgcagccacagccccgtggccgagaacgacaccctgtgctggaacggccaggagctggtggagagatacagccagaaggccgccagaaacggcatgaagaaccagttcaacctgcacgagctgaagatgaagggccccgagcccgtggtgagccagatcatcgacaagctgaagcacatcaaccagctgctgagaaccatgagcatgcccaagggcagagtgctggacaagaacctggacgaggagggcttcgagagcggcgactgcggcgacgacgaggacgagtgcatcggcggcagcggcgacggcatgatcaaggtgaagaaccagctgagattcctggccgagctggcctacgacctggacgtggacgacgcccccggcaacagccagcaggccacccccaaggacaacgagatcagcaccttccacaacctgggcaacgtgcacagccccctgaagctgctgaccagcatggccatcagcgtggtgtgcttcttcttcctggtgcactag

SEQ ID NO: 83484 - DNA, 771 bp, Artificial Sequence
  Description of Artificial Sequence: Synthetic coding sequence
tgaaagccctgcggcggctactgcaacgtggtgatgcagggctgcatggccggcgtggtggagatcgacaagtactggagagagtacatcctgagcctggaggagctggtgaacggcatgtacagaatctacgacatggagaacgtgctgctgggcctgttcagcaccatccacgacagcatccagtacgtgcagaagaacgccggcaagctgaccaccaccatcggcaagctgtgcgcccacagccagcagagacagtacagaagcgcctactaccccgaggacctgttcatcgacaagaaggtgctgaaggtggcccacgtggagcacgaggagaccctgagcagcagaagaagagagctgatccagaagctgaagagcttcatcagcttctacagcgccctgcccggctacatctgcagccacagccccgtggccgagaacgacaccctgtgctggaacggccaggagctggtggagagatacagccagaaggccgccagaaacggcatgaagaaccagttcaacctgcacgagctgaagatgaagggccccgagcccgtggtgagccagatcatcgacaagctgaagcacatcaaccagctgctgagaaccatgagcatgcccaagggcagagtgctggacaagaacctggacgaggagggcttcgagagcggcgactgcggcgacgacgaggacgagtgcatcggcggcagcggcgacggcatgatcaaggtgaagaaccagctgagattcctggccggcaactag

SEQ ID NO: 83485 - DNA, 1581 bp, Artificial Sequence
  Description of Artificial Sequence: Synthetic coding sequence
atggccggcaccgtgagaaccgcctgcctggtggtggccatgctgctgagcctggacttccccggccaggcccagccccccccccccccccccgacgccacctgccaccaggtgagaagcttcttccagagactgcagcccggcctgaagtgggtgcccgagacccccgtgcccgaggccttcgagatcgtggtgagacacgccaagaactacaccaacgccatgttcaagaacaactaccccagcctgaccccccaggccttcgagttcgtgggcgagttcttcaccgacgtgagcctgtacatcctgggcagcgacatcaacgtggacgacatggtgaacgagctgttcgacagcctgttccccgtgatctacacccagctgatgaaccccggcctgcccgacagcgccctggacatcaacgagtgcctgagaggcgccagaagagacctgaaggtgttcggcaacttccccaagctgatcatgacccaggtgagcaagagcctgcaggtgaccagaatcttcctgcaggccctgaacctgggcatcgaggtgatcaacaccaccgaccacctgaagttcagcaaggactgcggcagaatgctgaccagaatgtggtactgcagctactgccagggcctgatgatggtgaagccctgcggcggctactgcaacgtggtgatgcagggctgcatggccggcgtggtggagatcgacaagtactggagagagtacatcctgagcctggaggagctggtgaacggcatgtacagaatctacgacatggagaacgtgctgctgggcctgttcagcaccatccacgacagcatccagtacgtgcagaagaacgccggcaagctgaccaccaccatcggcaagctgtgcgcccacagccagcagagacagtacagaagcgcctactaccccgaggacctgttcatcgacaagaaggtgctgaaggtggcccacgtggagcacgaggagaccctgagcagcagaagaagagagctgatccagaagctgaagagcttcatcagcttctacagcgccctgcccggctacatctgcagccacagccccgtggccgagaacgacaccctgtgctggaacggccaggagctggtggagagatacagccagaaggccgccagaaacggcatgaagaaccagttcaacctgcacgagctgaagatgaagggccccgagcccgtggtgagccagatcatcgacaagctgaagcacatcaaccagctgctgagaaccatgagcatgcccaagggcagagtgctggacaagaacctggacgaggagggcttcgagagcggcgactgcggcgacgacgaggacgagtgcatcggcggcagcggcgacggcatgatcaaggtgaagaaccagctgagattcctggccgagctggcctacgacctggacgtggacgacgcccccggcaacagccagcaggccacccccaaggacaacgagatcagcaccttccacaacctgggcaacgtgcacagccccctgaagctgctgaccagcatggccatcagcgtggtgtgcttcttcttcctggtgcactag

SEQ ID NO: 83486 - DNA, 1671 bp, Artificial Sequence
  Description of Artificial Sequence: Synthetic coding sequence
atggccagattcggcctgcccgccctgctgtgcaccctggccgtgctgagcgccgccctgctggccgccgagctgaagagcaagagctgcagcgaggtgagaagactgtacgtgagcaagggcttcaacaagaacgacgcccccctgcacgagatcaacggcgaccacctgaagatctgcccccagggcagcacctgctgcagccaggagatggaggagaagtacagcctgcagagcaaggacgacttcaagagcgtggtgagcgagcagtgcaaccacctgcaggccgtgttcgccagcagatacaagaagttcgacgagttcttcaaggagctgctggagaacgccgagaagagcctgaacgacatgttcgtgaagacctacggccacctgtacatgcagaacagcgagctgttcaaggacctgttcgtggagctgaagagatactacgtggtgggcaacgtgaacctggaggagatgctgaacgacttctgggccagactgctggagagaatgttcagactggtgaacagccagtaccacttcaccgacgagtacctggagtgcgtgagcaagtacaccgagcagctgaagcccttcggcgacgtgcccagaaagctgaagctgcaggtgaccagagccttcgtggccgccagaaccttcgcccagggcctggccgtggccggcgacgtggtgagcaaggtgagcgtggtgaaccccaccgcccagtgcacccacgccctgctgaagatgatctactgcagccactgcagaggcctggtgaccgtgaagccctgctacaactactgcagcaacatcatgagaggctgcctggccaaccagggcgacctggacttcgagtggaacaacttcatcgacgccatgctgatggtggccgagagactggagggccccttcaacatcgagagcgtgatggaccccatcgacgtgaagatcagcgacgccatcatgaacatgcaggacaacagcgtgcaggtgagccagaaggtgttccagggctgcggcccccccaagcccctgcccgccggcagaatcagcagaagcatcagcgagagcgccttcagcgccagattcagaccccaccaccccgaggagagacccaccaccgccgccggcaccagcctggacagactggtgaccgacgtgaaggagaagctgaagcaggccaagaagttctggagcagcctgcccagcaacgtgtgcaacgacgagagaatggccgccggcaacggcaacgaggacgactgctggaacggcaagggcaagagcagatacctgttcgccgtgaccggcaacggcctggccaaccagggcaacaaccccgaggtgcaggtggacaccagcaagcccgacatcctgatcctgagacagatcatggccctgagagtgatgaccagcaagatgaagaacgcctacaacggcaacgacgtggacttcttcgacatcagcgacgagagcagcggcgagggcagcggcagcggctgcgagtaccagcagtgccccagcgagttcgactacaacgccaccgaccacgccggcaagagcgccaacgagaaggccgacagcgccggcgtgagacccggcgcccaggcctacctgctgaccgtgttctgcatcctgttcctggtgatgcagagagagtggagatag

SEQ ID NO: 83487 - DNA, 1461 bp, Artificial Sequence
  Description of Artificial Sequence: Synthetic coding sequence
atggaggagaagtacagcctgcagagcaaggacgacttcaagagcgtggtgagcgagcagtgcaaccacctgcaggccgtgttcgccagcagatacaagaagttcgacgagttcttcaaggagctgctggagaacgccgagaagagcctgaacgacatgttcgtgaagacctacggccacctgtacatgcagaacagcgagctgttcaaggacctgttcgtggagctgaagagatactacgtggtgggcaacgtgaacctggaggagatgctgaacgacttctgggccagactgctggagagaatgttcagactggtgaacagccagtaccacttcaccgacgagtacctggagtgcgtgagcaagtacaccgagcagctgaagcccttcggcgacgtgcccagaaagctgaagctgcaggtgaccagagccttcgtggccgccagaaccttcgcccagggcctggccgtggccggcgacgtggtgagcaaggtgagcgtggtgaaccccaccgcccagtgcacccacgccctgctgaagatgatctactgcagccactgcagaggcctggtgaccgtgaagccctgctacaactactgcagcaacatcatgagaggctgcctggccaaccagggcgacctggacttcgagtggaacaacttcatcgacgccatgctgatggtggccgagagactggagggccccttcaacatcgagagcgtgatggaccccatcgacgtgaagatcagcgacgccatcatgaacatgcaggacaacagcgtgcaggtgagccagaaggtgttccagggctgcggcccccccaagcccctgcccgccggcagaatcagcagaagcatcagcgagagcgccttcagcgccagattcagaccccaccaccccgaggagagacccaccaccgccgccggcaccagcctggacagactggtgaccgacgtgaaggagaagctgaagcaggccaagaagttctggagcagcctgcccagcaacgtgtgcaacgacgagagaatggccgccggcaacggcaacgaggacgactgctggaacggcaagggcaagagcagatacctgttcgccgtgaccggcaacggcctggccaaccagggcaacaaccccgaggtgcaggtggacaccagcaagcccgacatcctgatcctgagacagatcatggccctgagagtgatgaccagcaagatgaagaacgcctacaacggcaacgacgtggacttcttcgacatcagcgacgagagcagcggcgagggcagcggcagcggctgcgagtaccagcagtgccccagcgagttcgactacaacgccaccgaccacgccggcaagagcgccaacgagaaggccgacagcgccggcgtgagacccggcgcccaggcctacctgctgaccgtgttctgcatcctgttcctggtgatgcagagagagtggagatag

SEQ ID NO: 83488 - DNA, 1653 bp, Artificial Sequence
  Description of Artificial Sequence: Synthetic coding sequence
atggccagattcggcctgcccgccctgctgtgcaccctggccgtgctgagcgccgccctgctggccgccgagctgaagagcaagagctgcagcgaggtgagaagactgtacgtgagcaagggcttcaacaagaacgacgcccccctgcacgagatcaacggcgaccacgaggacctgagccccggcttctacctgctgctgagcagagacggcggctacagcctgcagagcaaggacgacttcaagagcgtggtgagcgagcagtgcaaccacctgcaggccgtgttcgccagcagatacaagaagttcgacgagttcttcaaggagctgctggagaacgccgagaagagcctgaacgacatgttcgtgaagacctacggccacctgtacatgcagaacagcgagctgttcaaggacctgttcgtggagctgaagagatactacgtggtgggcaacgtgaacctggaggagatgctgaacgacttctgggccagactgctggagagaatgttcagactggtgaacagccagtaccacttcaccgacgagtacctggagtgcgtgagcaagtacaccgagcagctgaagcccttcggcgacgtgcccagaaagctgaagctgcaggtgaccagagccttcgtggccgccagaaccttcgcccagggcctggccgtggccggcgacgtggtgagcaaggtgagcgtgcccagctgcacccacgccctgctgaagatgatctactgcagccactgcagaggcctggtgaccgtgaagccctgctacaactactgcagcaacatcatgagaggctgcctggccaaccagggcgacctggacttcgagtggaacaacttcatcgacgccatgctgatggtggccgagagactggagggccccttcaacatcgagagcgtgatggaccccatcgacgtgaagatcagcgacgccatcatgaacatgcaggacaacagcgtgcaggtgagccagaaggtgttccagggctgcggcccccccaagcccctgcccgccggcagaatcagcagaagcatcagcgagagcgccttcagcgccagattcagaccccaccaccccgaggagagacccaccaccgccgccggcaccagcctggacagactggtgaccgacgtgaaggagaagctgaagcaggccaagaagttctggagcagcctgcccagcaacgtgtgcaacgacgagagaatggccgccggcaacggcaacgaggacgactgctggaacggcaagggcaagagcagatacctgttcgccgtgaccggcaacggcctggccaaccagggcaacaaccccgaggtgcaggtggacaccagcaagcccgacatcctgatcctgagacagatcatggccctgagagtgatgaccagcaagatgaagaacgcctacaacggcaacgacgtggacttcttcgacatcagcgacgagagcagcggcgagggcagcggcagcggctgcgagtaccagcagtgccccagcgagttcgactacaacgccaccgaccacgccggcaagagcgccaacgagaaggccgacagcgccggcgtgagacccggcgcccaggcctacctgctgaccgtgttctgcatcctgttcctggtgatgcagagagagtggagatag

SEQ ID NO: 83489 - DNA, 1719 bp, Artificial Sequence
  Description of Artificial Sequence: Synthetic coding sequence
atggacgcccagacctggcccgtgggcttcagatgcctgctgctgctggccctggtgggcagcgccagaagcgagggcgtgcagacctgcgaggaggtgagaaagctgttccagtggagactgctgggcgccgtgagaggcctgcccgacagccccagagccggccccgacctgcaggtgtgcatcagcaagaagcccacctgctgcaccagaaagatggaggagagataccagatcgccgccagacaggacatgcagcagttcctgcagaccagcagcagcaccctgaagttcctgatcagcagaaacgccgccgccttccaggagaccctggagaccctgatcaagcaggccgagaactacaccagcatcctgttctgcagcacctacagaaacatggccctggaggccgccgccagcgtgcaggagttcttcaccgacgtgggcctgtacctgttcggcgccgacgtgaaccccgaggagttcgtgaacagattcttcgacagcctgttccccctggtgtacaaccacctgatcaaccccggcgtgaccgacagcagcctggagtacagcgagtgcatcagaatggccagaagagacgtgagccccttcggcaacatcccccagagagtgatgggccagatgggcagaagcctgctgcccagcagaaccttcctgcaggccctgaacctgggcatcgaggtgatcaacaccaccgactacctgcacttcagcaaggagtgcagcagagccctgctgaagatgcagtactgcccccactgccagggcctggccctgaccaagccctgcatgggctactgcctgaacgtgatgagaggctgcctggcccacatggccgagctgaacccccactggcacgcctacatcagaagcctggaggagctgagcgacgccatgcacggcacctacgacatcggccacgtgctgctgaacttccacctgctggtgaacgacgccgtgctgcaggcccacctgaacggccagaagctgctggagcaggtgaacagaatctgcggcagacccgtgagaacccccacccagagccccagatgcagcttcgaccagagcaaggagaagcacggcatgaagaccaccaccagaaacagcgaggagaccctggccaacagaagaaaggagttcatcaacagcctgagactgtacagaagcttctacggcggcctggccgaccagctgtgcgccaacgagctggccgccgccgacggcctgccctgctggaacggcgaggacatcgtgaagagctacacccagagagtggtgggcaacggcatcaaggcccagagcggcaaccccgaggtgaaggtgaagggcatcgaccccgtgatcaaccagatcatcgacaagctgaagcacgtggtgcagctgctgcagggcagaagccccaagcccgacaagtgggagctgctgcagctgggcagcggcggcggcatggtggagcaggtgagcggcgactgcgacgacgaggacggctgcggcggcagcggcagcggcgaggtgaagagaaccctgaagatcaccgactggatgcccgacgacatgaacttcagcgacgtgaagcagatccaccagaccgacaccggcagcaccctggacaccaccggcgccggctgcgccgtggccaccgagagcatgaccttcaccctgatcagcgtggtgatgctgctgcccggcatctggtag

SEQ ID NO: 83490 - DNA, 1668 bp, Artificial Sequence
  Description of Artificial Sequence: Synthetic coding sequence
atgcccagctggatcggcgccgtgatcctgcccctgctgggcctgctgctgagcctgcccgccggcgccgacgtgaaggccagaagctgcggcgaggtgagacaggcctacggcgccaagggcttcagcctggccgacatcccctaccaggagatcgccggcgagcacctgagaatctgcccccaggagtacacctgctgcaccaccgagatggaggacaagctgagccagcagagcaagctggagttcgagaacctggtggaggagaccagccacttcgtgagaaccaccttcgtgagcagacacaagaagttcgacgagttcttcagagagctgctggagaacgccgagaagagcctgaacgacatgttcgtgagaacctacggcatgctgtacatgcagaacagcgaggtgttccaggacctgttcaccgagctgaagagatactacaccggcggcaacgtgaacctggaggagatgctgaacgacttctgggccagactgctggagagaatgttccagctgatcaacccccagtaccacttcagcgaggactacctggagtgcgtgagcaagtacaccgaccagctgaagcccttcggcgacgtgcccagaaagctgaagatccaggtgaccagagccttcatcgccgccagaaccttcgtgcagggcctgaccgtgggcagagaggtggccaacagagtgagcaaggtgagccccacccccggctgcatcagagccctgatgaagatgctgtactgcccctactgcagaggcctgcccaccgtgagaccctgcaacaactactgcctgaacgtgatgaagggctgcctggccaaccaggccgacctggacaccgagtggaacctgttcatcgacgccatgctgctggtggccgagagactggagggccccttcaacatcgagagcgtgatggaccccatcgacgtgaagatcagcgaggccatcatgaacatgcaggagaacagcatgcaggtgagcgccaaggtgttccagggctgcggccagcccaagcccgcccccgccctgagaagcgccagaagcgcccccgagaacttcaacaccagattcagaccctacaaccccgaggagagacccaccaccgccgccggcaccagcctggacagactggtgaccgacatcaaggagaagctgaagctgagcaagaaggtgtggagcgccctgccctacaccatctgcaaggacgagagcgtgaccgccggcaccagcaacgaggaggagtgctggaacggccacagcaaggccagatacctgcccgagatcatgaacgacggcctgaccaaccagatcaacaaccccgaggtggacgtggacatcaccagacccgacaccttcatcagacagcagatcatggccctgagagtgatgaccaacaagctgaagaacgcctacaacggcaacgacgtgaacttccaggacaccagcgacgagagcagcggcagcggcagcggcagcggctgcatggacgacgtgtgccccaccgagttcgagttcgtgaccaccgaggcccccgccgtggaccccgacagaagagaggtggacagcagcgccgcccagagaggccacagcctgctgagctggagcctgacctgcatcgtgctggccctgcagagactgtgcagatag

SEQ ID NO: 83491 - DNA, 582 bp, Artificial Sequence
  Description of Artificial Sequence: Synthetic coding sequence
atgcagagcctgatgcaggcccccctgctgatcgccctgggcctgctgctggccgcccccgcccaggcccacctgaagaagcccagccagctgagcagcttcagctgggacaactgcgacgagggcaaggaccccgccgtgatcagaagcctgaccctggagcccgaccccatcatcgtgcccggcaacgtgaccctgagcgtgatgggcagcaccagcgtgcccctgagcagccccctgaaggtggacctggtgctggagaaggaggtggccggcctgtggatcaagatcccctgcaccgactacatcggcagctgcaccttcgagcacttctgcgacgtgctggacatgctgatccccaccggcgagccctgccccgagcccctgagaacctacggcctgccctgccactgccccttcaaggagggcacctacagcctgcccaagagcgagttcgtggtgcccgacctggagctgcccagctggctgaccaccggcaactacagaatcgagagcgtgctgagcagcagcggcaagagactgggctgcatcaagatcgccgccagcctgaagggcatctag

SEQ ID NO: 83492 - DNA, 1140 bp, Artificial Sequence
  Description of Artificial Sequence: Synthetic coding sequence
atgggctgcctgggcaacagcaagaccgaggaccagagaaacgaggagaaggcccagagagaggccaacaagaagatcgagaagcagctgcagaaggacaagcaggtgtacagagccacccacagactgctgctgctgggcgccggcgagagcggcaagagcaccatcgtgaagcagatgagaatcctgcacgtgaacggcttcaacggcgacgagaaggccaccaaggtgcaggacatcaagaacaacctgaaggaggccatcgagaccatcgtggccgccatgagcaacctggtgccccccgtggagctggccaaccccgagaaccagttcagagtggactacatcctgagcgtgatgaacgtgcccgacttcgacttcccccccgagttctacgagcacgccaaggccctgtgggaggacgagggcgtgagagcctgctacgagagaagcaacgagtaccagctgatcgactgcgcccagtacttcctggacaagatcgacgtgatcaagcaggccgactacgtgcccagcgaccaggacctgctgagatgcagagtgctgaccagcggcatcttcgagaccaagttccaggtggacaaggtgaacttccacatgttcgacgtgggcggccagagagacgagagaagaaagtggatccagtgcttcaacgacgtgaccgccatcatcttcgtggtggccagcagcagctacaacatggtgatcagagaggacaaccagaccaacagactgcaggaggccctgaacctgttcaagagcatctggaacaacagatggctgagaaccatcagcgtgatcctgttcctgaacaagcaggacctgctggccgagaaggtgctggccggcaagagcaagatcgaggactacttccccgagttcgccagatacaccacccccgaggacgccacccccgagcccggcgaggaccccagagtgaccagagccaagtacttcatcagagacgagttcctgagaatcagcaccgccagcggcgacggcagacactactgctacccccacttcacctgcgccgtggacaccgagaacatcagaagagtgttcaacgactgcagagacatcatccagagaatgcacctgagacagtacgagctgctgtag

SEQ ID NO: 83493 - DNA, 1143 bp, Artificial Sequence
  Description of Artificial Sequence: Synthetic coding sequence
atgggctgcctgggcaacagcaagaccgaggaccagagaaacgaggagaaggcccagagagaggccaacaagaagatcgagaagcagctgcagaaggacaagcaggtgtacagagccacccacagactgctgctgctgggcgccggcgagagcggcaagagcaccatcgtgaagcagatgagaatcctgcacgtgaacggcttcaacggcgacagcgagaaggccaccaaggtgcaggacatcaagaacaacctgaaggaggccatcgagaccatcgtggccgccatgagcaacctggtgccccccgtggagctggccaaccccgagaaccagttcagagtggactacatcctgagcgtgatgaacgtgcccgacttcgacttcccccccgagttctacgagcacgccaaggccctgtgggaggacgagggcgtgagagcctgctacgagagaagcaacgagtaccagctgatcgactgcgcccagtacttcctggacaagatcgacgtgatcaagcaggccgactacgtgcccagcgaccaggacctgctgagatgcagagtgctgaccagcggcatcttcgagaccaagttccaggtggacaaggtgaacttccacatgttcgacgtgggcggccagagagacgagagaagaaagtggatccagtgcttcaacgacgtgaccgccatcatcttcgtggtggccagcagcagctacaacatggtgatcagagaggacaaccagaccaacagactgcaggaggccctgaacctgttcaagagcatctggaacaacagatggctgagaaccatcagcgtgatcctgttcctgaacaagcaggacctgctggccgagaaggtgctggccggcaagagcaagatcgaggactacttccccgagttcgccagatacaccacccccgaggacgccacccccgagcccggcgaggaccccagagtgaccagagccaagtacttcatcagagacgagttcctgagaatcagcaccgccagcggcgacggcagacactactgctacccccacttcacctgcgccgtggacaccgagaacatcagaagagtgttcaacgactgcagagacatcatccagagaatgcacctgagacagtacgagctgctgtag

SEQ ID NO: 83494 - DNA, 738 bp, Artificial Sequence
  Description of Artificial Sequence: Synthetic coding sequence
atggacagaagaagcagagcccagcagtggagaagagccagacacaactacaacgacctgtgcccccccatcggcagaagagccgccaccgccctgctgtggctgagctgcagcatcgccctgctgagagccctggccaccagcaacgccagagcccagcagagagccgccgcccagcagagaagaagcttcctgaacgcccaccacagaagcggcgcccaggtgttccccgagagccccgagagcgagagcgaccacgagcacgaggaggccgacctggagctgagcctgcccgagtgcctggagtacgaggaggagttcgactacgagaccgagagcgagaccgagagcgagatcgagagcgagaccgacttcgagaccgagcccgagaccgcccccaccaccgagcccgagaccgagcccgaggacgacagaggccccgtggtgcccaagcacagcaccttcggccagagcctgacccagagactgcacgccctgaagctgagaagccccgacgccagccccagcagagccccccccagcacccaggagccccagagccccagagagggcgaggagctgaagcccgaggacaaggaccccagagaccccgaggagagcaaggagcccaaggaggagaagcagagaagaagatgcaagcccaagaagcccaccagaagagacgccagccccgagagccccagcaagaagggccccatccccatcagaagacactag

SEQ ID NO: 83495 - DNA, 1188 bp, Artificial Sequence
  Description of Artificial Sequence: Synthetic coding sequence
atgggctgcctgggcaacagcaagaccgaggaccagagaaacgaggagaaggcccagagagaggccaacaagaagatcgagaagcagctgcagaaggacaagcaggtgtacagagccacccacagactgctgctgctgggcgccggcgagagcggcaagagcaccatcgtgaagcagatgagaatcctgcacgtgaacggcttcaacggcgagggcggcgaggaggacccccaggccgccagaagcaacagcgacggcagcgagaaggccaccaaggtgcaggacatcaagaacaacctgaaggaggccatcgagaccatcgtggccgccatgagcaacctggtgccccccgtggagctggccaaccccgagaaccagttcagagtggactacatcctgagcgtgatgaacgtgcccgacttcgacttcccccccgagttctacgagcacgccaaggccctgtgggaggacgagggcgtgagagcctgctacgagagaagcaacgagtaccagctgatcgactgcgcccagtacttcctggacaagatcgacgtgatcaagcaggccgactacgtgcccagcgaccaggacctgctgagatgcagagtgctgaccagcggcatcttcgagaccaagttccaggtggacaaggtgaacttccacatgttcgacgtgggcggccagagagacgagagaagaaagtggatccagtgcttcaacgacgtgaccgccatcatcttcgtggtggccagcagcagctacaacatggtgatcagagaggacaaccagaccaacagactgcaggaggccctgaacctgttcaagagcatctggaacaacagatggctgagaaccatcagcgtgatcctgttcctgaacaagcaggacctgctggccgagaaggtgctggccggcaagagcaagatcgaggactacttccccgagttcgccagatacaccacccccgaggacgccacccccgagcccggcgaggaccccagagtgaccagagccaagtacttcatcagagacgagttcctgagaatcagcaccgccagcggcgacggcagacactactgctacccccacttcacctgcgccgtggacaccgagaacatcagaagagtgttcaacgactgcagagacatcatccagagaatgcacctgagacagtacgagctgctgtag

SEQ ID NO: 83496 - DNA, 738 bp, Artificial Sequence; identical to SEQ ID NO: 83494
  Description of Artificial Sequence: Synthetic coding sequence

SEQ ID NO: 83497 - DNA, 483 bp, Artificial Sequence
  Description of Artificial Sequence: Synthetic coding sequence
atgggctgcctgggcaacagcaagaccgaggaccagagaaacgaggagaaggcccagagagaggccaacaaggaggacaaccagaccaacagactgcaggaggccctgaacctgttcaagagcatctggaacaacagatggctgagaaccatcagcgtgatcctgttcctgaacaagcaggacctgctggccgagaaggtgctggccggcaagagcaagatcgaggactacttccccgagttcgccagatacaccacccccgaggacgccacccccgagcccggcgaggaccccagagtgaccagagccaagtacttcatcagagacgagttcctgagaatcagcaccgccagcggcgacggcagacactactgctacccccacttcacctgcgccgtggacaccgagaacatcagaagagtgttcaacgactgcagagacatcatccagagaatgcacctgagacagtacgagctgctgtag

SEQ ID NO: 83498 - DNA, 1185 bp, Artificial Sequence
  Description of Artificial Sequence: Synthetic coding sequence
atgggctgcctgggcaacagcaagaccgaggaccagagaaacgaggagaaggcccagagagaggccaacaagaagatcgagaagcagctgcagaaggacaagcaggtgtacagagccacccacagactgctgctgctgggcgccggcgagagcggcaagagcaccatcgtgaagcagatgagaatcctgcacgtgaacggcttcaacggcgagggcggcgaggaggacccccaggccgccagaagcaacagcgacggcgagaaggccaccaaggtgcaggacatcaagaacaacctgaaggaggccatcgagaccatcgtggccgccatgagcaacctggtgccccccgtggagctggccaaccccgagaaccagttcagagtggactacatcctgagcgtgatgaacgtgcccgacttcgacttcccccccgagttctacgagcacgccaaggccctgtgggaggacgagggcgtgagagcctgctacgagagaagcaacgagtaccagctgatcgactgcgcccagtacttcctggacaagatcgacgtgatcaagcaggccgactacgtgcccagcgaccaggacctgctgagatgcagagtgctgaccagcggcatcttcgagaccaagttccaggtggacaaggtgaacttccacatgttcgacgtgggcggccagagagacgagagaagaaagtggatccagtgcttcaacgacgtgaccgccatcatcttcgtggtggccagcagcagctacaacatggtgatcagagaggacaaccagaccaacagactgcaggaggccctgaacctgttcaagagcatctggaacaacagatggctgagaaccatcagcgtgatcctgttcctgaacaagcaggacctgctggccgagaaggtgctggccggcaagagcaagatcgaggactacttccccgagttcgccagatacaccacccccgaggacgccacccccgagcccggcgaggaccccagagtgaccagagccaagtacttcatcagagacgagttcctgagaatcagcaccgccagcggcgacggcagacactactgctacccccacttcacctgcgccgtggacaccgagaacatcagaagagtgttcaacgactgcagagacatcatccagagaatgcacctgagacagtacgagctgctgtag

SEQ ID NO: 83499 - DNA, 1143 bp, Artificial Sequence; identical to SEQ ID NO: 83493
  Description of Artificial Sequence: Synthetic coding sequence

SEQ ID NO: 83500 - DNA, 738 bp, Artificial Sequence; identical to SEQ ID NO: 83494
  Description of Artificial Sequence: Synthetic coding sequence

SEQ ID NO: 83501 - DNA, 3114 bp, Artificial Sequence
  Description of Artificial Sequence: Synthetic coding sequence
atgggcgtgagaaactgcctgtacggcaacaacatgagcggccagagagacatcccccccgagatcggcgagcagcccgagcagccccccctggaggcccccggcgccgccgcccccggcgccggccccagccccgccgaggagatggagaccgagcccccccacaacgagcccatccccgtggagaacgacggcgaggcctgcggcccccccgaggtgagcagacccaacttccaggtgctgaaccccgccttcagagaggccggcgcccacggcagctacagccccccccccgaggaggccatgcccttcgaggccgagcagcccagcctgggcggcttctggcccaccctggagcagcccggcttccccagcggcgtgcacgccggcctggaggccttcggccccgccctgatggagcccggcgccttcagcggcgccagacccggcctgggcggctacagccccccccccgaggaggccatgcccttcgagttcgaccagcccgcccagagaggctgcagccagctgctgctgcaggtgcccgacctggcccccggcggccccggcgccgccggcgtgcccggcgccccccccgaggagccccaggccctgagacccgccaaggccggcagcagaggcggctacagccccccccccgaggagaccatgcccttcgagctggacggcgagggcttcggcgacgacagccccccccccggcctgagcagagtgatcgcccaggtggacggcagcagccagttcgccgccgtggccgccagcagcgccgtgagactgacccccgccgccaacgccccccccctgtgggtgcccggcgccatcggcagccccagccaggaggccgtgagaccccccagcaacttcaccggcagcagcccctggatggagatcagcggcccccccttcgagatcggcagcgcccccgccggcgtggacgacacccccgtgaacatggacagcccccccatcgccctggacggcccccccatcaaggtgagcggcgcccccgacaagagagagagagccgagagaccccccgtggaggaggaggccgccgagatggagggcgccgccgacgccgccgagggcggcaaggtgcccagccccggctacggcagccccgccgccggcgccgccagcgccgacaccgccgccagagccgcccccgccgcccccgccgaccccgacagcggcgccacccccgaggaccccgacagcggcaccgcccccgccgaccccgacagcggcgccttcgccgccgaccccgacagcggcgccgcccccgccgcccccgccgaccccgacagcggcgccgcccccgacgcccccgccgaccccgacagcggcgccgcccccgacgcccccgccgaccccgacgccggcgccgcccccgaggcccccgccgcccccgccgccgccgagaccagagccgcccacgtggcccccgccgcccccgacgccggcgcccccaccgcccccgccgccagcgccaccagagccgcccaggtgagaagagccgccagcgccgcccccgccagcggcgccagaagaaagatccacctgagaccccccagccccgagatccaggccgccgacccccccacccccagacccaccagagccagcgcctggagaggcaagagcgagagcagcagaggcagaagagtgtactacgacgagggcgtggccagcagcgacgacgacagcagcggcgacgagagcgacgacggcaccagcggctgcctgagatggttccagcacagaagaaacagaagaagaagaaagccccagagaaacctgctgagaaacttcctggtgcaggccttcggcggctgcttcggcagaagcgagagcccccagcccaaggccagcagaagcctgaaggtgaagaaggtgcccctggccgagaagagaagacagatgagaaaggaggccctggagaagagagcccagaagagagccgagaagaagagaagcaagctgatcgacaagcagctgcaggacgagaagatgggctacatgtgcacccacagactgctgctgctgggcgccggcgagagcggcaagagcaccatcgtgaagcagatgagaatcctgcacgtgaacggcttcaacggcgagggcggcgaggaggacccccaggccgccagaagcaacagcgacggcgagaaggccaccaaggtgcaggacatcaagaacaacctgaaggaggccatcgagaccatcgtggccgccatgagcaacctggtgccccccgtggagctggccaaccccgagaaccagttcagagtggactacatcctgagcgtgatgaacgtgcccgacttcgacttcccccccgagttctacgagcacgccaaggccctgtgggaggacgagggcgtgagagcctgctacgagagaagcaacgagtaccagctgatcgactgcgcccagtacttcctggacaagatcgacgtgatcaagcaggccgactacgtgcccagcgaccaggacctgctgagatgcagagtgctgaccagcggcatcttcgagaccaagttccaggtggacaaggtgaacttccacatgttcgacgtgggcggccagagagacgagagaagaaagtggatccagtgcttcaacgacgtgaccgccatcatcttcgtggtggccagcagcagctacaacatggtgatcagagaggacaaccagaccaacagactgcaggaggccctgaacctgttcaagagcatctggaacaacagatggctgagaaccatcagcgtgatcctgttcctgaacaagcaggacctgctggccgagaaggtgctggccggcaagagcaagatcgaggactacttccccgagttcgccagatacaccacccccgaggacgccacccccgagcccggcgaggaccccagagtgaccagagccaagtacttcatcagagacgagttcctgagaatcagcaccgccagcggcgacggcagacactactgctacccccacttcacctgcgccgtggacaccgagaacatcagaagagtgttcaacgactgcagagacatcatccagagaatgcacctgagacagtacgagctgctgtag

SEQ ID NO: 83502 - DNA, 342 bp, Artificial Sequence
  Description of Artificial Sequence: Synthetic coding sequence
tgaaccaccgagcccgagaccgagcccgaggacgacagaggccccgtggtgcccaagcacagcaccttcggccagagcctgacccagagactgcacgccctgaagctgagaagccccgacgccagccccagcagagccccccccagcacccaggagccccagagccccagagagggcgaggagctgaagcccgaggacaaggaccccagagaccccgaggagagcaaggagcccaaggaggagaagcagagaagaagatgcaagcccaagaagcccaccagaagagacgccagccccgagagccccagcaagaagggccccatccccatcagaagacactag

SEQ ID NO: 83503 - DNA, 501 bp, Artificial Sequence
  Description of Artificial Sequence: Synthetic coding sequence
cccgagagcgagagcgaccacgagcacgaggaggccgacctggagctgagcctgcccgagtgcctggagtacgaggaggagttcgactacgagaccgagagcgagaccgagagcgagatcgagagcgagaccgacttcgagaccgagcccgagaccgcccccaccaccgagcccgagaccgagcccgaggacgacagaggccccgtggtgcccaagcacagcaccttcggccagagcctgacccagagactgcacgccctgaagctgagaagccccgacgccagccccagcagagccccccccagcacccaggagccccagagccccagagagggcgaggagctgaagcccgaggacaaggaccccagagaccccgaggagagcaaggagcccaaggaggagaagcagagaagaagatgcaagcccaagaagcccaccagaagagacgccagccccgagagccccagcaagaagggccccatccccatcagaagacactag

SEQ ID NO: 83504 - DNA, 5580 bp, Artificial Sequence
  Description of Artificial Sequence: Synthetic coding sequence
atggtggacaagaacatctacatcatccagggcgagatcaacatcgtggtgggcgccatcaagagaaacgccagatggagcacccacacccccctggacgaggagagagaccccctgctgcacagcttcggccacctgaaggaggtgctgaacagcatcaccgagctgagcgagatcgagcccaacgtgttcctgagacccttcctggaggtgatcagaagcgaggacaccaccggccccatcaccggcctggccctgaccagcgtgaacaagttcctgagctacgccctgatcgaccccacccacgagggcaccgccgagggcatggagaacatggccgacgccgtgacccacgccagattcgtgggcaccgaccccgccagcgacgaggtggtgctgatgaagatcctgcaggtgctgagaaccctgctgctgacccccgtgggcgcccacctgaccaacgagagcgtgtgcgagatcatgcagagctgcttcagaatctgcttcgagatgagactgagcgagctgctgagaaagagcgccgagcacaccctggtggacatggtgcagctgctgttcaccagactgccccagttcaaggaggagcccaagaactacgtgggcaccaacatgaagaagctgaagatgagagccggcggcatgagcgacagcagcaagtggaagaagcagaagagaagccccagaccccccagacacatgaccaaggtgacccccggcagcgagctgcccacccccaacggcaccaccctgagcagcaacctgaccggcggcatgcccttcatcgacgtgcccacccccatcagcagcgccagcagcgaggccgccagcgccgtggtgagccccagcaccgacagcggcctggagttcagcagccagaccaccagcaaggaggacctgaccgacctggagcagcccggcagccccggctacagcaccgccaccgagcccggcagcagcgagctgggcgtgcccgagcagcccgacctgcaggagggcacccacgtggagaagagccagagcgccagcgtggagagcatccccgaggtgctggaggagtgcaccagccccgccgaccacagcgacagcgccagcgtgcacgacatggactacgtgaaccccagaggcgtgagattcacccagagcagccagaaggagggcaccgccctggtgccctacggcctgccctgcatcagagagctgttcagattcctgatcagcctgaccaacccccacgacagacacaacagcgaggtgatgatccacatgggcctgcacctgctgaccgtggccctggagagcgcccccgtggcccagtgccagaccctgctgggcctgatcaaggacgagatgtgcagacacctgttccagctgctgagcatcgagagactgaacctgtacgccgccagcctgagagtgtgcttcctgctgttcgagagcatgagagagcacctgaagttccagatggagatgtacatcaagaagctgatggagatcatcaccgtggagaaccccaagatgccctacgagatgaaggagatggccctggaggccatcgtgcagctgtggagaatccccagcttcgtgaccgagctgtacatcaactacgactgcgactactactgcagcaacctgttcgaggagctgaccaagctgctgagcaagaacgccttccccgtgagcggccagctgtacaccacccacctgctgagcctggacgccctgctgaccgtgatcgacagcaccgaggcccactgccaggccaaggtgctgaacagcctgacccagcaggagaagaaggagaccgccagacccagctgcgagatcgtggacggcaccagagaggccagcaacaccgagagaaccgccagcgacggcaaggccgtgggcatggccagcgacatccccggcctgcacctgcccggcggcggcagactgccccccgagcacggcaagagcggctgcagcgacctggaggaggccgtggacagcggcgccgacaagaagttcgccagaaagccccccagattcagctgcctgctgcccgaccccagagagctgatcgagatcaagaacaagaagaagctgctgatcaccggcaccgagcagttcaaccagaagcccaagaagggcatccagttcctgcaggagaagggcctgctgaccatccccatggacaacaccgaggtggcccagtggctgagagagaaccccagactggacaagaagatgatcggcgagttcgtgagcgacagaaagaacatcgacctgctggagagcttcgtgagcaccttcagcttccagggcctgagactggacgaggccctgagactgtacctggaggccttcagactgcccggcgaggcccccgtgatccagagactgctggaggccttcaccgagagatggatgaactgcaacggcagccccttcgccaacagcgacgcctgcttcagcctggcctacgccgtgatcatgctgaacaccgaccagcacaaccacaacgtgagaaagcagaacgcccccatgaccctggaggagttcagaaagaacctgaagggcgtgaacggcggcaaggacttcgagcaggacatcctggaggacatgtaccacgccatcaagaacgaggagatcgtgatgcccgaggagcagaccggcctggtgagagagaactacgtgtggaacgtgctgctgcacagaggcgccacccccgagggcatcttcctgagagtgcccaccgccagctacgacctggacctgttcaccatgacctggggccccaccatcgccgccctgagctacgtgttcgacaagagcctggaggagaccatcatccagaaggccatcagcggcttcagaaagtgcgccatgatcagcgcccactacggcctgagcgacgtgttcgacaacctgatcatcagcctgtgcaagttcaccgccctgagcagcgagagcatcgagaacctgcccagcgtgttcggcagcaaccccaaggcccacatcgccgccaagaccgtgttccacctggcccacagacacggcgacatcctgagagagggctggaagaacatcatggaggccatgctgcagctgttcagagcccagctgctgcccaaggccatgatcgaggtggaggacttcgtggaccccaacggcaagatcagcctgcagagagaggagacccccagcaacagaggcgagagcaccgtgctgagcttcgtgagctggctgaccctgagcggccccgagcagagcagcgtgagaggccccagcaccgagaaccaggaggccaagagagtggccctggagtgcatcaagcagtgcgaccccgagaagatgatcaccgagagcaagttcctgcagctggagagcctgcaggagctgatgaaggccctggtgagcgtgacccccgacgaggagacctacgacgaggaggacgccgccttctgcctggagatgctgctgagaatcgtgctggagaacagagacagagtgggctgcgtgtggcagaccgtgagagaccacctgtaccacctgtgcgtgcaggcccaggacttctgcttcctggtggagagagccgtggtgggcctgctgagactggccatcagactgctgagaagagaggagatcagcgcccaggtgctgctgagcctgagaatcctgctgctgatgaagcccagcgtgctgagcagagtgagccaccaggtggcctacggcctgcacgagctgctgaagaccaacgccgccaacatccacagcggcgacgactgggccaccctgttcaccctgctggagtgcatcggcagcggcgtgaagccccccgccgccctgcaggccaccgccagagccgacgcccccgacgccggcgcccagagcgacagcgagctgcccagctaccaccagaacgacgtgagcctggacagaggctacaccagcgacagcgaggtgtacaccgaccacggcagacccggcaagatccacagaagcgccaccgacgccgacgtggtgaacagcggctggctggtggtgggcaaggacgacgtggacaacagcaagcccggccccagcagacccggccccagccccctgatcaaccagtacagcctgaccgtgggcctggacctgggcccccacgacaccaagagcctgctgaagtgcgtggagagcctgagcttcatcgtgagagacgccgcccacatcacccccgacaacttcgagctgtgcgtgaagaccctgagaatcttcgtggaggccagcctgaacggcggctgcaagagccaggagaagagaggcaagagccacaagtacgacagcaagggcaacagattcaagaagaagagcaaggagggcagcatgctgagaagacccagaaccagcagccagcacgccagcagaggcggccagagcgacgacgacgaggacgagggcgtgcccgccagctaccacaccgtgagcctgcaggtgagccaggacctgctggacctgatgcacaccctgcacaccagagccgccagcatctacagcagctgggccgaggagcagagacacctggagaccggcggccagaagatcgaggccgacagcagaaccctgtgggcccactgctggtgccccctgctgcagggcatcgcctgcctgtgctgcgacgccagaagacaggtgagaatgcaggccctgacctacctgcagagagccctgctggtgcacgacctgcagaagctggacgccctggagtgggagagctgcttcaacaaggtgctgttccccctgctgaccaagctgctggagaacatcagccccgccgacgtgggcggcatggaggagaccagaatgagagccagcaccctgctgagcaaggtgttcctgcagcacctgagccccctgctgagcctgagcaccttcgccgccctgtggctgaccatcctggacttcatggacaagtacatgcacgccggcagcagcgacctgctgagcgaggccatccccgagagcctgaagaacatgctgctggtgatggacaccgccgagatcttccacagcgccgacgccagaggcggcggccccagcgccctgtgggagatcacctgggagagaatcgactgcttcctgccccacctgagagacgagctgttcaagcagaccgtgatccaggaccccatgcccatggagccccagggccagaagcccctggccagcgcccacctgaccagcgccgccggcgacaccagaacccccggccacccccccccccccgagatccccagcgagctgggcgcctgcgacttcgagaagcccgagagccccagagccgccagcagcagcagccccggcagccccgtggccagcagccccagcagactgagccccacccccgacggccccccccccctggcccagccccccctgatcctgcagcccctggccagccccctgcaggtgggcgtgccccccatgaccctgcccatcatcctgaaccccgccctgatcgaggccaccagccccgtgcccctgctggccacccccagacccaccgaccccatccccaccagcgaggtgaactag

SEQ ID NO: 83505 - DNA, 1749 bp, Artificial Sequence
  Description of Artificial Sequence: Synthetic coding sequence
atgggcggcagcagccccgtgaccagcaaggccatcgtggacgccgacggcagaatctacatcagaaactggcagggcggcatcctgagcggcggcttcgagaagaaccccaagcccatcttcaccgagggcaagaaccagctggagatccagaacctgcaggaggactgggaccacttcgagcccctgctgagcagcctgctgagaagaatgcccgagctggagaccctggagatcatgaagctggtgaactgccccgagaccttcacccccgacatgagatgcatcatgggcgagagccccgccgtgcagggctacttcgtgctggccggcatgaacagcgccggcctgagcttcggcggcggcgccggcaagtacctggccgagtggatggtgcacggctaccccagcgagaacgtgtgggagctggacctgaagagattcggcgccctgcagagcagcagaaccttcctgagacacagagtgatggaggtgatgcccctgatgtacgacctgaaggtgcccagatgggacttccagaccggcagacagctgagaaccagccccctgtacgacagactggacgcccagggcgccagatggatggagaagcacggcttcgagagacccaagtacttcgtgccccccgacaaggacctgctggccctggagcagagcaagaccttctacaagcccgactggttcgacatcgtggagagcgaggtgaagtgctgcaaggaggccgtgtgcgtgatcgacatgagcagcttcaccaagttcgagatcaccagcaccggcgaccaggccctggaggtgctgcagtacctgttcagcaacgacctggacgtgcccgtgggccacatcgtgcacaccggcatgctgaacgagggcggcggctacgagaacgactgcagcatcgccagactgaacaagagaagcttcttcatgatcagccccaccgaccagcaggtgcactgctgggcctggctgaagaagcacatgcccaaggacagcaacctgctgctggaggacgtgacctggaagtacaccgccctgaacctgatcggccccagagccgtggacgtgctgagcgagctgagctacgcccccatgacccccgaccacttccccagcctgttctgcaaggagatgagcgtgggctacgccaacggcatcagagtgatgagcatgacccacaccggcgagcccggcttcatgctgtacatccccatcgagggcatggacttcatcggcagagacgccctgctgcagcagaagcagaacggcgtgtacaagagactgaccatgttcatcctggacgaccacgacagcgacctggacctgtggccctggtggggcgagcccatctacagaaacggccagtacgtgggcaagaccaccagcagcgcctacagctacagcctggagagacacgtgtgcctgggcttcgtgcacaacttcagcgaggacaccggcgaggagcaggtggtgaccgccgacttcatcaacagaggcgagtacgagatcgacatcgccggctacagattccaggccaaggccaagctgtaccccgtggccagcctgttcacccagaagagaagaaaggacgacatggagctgagcgccttcctggccctgcccccccccccccccaacatccacagcggcctgttcttccccagccaccccagcctgagcttcagctggtggcaggaggtgtgcctgaccggccagaagcaggccccctag

SEQ ID NO: 83506 - DNA, 3540 bp, Artificial Sequence
  Description of Artificial Sequence: Synthetic coding sequence
atggccgcctgcggcagagtgagaagaatgttcagactgagcgccgccctgcacctgctgctgctgttcgccgccggcgccgagaagctgcccggccagggcgtgcacagccagggccagggccccggcgccaacttcgtgagcttcgtgggccaggccggcggcggcggccccgccggccagcagctgccccagctgccccagagcagccagctgcagcagcagcagcagcagcagcagcagcagcagcagccccagcccccccagccccccttccccgccggcggcccccccgccagaagaggcggcgccggcgccggcggcggctggaagctggccgaggaggagagctgcagagaggacgtgaccagagtgtgccccaagcacacctggagcaacaacctggccgtgctggagtgcctgcaggacgtgagagagcccgagaacgagatcagcagcgactgcaaccacctgctgtggaactacaagctgaacctgaccaccgaccccaagttcgagagcgtggccagagaggtgtgcaagagcaccatcaccgagatcaaggagtgcgccgacgagcccgtgggcaagggctacatggtgagctgcctggtggaccacagaggcaacatcaccgagtaccagtgccaccagtacatcaccaagatgaccgccatcatcttcagcgactacagactgatctgcggcttcatggacgactgcaagaacgacatcaacatcctgaagtgcggcagcatcagactgggcgagaaggacgcccacagccagggcgaggtggtgagctgcctggagaagggcctggtgaaggaggccgaggagagagagcccaagatccaggtgagcgagctgtgcaagaaggccatcctgagagtggccgagctgagcagcgacgacttccacctggacagacacctgtacttcgcctgcagagacgacagagagagattctgcgagaacacccaggccggcgagggcagagtgtacaagtgcctgttcaaccacaagttcgaggagagcatgagcgagaagtgcagagaggccctgaccaccagacagaagctgatcgcccaggactacaaggtgagctacagcctggccaagagctgcaagagcgacctgaagaagtacagatgcaacgtggagaacctgcccagaagcagagaggccagactgagctacctgctgatgtgcctggagagcgccgtgcacagaggcagacaggtgagcagcgagtgccagggcgagatgctggactacagaagaatgctgatggaggacttcagcctgagccccgagatcatcctgagctgcagaggcgagatcgagcaccactgcagcggcctgcacagaaagggcagaaccctgcactgcctgatgaaggtggtgagaggcgagaagggcaacctgggcatgaactgccagcaggccctgcagaccctgatccaggagaccgaccccggcgccgactacagaatcgacagagccctgaacgaggcctgcgagagcgtgatccagaccgcctgcaagcacatcagaagcggcgaccccatgatcctgagctgcctgatggagcacctgtacaccgagaagatggtggaggactgcgagcacagactgctggagctgcagtacttcatcagcagagactggaagctggaccccgtgctgtacagaaagtgccagggcgacgccagcagactgtgccacacccacggctggaacgagaccagcgagttcatgccccagggcgccgtgttcagctgcctgtacagacacgcctacagaaccgaggagcagggcagaagactgagcagagagtgcagagccgaggtgcagagaatcctgcaccagagagccatggacgtgaagctggaccccgccctgcaggacaagtgcctgatcgacctgggcaagtggtgcagcgagaagaccgagaccggccaggagctggagtgcctgcaggaccacctggacgacctggtggtggagtgcagagacatcgtgggcaacctgaccgagctggagagcgaggacatccagatcgaggccctgctgatgagagcctgcgagcccatcatccagaacttctgccacgacgtggccgacaaccagatcgacagcggcgacctgatggagtgcctgatccagaacaagcaccagaaggacatgaacgagaagtgcgccatcggcgtgacccacttccagctggtgcagatgaaggacttcagattcagctacaagttcaagatggcctgcaaggaggacgtgctgaagctgtgccccaacatcaagaagaaggtggacgtggtgatctgcctgagcaccaccgtgagaaacgacaccctgcaggaggccaaggagcacagagtgagcctgaagtgcagaagacagctgagagtggaggagctggagatgaccgaggacatcagactggagcccgacctgtacgaggcctgcaagagcgacatcaagaacttctgcagcgccgtgcagtacggcaacgcccagatcatcgagtgcctgaaggagaacaagaagcagctgagcaccagatgccaccagaaggtgttcaagctgcaggagaccgagatgatggaccccgagctggactacaccctgatgagagtgtgcaagcagatgatcaagagattctgccccgaggccgacagcaagaccatgctgcagtgcctgaagcagaacaagaacagcgagctgatggaccccaagtgcaagcagatgatcaccaagagacagatcacccagaacaccgactacagactgaaccccatgctgagaaaggcctgcaaggccgacatccccaagttctgccacggcatcctgaccaaggccaaggacgacagcgagctggagggccaggtgatcagctgcctgaagctgagatacgccgaccagagactgagcagcgactgcgaggaccagatcagaatcatcatccaggagagcgccctggactacagactggacccccagctgcagctgcactgcagcgacgagatcagcagcctgtgcgccgaggaggccgccgcccaggagcagaccggccaggtggaggagtgcctgaaggtgaacctgctgaagatcaagaccgagctgtgcaagaaggaggtgctgaacatgctgaaggagagcaaggccgacatcttcgtggaccccgtgctgcacaccgcctgcgccctggacatcaagcaccactgcgccgccatcacccccggcagaggcagacagatgagctgcctgatggaggccctggaggacaagagagtgagactgcagcccgagtgcaagaagagactgaacgacagaatcgagatgtggagctacgccgccaaggtggcccccgccgacggcttcagcgacctggccatgcaggtgatgaccagccccagcaagaactacatcctgagcgtgatcagcggcagcatctgcatcctgttcctgatcggcctgatgtgcggcagaatcaccaagagagtgaccagagagctgaaggacagatag

SEQ ID NO: 83507 - DNA, 3579 bp, Artificial Sequence
  Description of Artificial Sequence: Synthetic coding sequence
atggccgcctgcggcagagtgagaagaatgttcagactgagcgccgccctgcacctgctgctgctgttcgccgccggcgccgagaagctgcccggccagggcgtgcacagccagggccagggccccggcgccaacttcgtgagcttcgtgggccaggccggcggcggcggccccgccggccagcagctgccccagctgccccagagcagccagctgcagcagcagcagcagcagcagcagcagcagcagcagccccagcccccccagccccccttccccgccggcggcccccccgccagaagaggcggcgccggcgccggcggcggctggaagctggccgaggaggagagctgcagagaggacgtgaccagagtgtgccccaagcacacctggagcaacaacctggccgtgctggagtgcctgcaggacgtgagagagctgctgtggaactacaagctgaacctgaccaccgaccccaagttcgagagcgtggccagagaggtgtgcaagagcaccatcaccgagatcaaggagtgcgccgacgagcccgtgggcaagggctacatggtgagctgcctggtggaccacagaggcaacatcaccgagtaccagtgccaccagtacatcaccaagatgaccgccatcatcttcagcgactacagactgatctgcggcttcatggacgactgcaagaacgacatcaacatcctgaagtgcggcagcatcagactgggcgagaaggacgcccacagccagggcgaggtggtgagctgcctggagaagggcctggtgaaggaggccgaggagagagagcccaagatccaggtgagcgagctgtgcaagaaggccatcctgagagtggccgagctgagcagcgacgacttccacctggacagacacctgtacttcgcctgcagagacgacagagagagattctgcgagaacacccaggccggcgagggcagagtgtacaagtgcctgttcaaccacaagttcgaggagagcatgagcgagaagtgcagagaggccctgaccaccagacagaagctgatcgcccaggactacaaggtgagctacagcctggccaagagctgcaagagcgacctgaagaagtacagatgcaacgtggagaacctgcccagaagcagagaggccagactgagctacctgctgatgtgcctggagagcgccgtgcacagaggcagacaggtgagcagcgagtgccagggcgagatgctggactacagaagaatgctgatggaggacttcagcctgagccccgagatcatcctgagctgcagaggcgagatcgagcaccactgcagcggcctgcacagaaagggcagaaccctgcactgcctgatgaaggtggtgagaggcgagaagggcaacctgggcatgaactgccagcaggccctgcagaccctgatccaggagaccgaccccggcgccgactacagaatcgacagagccctgaacgaggcctgcgagagcgtgatccagaccgcctgcaagcacatcagaagcggcgaccccatgatcctgagctgcctgatggagcacctgtacaccgagaagatggtggaggactgcgagcacagactgctggagctgcagtacttcatcagcagagactggaagctggaccccgtgctgtacagaaagtgccagggcgacgccagcagactgtgccacacccacggctggaacgagaccagcgagttcatgccccagggcgccgtgttcagctgcctgtacagacacgcctacagaaccgaggagcagggcagaagactgagcagagagtgcagagccgaggtgcagagaatcctgcaccagagagccatggacgtgaagctggaccccgccctgcaggacaagtgcctgatcgacctgggcaagtggtgcagcgagaagaccgagaccggccaggagctggagtgcctgcaggaccacctggacgacctggtggtggagtgcagagacatcgtgggcaacctgaccgagctggagagcgaggacatccagatcgaggccctgctgatgagagcctgcgagcccatcatccagaacttctgccacgacgtggccgacaaccagatcgacagcggcgacctgatggagtgcctgatccagaacaagcaccagaaggacatgaacgagaagtgcgccatcggcgtgacccacttccagctggtgcagatgaaggacttcagattcagctacaagttcaagatggcctgcaaggaggacgtgctgaagctgtgccccaacatcaagaagaaggtggacgtggtgatctgcctgagcaccaccgtgagaaacgacaccctgcaggaggccaaggagcacagagtgagcctgaagtgcagaagacagctgagagtggaggagctggagatgaccgaggacatcagactggagcccgacctgtacgaggcctgcaagagcgacatcaagaacttctgcagcgccgtgcagtacggcaacgcccagatcatcgagtgcctgaaggagaacaagaagcagctgagcaccagatgccaccagaaggtgttcaagctgcaggagaccgagatgatggaccccgagctggactacaccctgatgagagtgtgcaagcagatgatcaagagattctgccccgaggccgacagcaagaccatgctgcagtgcctgaagcagaacaagaacagcgagctgatggaccccaagtgcaagcagatgatcaccaagagacagatcacccagaacaccgactacagactgaaccccatgctgagaaaggcctgcaaggccgacatccccaagttctgccacggcatcctgaccaaggccaaggacgacagcgagctggagggccaggtgatcagctgcctgaagctgagatacgccgaccagagactgagcagcgactgcgaggaccagatcagaatcatcatccaggagagcgccctggactacagactggacccccagctgcagctgcactgcagcgacgagatcagcagcctgtgcgccgaggaggccgccgcccaggagcagaccggccaggtggaggagtgcctgaaggtgaacctgctgaagatcaagaccgagctgtgcaagaaggaggtgctgaacatgctgaaggagagcaaggccgacatcttcgtggaccccgtgctgcacaccgcctgcgccctggacatcaagcaccactgcgccgccatcacccccggcagaggcagacagatgagctgcctgatggaggccctggaggacaagagagtgagactgcagcccgagtgcaagaagagactgaacgacagaatcgagatgtggagctacgccgccaaggtggcccccgccgacggcttcagcgacctggccatgcaggtgatgaccagccccagcaagaactacatcctgagcgtgatcagcggcagcatctgcatcctgttcctgatcggcctgatgtgcggcagaatcaccaagagagtgaccagagagctgaaggacagactgcagtacagaagcgagaccatggcctacaagggcctggtgtggagccaggacgtgaccggcagccccgcctag

SEQ ID NO: 83508 - DNA, 2091 bp, Artificial Sequence
  Description of Artificial Sequence: Synthetic coding sequence
atgggcaacggcatgtgcagcagaaagcagaagagaatcttccagaccctgctgctgctgaccgtggtgttcggcttcctgtacggcgccatgctgtactacgagctgcagacccagctgagaaaggccgaggccgtggccctgaagtaccagcagcaccaggagagcctgagcgcccagctgcaggtggtgtacgagcacagaagcagactggagaagagcctgcagaaggagagactggagcacaagaaggccaaggaggacttcctggtgtacaagctggaggcccaggagaccctgaacaagggcagacaggacagcaacagcagatacagcgccctgaacgtgcagcaccagatgctgaagagccagcacgaggagctgaagaagcagcacagcgacctggaggaggagcacagaaagcagggcgaggacttcagcagaaccttcaacgaccacaagcagaagtacctgcagctgcagcaggagaaggagcaggagctgagcaagctgaaggagaccgtgtacaacctgagagaggagaacagacagctgagaaaggcccaccaggacatccacacccagctgcaggacgtgaagcagcagcacaagaacctgctgagcgagcacgagcagctggtggtgaccctggaggaccacaagagcgccctggccgccgcccagacccaggtggccgagtacaagcagctgaaggacaccctgaacagaatccccagcctgagaaagcccgaccccgccgagcagcagaacgtgacccaggtggcccacagcccccagggctacaacaccgccagagagaagcccaccagagaggtgcaggaggtgagcagaaacaacgacgtgtggcagaaccacgaggccgtgcccggcagagccgaggacaccaagctgtacgcccccacccacaaggaggccgagttccaggccccccccgagcccatccagcaggaggtggagagaagagagcccgaggagcaccaggtggaggaggagcacagaaaggccctggaggaggaggagatggagcaggtgggccaggccgagcacctggaggaggagcacgaccccagccccgaggagcaggacagagagtggaaggagcagcacgagcagagagaggccgccaacctgctggagggccacgccagagccgaggtgtaccccagcgccaagcccatgatcaagttccagagcccctacgaggagcagctggagcagcagagactggccgtgcagcaggtggaggaggcccagcagctgagagagcaccaggaggccctgcaccagcagagactgcagggccacctgctgagacagcaggagcagcagcagcagcaggtggccagagagatggccctgcagagacaggccgagctggaggagggcagaccccagcaccaggagcagctgagacagcaggcccactacgacgccatggacaacgacatcgtgcagggcgccgaggaccagggcatccagggcgaggagggcgcctacgagagagacaaccagcaccaggacgaggccgagggcgaccccggcaacagacacgagcccagagagcagggccccagagaggccgaccccgagagcgaggccgacagagccgccgtggaggacatcaaccccgccgacgaccccaacaaccagggcgaggacgagttcgaggaggccgagcaggtgagagaggagaacctgcccgacgagaacgaggagcagaagcagagcaaccagaagcaggagaacaccgaggtggaggagcacctggtgatggccggcaaccccgaccagcaggaggacaacgtggacgagcagtaccaggaggaggccgaggaggaggtgcaggaggacctgaccgaggagaagaagagagagctggagcacaacgccgaggagacctacggcgagaacgacgagaacaccgacgacaagaacaacgacggcgaggagcaggaggtgagagacgacaacagacccaagggcagagaggagcactacgaggaggaggaggaggaggaggaggacggcgccgccgtggccgagaagagccacagaagagccgagatgtag

SEQ ID NO: 83509 - DNA, 897 bp, Artificial Sequence
  Description of Artificial Sequence: Synthetic coding sequence
atgaccagcctgacccagagaagcagcggcctggtgcagagaagaaccgaggccagcagaaacgccgccgacaaggagagagccgccggcggcggcgccggcagcagcgaggacgacgcccagagcagaagagacgagcaggacgacgacgacaagggcgacagcaaggagaccagactgaccctgatggaggaggtgctgctgctgggcctgaaggacagagagggctacaccagcttctggaacgactgcatcagcagcggcctgagaggctgcatgctgatcgagctggccctgagaggcagactgcagctggaggcctgcggcatgagaagaaagagcctgctgaccagaaaggtgatctgcaagagcgacgcccccaccggcgacgtgctgctggacgaggccctgaagcacgtgaaggagacccagccccccgagaccgtgcagaactggatcgagctgctgagcggcgagacctggaaccccctgaagctgcactaccagctgagaaacgtgagagagagactggccaagaacctggtggagaagggcgtgctgaccaccgagaagcagaacttcctgctgttcgacatgaccacccaccccctgaccaacaacaacatcaagcagagactgatcaagaaggtgcaggaggccgtgctggacaagtgggtgaacgacccccacagaatggacagaagactgctggccctgatctacctggcccacgccagcgacgtgctggagaacgccttcgcccccctgctggacgagcagtacgacctggccaccaagagagtgagacagctgctggacctggaccccgaggtggagtgcctgaaggccaacaccaacgaggtgctgtgggccgtggtggccgccttcaccaagtag

SEQ ID NO: 83510 - DNA, 846 bp, Artificial Sequence
  Description of Artificial Sequence: Synthetic coding sequence
atgaccagcctgacccagagaagcagcggcctggtgcagagaagaaccgaggccagcagaaacgccgccgacagcagaagagacgagcaggacgacgacgacaagggcgacagcaaggagaccagactgaccctgatggaggaggtgctgctgctgggcctgaaggacagagagggctacaccagcttctggaacgactgcatcagcagcggcctgagaggctgcatgctgatcgagctggccctgagaggcagactgcagctggaggcctgcggcatgagaagaaagagcctgctgaccagaaaggtgatctgcaagagcgacgcccccaccggcgacgtgctgctggacgaggccctgaagcacgtgaaggagacccagccccccgagaccgtgcagaactggatcgagctgctgagcggcgagacctggaaccccctgaagctgcactaccagctgagaaacgtgagagagagactggccaagaacctggtggagaagggcgtgctgaccaccgagaagcagaacttcctgctgttcgacatgaccacccaccccctgaccaacaacaacatcaagcagagactgatcaagaaggtgcaggaggccgtgctggacaagtgggtgaacgacccccacagaatggacagaagactgctggccctgatctacctggcccacgccagcgacgtgctggagaacgccttcgcccccctgctggacgagcagtacgacctggccaccaagagagtgagacagctgctggacctggaccccgaggtggagtgcctgaaggccaacaccaacgaggtgctgtgggccgtggtggccgccttcaccaagtag

SEQ ID NO: 83511 - DNA, 858 bp, Artificial Sequence
  Description of Artificial Sequence: Synthetic coding sequence
atgaccaccctgacccacagagccagaagaaccgagatcagcaagaacagcgagaagaagatggagagcgaggaggacagcaactgggagaagagccccgacaacgaggacagcggcgacagcaaggacatcagactgaccctgatggaggaggtgctgctgctgggcctgaaggacaaggagggctacaccagcttctggaacgactgcatcagcagcggcctgagaggcggcatcctgatcgagctggccatgagaggcagaatctacctggagccccccaccatgagaaagaagagactgctggacagaaaggtgctgctgaagagcgacagccccaccggcgacgtgctgctggacgagaccctgaagcacatcaaggccaccgagcccaccgagaccgtgcagacctggatcgagctgctgaccggcgagacctggaaccccttcaagctgcagtaccagctgagaaacgtgagagagagaatcgccaagaacctggtggagaagggcatcctgaccaccgagaagcagaacttcctgctgttcgacatgaccacccaccccgtgaccaacaccaccgagaagcagagactggtgaagaagctgcaggacagcgtgctggagagatgggtgaacgacccccagagaatggacaagagaaccctggccctgctggtgctggcccacagcagcgacgtgctggagaacgtgttcagcagcctgaccgacgacaagtacgacgtggccatgaacagagccaaggacctggtggagctggaccccgaggtggagggcaccaagcccagcgccaccgagatgatctgggccgtgctggccgccttcaacaagagctag

SEQ ID NO: 83512 - DNA, 924 bp, Artificial Sequence
  Description of Artificial Sequence: Synthetic coding sequence
atgaccaccctgacccacagagccagaagaaccgagatcagcaagaacagcgagaagaagatggagagcgaggaggacagcaactgggagaagagccccgacaacgaggacagcggcgacagcaaggacatcagactgaccctgatggaggaggtgctgctgctgggcctgaaggacaaggaggccaacatcaacagctggatcaccagatggctgacccccgtgatccccgccctgtggggcgccgagggctacaccagcttctggaacgactgcatcagcagcggcctgagaggcggcatcctgatcgagctggccatgagaggcagaatctacctggagccccccaccatgagaaagaagagactgctggacagaaaggtgctgctgaagagcgacagccccaccggcgacgtgctgctggacgagaccctgaagcacatcaaggccaccgagcccaccgagaccgtgcagacctggatcgagctgctgaccggcgagacctggaaccccttcaagctgcagtaccagctgagaaacgtgagagagagaatcgccaagaacctggtggagaagggcatcctgaccaccgagaagcagaacttcctgctgttcgacatgaccacccaccccgtgaccaacaccaccgagaagcagagactggtgaagaagctgcaggacagcgtgctggagagatgggtgaacgacccccagagaatggacaagagaaccctggccctgctggtgctggcccacagcagcgacgtgctggagaacgtgttcagcagcctgaccgacgacaagtacgacgtggccatgaacagagccaaggacctggtggagctggaccccgaggtggagggcaccaagcccagcgccaccgagatgatctgggccgtgctggccgccttcaacaagagctag

SEQ ID NO: 83513 - DNA, 810 bp, Artificial Sequence
  Description of Artificial Sequence: Synthetic coding sequence
atgaccaccctgacccacagagccagaagaaccgagatcagcaagaacagcgagaagaagatggagagcgaggaggacagcaactgggagaagagccccgacaacgaggacagcggcgacagcaaggacatcagactgaccctgatggaggaggtgctgctgctgggcctgaaggacaaggaggccaacatcaacagctggatcaccagatggctgacccccgtgatccccgccctgtggggcgccgagggctacaccagcttctggaacgactgcatcagcagcggcctgagaggcggcatcctgatcgagctggccatgagaggcagaatctacctggagccccccaccatgagaaagaagagactgctggacagaaaggtgctgctgaagagcgacagccccaccggcgacgtgctgctggacgagaccctgaagcacatcaaggccaccgagcccaccgagaccgtgcagacctggatcgagctgctgaccggcgagacctggaaccccttcaagctgcagtaccagctgagaaacgtgagagagagaatcgccaagaacctggtggagaagggcatcctgaccaccgagaagcagaacttcctgctgttcgacatgaccacccaccccgtgaccaacaccaccgagaagcagagactggtgaagaagctgcaggacagcgtgctggagagatgggtgaacgacccccagagaatggacaagagaaccctggccctgctggtgctggcccacagcagcgacgtgctggagaacgtgttcagcagcctgaccgacgacaagtactag

SEQ ID NO: 83514 - DNA, 726 bp, Artificial Sequence
  Description of Artificial Sequence: Synthetic coding sequence
atgaccaccctgacccacagagccagaagaaccgagatcagcaagaacagcgagaagaagatggagagcgaggaggacagcaactgggagaagagccccgacaacgaggacagcggcgacagcaaggacatcagactgaccctgatggaggaggtgctgctgctgggcctgaaggacaaggaggtgctgctgaagagcgacagccccaccggcgacgtgctgctggacgagaccctgaagcacatcaaggccaccgagcccaccgagaccgtgcagacctggatcgagctgctgaccggcgagacctggaaccccttcaagctgcagtaccagctgagaaacgtgagagagagaatcgccaagaacctggtggagaagggcatcctgaccaccgagaagcagaacttcctgctgttcgacatgaccacccaccccgtgaccaacaccaccgagaagcagagactggtgaagaagctgcaggacagcgtgctggagagatgggtgaacgacccccagagaatggacaagagaaccctggccctgctggtgctggcccacagcagcgacgtgctggagaacgtgttcagcagcctgaccgacgacaagtacgacgtggccatgaacagagccaaggacctggtggagctggaccccgaggtggagggcaccaagcccagcgccaccgagatgatctgggccgtgctggccgccttcaacaagagctag

SEQ ID NO: 83515 - DNA, 1323 bp, Artificial Sequence
  Description of Artificial Sequence: Synthetic coding sequence
atgggcctgggcgtgagcgccgagcagcccgccggcggcgccgagggcttccacctgcacggcgtgcaggagaacagccccgcccagcaggccggcctggagccctacttcgacttcatcatcaccatcggccacagcagactgaacaaggagaacgacaccctgaaggccctgctgaaggccaacgtggagaagcccgtgaagctggaggtgttcaacatgaagaccatgagagtgagagaggtggaggtggtgcccagcaacatgtggggcggccagggcctgctgggcgccagcgtgagattctgcagcttcagaagagccagcgagcaggtgtggcacgtgctggacgtggagcccagcagccccgccgccctggccggcctgagaccctacaccgactacgtggtgggcagcgaccagatcctgcaggagagcgaggacttcttcaccctgatcgagagccacgagggcaagcccctgaagctgatggtgtacaacagcaagagcgacagctgcagagaggtgaccgtgacccccaacgccgcctggggcggcgagggcagcctgggctgcggcatcggctacggctacctgcacagaatccccacccagccccccagctaccacaagaagccccccggcacccccccccccagcgccctgcccctgggcgcccccccccccgacgccctgccccccggccccacccccgaggacagccccagcctggagaccggcagcagacagagcgactacatggaggccctgctgcaggcccccggcagcagcatggaggaccccctgcccggccccggcagccccagccacagcgcccccgaccccgacggcctgccccacttcatggagacccccctgcagccccccccccccgtgcagagagtgatggaccccggcttcctggacgtgagcggcatcagcctgctggacaacagcaacgccagcgtgtggcccagcctgcccagcagcaccgagctgaccaccaccgccgtgagcaccagcggccccgaggacatctgcagcagcagcagcagccacgagagaggcggcgaggccacctggagcggcagcgagttcgaggtgagcttcctggacagccccggcgcccaggcccaggccgaccacctgccccagctgaccctgcccgacagcctgaccagcgccgccagccccgaggacggcctgagcgccgagctgctggaggcccaggccgaggaggagcccgccagcaccgagggcctggacaccggcaccgaggccgagggcctggacagccaggcccagatcagcaccaccgagtag

SEQ ID NO: 83516 - DNA, 4143 bp, Artificial Sequence
  Description of Artificial Sequence: Synthetic coding sequence
atggccagcggcagagacgagagacccccctggagactgggcagactgctgctgctgatgtgcctgctgctgctgggcagcagcgccagagccgcccacatcaagaaggccgaggccaccaccaccaccaccagcgccggcgccgaggccgccgagggccagttcgacagatactaccacgaggaggagctggagagcgccctgagagaggccgccgccgccggcctgcccggcctggccagactgttcagcatcggcagaagcgtggagggcagacccctgtgggtgctgagactgaccgccggcctgggcagcctgatccccgagggcgacgccggccccgacgccgccggccccgacgccgccggccccctgctgcccggcagaccccaggtgaagctggtgggcaacatgcacggcgacgagaccgtgagcagacaggtgctgatctacctggccagagagctggccgccggctacagaagaggcgaccccagactggtgagactgctgaacaccaccgacgtgtacctgctgcccagcctgaaccccgacggcttcgagagagccagagagggcgactgcggcttcggcgacggcggccccagcggcgccagcggcagagacaacagcagaggcagagacctgaacagaagcttccccgaccagttcagcaccggcgagccccccgccctggacgaggtgcccgaggtgagagccctgatcgagtggatcagaagaaacaagttcgtgctgagcggcaacctgcacggcggcagcgtggtggccagctaccccttcgacgacagccccgagcacaaggccaccggcatctacagcaagaccagcgacgacgaggtgttcaagtacctggccaaggcctacgccagcaaccaccccatcatgaagaccggcgagccccactgccccggcgacgaggacgagaccttcaaggacggcatcaccaacggcgcccactggtacgacgtggagggcggcatgcaggactacaactacgtgtgggccaactgcttcgagatcaccctggagctgagctgctgcaagtacccccccgccagccagctgagacaggagtgggagaacaacagagagagcctgatcaccctgatcgagaaggtgcacatcggcgtgaagggcttcgtgaaggacagcatcaccggcagcggcctggagaacgccaccatcagcgtggccggcatcaaccacaacatcaccaccggcagattcggcgacttctacagactgctggtgcccggcacctacaacctgaccgtggtgctgaccggctacatgcccctgaccgtgaccaacgtggtggtgaaggagggccccgccaccgaggtggacttcagcctgagacccaccgtgaccagcgtgatccccgacaccaccgaggccgtgagcaccgccagcaccgtggccatccccaacatcctgagcggcaccagcagcagctaccagcccatccagcccaaggacttccaccaccaccacttccccgacatggagatcttcctgagaagattcgccaacgagtaccccaacatcaccagactgtacagcctgggcaagagcgtggagagcagagagctgtacgtgatggagatcagcgacaaccccggcgtgcacgagcccggcgagcccgagttcaagtacatcggcaacatgcacggcaacgaggtggtgggcagagagctgctgctgaacctgatcgagtacctgtgcaagaacttcggcaccgaccccgaggtgaccgacctggtgcacaacaccagaatccacctgatgcccagcatgaaccccgacggctacgagaagagccaggagggcgacagcatcagcgtgatcggcagaaacaacagcaacaacttcgacctgaacagaaacttccccgaccagttcgtgcagatcaccgaccccacccagcccgagaccatcgccgtgatgagctggatgaagagctaccccttcgtgctgagcgccaacctgcacggcggcagcctggtggtgaactaccccttcgacgacgacgagcagggcctggccacctacagcaagagccccgacgacgccgtgttccagcagatcgccctgagctacagcaaggagaacagccagatgttccagggcagaccctgcaagaacatgtaccccaacgagtacttcccccacggcatcaccaacggcgccagctggtacaacgtgcccggcggcatgcaggactggaactacctgcagaccaactgcttcgaggtgaccatcgagctgggctgcgtgaagtaccccctggagaaggagctgcccaacttctgggagcagaacagaagaagcctgatccagttcatgaagcaggtgcaccagggcgtgagaggcttcgtgctggacgccaccgacggcagaggcatcctgaacgccaccatcagcgtggccgagatcaaccaccccgtgaccacctacaagaccggcgactactggagactgctggtgcccggcacctacaagatcaccgccagcgccagaggctacaaccccgtgaccaagaacgtgaccgtgaagagcgagggcgccatccaggtgaacttcaccctggtgagaagcagcaccgacagcaacaacgagagcaagaagggcaagggcgccagcagcagcaccaacgacgccagcgaccccaccaccaaggagttcgagaccctgatcaaggacctgagcgccgagaacggcctggagagcctgatgctgagaagcagcagcaacctggccctggccctgtacagataccacagctacaaggacctgagcgagttcctgagaggcctggtgatgaactacccccacatcaccaacctgaccaacctgggccagagcaccgagtacagacacatctggagcctggagatcagcaacaagcccaacgtgagcgagcccgaggagcccaagatcagattcgtggccggcatccacggcaacgcccccgtgggcaccgagctgctgctggccctggccgagttcctgtgcctgaactacaagaagaaccccgccgtgacccagctggtggacagaaccagaatcgtgatcgtgcccagcctgaaccccgacggcagagagagagcccaggagaaggactgcaccagcaagatcggccagaccaacgccagaggcaaggacctggacaccgacttcaccaacaacgccagccagcccgagaccaaggccatcatcgagaacctgatccagaagcaggacttcagcctgagcgtggccctggacggcggcagcatgctggtgacctacccctacgacaagcccgtgcagaccgtggagaacaaggagaccctgaagcacctggccagcctgtacgccaacaaccaccccagcatgcacatgggccagcccagctgccccaacaagagcgacgagaacatccccggcggcgtgatgagaggcgccgagtggcacagccacctgggcagcatgaaggactacagcgtgacctacggccactgccccgagatcaccgtgtacaccagctgctgctacttccccagcgccgccagactgcccagcctgtgggccgacaacaagagaagcctgctgagcatgctggtggaggtgcacaagggcgtgcacggcttcgtgaaggacaagaccggcaagcccatcagcaaggccgtgatcgtgctgaacgagggcatcaaggtgcagaccaaggagggcggctacttccacgtgctgctggcccccggcgtgcacaacatcatcgccatcgccgacggctaccagcagcagcacagccaggtgttcgtgcaccacgacgccgccagcagcgtggtgatcgtgttcgacaccgacaacagaatcttcggcctgcccagagagctggtggtgaccgtgagcggcgccaccatgagcgccctgatcctgaccgcctgcatcatctggtgcatctgcagcatcaagagcaacagacacaaggacggcttccacagactgagacagcaccacgacgagtacgaggacgagatcagaatgatgagcaccggcagcaagaagagcctgctgagccacgagttccaggacgagaccgacaccgaggaggagaccctgtacagcagcaagcactag

SEQ ID NO: 83517 - DNA, 558 bp, Artificial Sequence
  Description of Artificial Sequence: Synthetic coding sequence
atgttcgagaccatggccatcgagatcgagcagctgctggccagactgaccggcgtgaacgacaagatggccgagtacaccaacagcgccggcgtgcccagcctgaacgccgccctgatgcacaccctgcagagacacagagacatcctgcaggactacacccacgagttccacaagaccaaggccaacttcatggccatcagagagagagagaacctgatgggcagcgtgagaaaggacatcgagagctacaagagcggcagcggcgtgaacaacagaagaaccgagctgttcctgaaggagcacgaccacctgagaaacagcgacagactgatcgaggagaccatcagcatcgccatggccaccaaggagaacatgaccagccagagaggcatgctgaagagcatccacagcaagatgaacaccctggccaacagattccccgccgtgaacagcctgatccagagaatcaacctgagaaagagaagagacagcctgatcctgggcggcgtgatcggcatctgcaccatcctgctgctgctgtacgccttccactag

SEQ ID NO: 83518 - DNA, 525 bp, Artificial Sequence
  Description of Artificial Sequence: Synthetic coding sequence
atggccgccggcaccagcagctactgggaggacctgagaaagcaggccagacagctggagaacgagctggacctgaagctggtgagcttcagcaagctgtgcaccagctacagccacagcagcaccagagacggcagaagagacagcagcgacaccacccccctgctgaacggcagcagccaggacagaatgttcgagaccatggccatcgagatcgagcagctgctggccagactgaccggcgtgaacgacaagatggccgagtacaccaacagcgccggcgtgcccagcctgaacgccgccctgatgcacaccctgcagagacacagagacatcctgcaggactacacccacgagttccacaagaccaaggccaacttcatggccatcagagagagagagaacctgatgggcagcgtgagaaaggacatcgagagctacaagagcggcagcggcgtgaacaacagaagaaccgagctgttcctgaaggagcacgaccacctgagaaagggcttccagtggtag

SEQ ID NO: 83519 - DNA, 747 bp, Artificial Sequence
  Description of Artificial Sequence: Synthetic coding sequence
atggccgccggcaccagcagctactgggaggacctgagaaagcaggccagacagctggagaacgagctggacctgaagctggtgagcttcagcaagctgtgcaccagctacagccacagcagcaccagagacggcagaagagacagcagcgacaccacccccctgctgaacggcagcagccaggacagaatgttcgagaccatggccatcgagatcgagcagctgctggccagactgaccggcgtgaacgacaagatggccgagtacaccaacagcgccggcgtgcccagcctgaacgccgccctgatgcacaccctgcagagacacagagacatcctgcaggactacacccacgagttccacaagaccaaggccaacttcatggccatcagagagagagagaacctgatgggcagcgtgagaaaggacatcgagagctacaagagcggcagcggcgtgaacaacagaagaaccgagctgttcctgaaggagcacgaccacctgagaaacagcgacagactgatcgaggagaccatcagcatcgccatggccaccaaggagaacatgaccagccagagaggcatgctgaagagcatccacagcaagatgaacaccctggccaacagattccccgccgtgaacagcctgatccagagaatcaacctgagaaagagaagagacagcctgatcctgggcggcgtgatcggcatctgcaccatcctgctgctgctgtacgccttccactag

SEQ ID NO: 83520 - DNA, 528 bp, Artificial Sequence
  Description of Artificial Sequence: Synthetic coding sequence
atggccgccggcaccagcagctactgggaggacctgagaaagcaggccagacagctggagaacgagctggacctgaagctggtgagcttcagcaagctgtgcaccagctacagccacagcagcaccagagacggcagaagagacagatacagcagcgacaccacccccctgctgaacggcagcagccaggacagaatgttcgagaccatggccatcgagatcgagcagctgctggccagactgaccggcgtgaacgacaagatggccgagtacaccaacagcgccggcgtgcccagcctgaacgccgccctgatgcacaccctgcagagacacagagacatcctgcaggtgatctactgggccagagacgtgttcatcatcaccggcgtgtgggtgttcttcttcaacccctgcatcggctacgtgcacatctacctgaagggccagagagagaagagcgagaagatcaacgccatgctgaagggcctggtgctgctgttcttcggcgtgaccatcatcaagttctag

SEQ ID NO: 83521 - DNA, 558 bp, Artificial Sequence; identical to SEQ ID NO: 83517
  Description of Artificial Sequence: Synthetic coding sequence

SEQ ID NO: 83522 - DNA, 1350 bp, Artificial Sequence
  Description of Artificial Sequence: Synthetic coding sequence
atgaccagcttctacagcaccagcagctgccccctgggctgcaccatggcccccggcgccagaaacgtgttcgtgagccccatcgacgtgggctgccagcccgtggccgaggccaacgccgccagcatgtgcctgctggccaacgtggcccacgccaacagagtgagagtgggcagcacccccctgggcagacccagcctgtgcctgccccccaccagccacaccgcctgccccctgcccggcacctgccacatccccggcaacatcggcatctgcggcgcctacggcaagaacaccctgaacggccacgagaaggagaccatgaagttcctgaacgacagactggccaactacctggagaaggtgagacagctggagcaggagaacgccgagctggagaccaccctgctggagagaagcaagtgccacgagagcaccgtgtgccccgactaccagagctacttcagaaccatcgaggagctgcagcagaagatcctgtgcagcaaggccgagaacgccagactgatcgtgcagatcgacaacgccaagctggccgccgacgacttcagaatcaagctggagagcgagagaagcctgcaccagctggtggaggccgacaagtgcggcacccagaagctgctggacgacgccaccctggccaaggccgacctggaggcccagcaggagagcctgaaggaggagcagctgagcctgaagagcaaccacgagcaggaggtgaagatcctgagaagccagctgggcgagaagttcagaatcgagctggacatcgagcccaccatcgacctgaacagagtgctgggcgagatgagagcccagtacgaggccatggtggagaccaaccaccaggacgtggagcagtggttccaggcccagagcgagggcatcagcctgcaggccatgagctgcagcgaggagctgcagtgctgccagagcgagatcctggagctgagatgcaccgtgaacgccctggaggtggagagacaggcccagcacaccctgaaggactgcctgcagaacagcctgtgcgaggccgaggacagatacggcaccgagctggcccagatgcagagcctgatcagcaacctggaggagcagctgagcgagatcagagccgacctggagagacagaaccaggagtaccaggtgctgctggacgtgaaggccagactggagaacgagatcgccacctacagaaacctgctggagagcgaggactgcaagctgccctgcaacccctgcagcacccccgccagctgcaccagctgccccagctgcggccccgtgaccggcggcagccccagcggccacggcgccagcatgggcagatag

SEQ ID NO: 83523 - DNA, 639 bp, Artificial Sequence
  Description of Artificial Sequence: Synthetic coding sequence
atggaccccctgttccagcagacccacaagcaggtgcacgagatccagagctgcatgggcagactggagaccgccgacaagcagagcgtgcacatcgtggagaacgagatccaggccagcatcgaccagatcttcagcagactggagagactggagatcctgagcagcaaggagccccccaacaagagacagaacgccagactgagagtggaccagctgaagtacgacgtgcagcacctgcagaccgccctgagaaacttccagcacagaagacacgccagagagcagcaggagagacagagagaggagctgctgagcagaaccttcaccaccaacgacagcgacaccaccatccccatggacgagagcctgcagttcaacagcagcctgcagaaggtgcacaacggcatggacgacctgatcctggacggccacaacatcctggacggcctgagaacccagagactgaccctgaagggcacccagaagaagatcctggacatcgccaacatgctgggcctgagcaacaccgtgatgagactgatcgagaagagagccttccaggacaagtacttcatgatcggcggcatgctgctgacctgcgtggtgatgttcctggtggtgcagtacctgacctag

SEQ ID NO: 83524 - DNA, 588 bp, Artificial Sequence
  Description of Artificial Sequence: Synthetic coding sequence
atggaccccctgttccagcagacccacaagcaggtgcacgagatccagagctgcatgggcagactggagaccgccgacaagcagagcgtgcacatcgtggagaacgagatccaggccagcatcgaccagatcttcagcagactggagagactggagatcctgagcagcaaggagccccccaacaagagacagaacgccagactgagagtggaccagctgaagtacgacgtgcagcacctgcagaccgccctgagaaacttccagcacagaagacacgccagagagcagcaggagagacagagagaggagctgctgagcagaaccttcaccaccaacgacagcgacaccaccatccccatggacgagagcctgcagttcaacagcagcctgcagaaggtgcacaacggcatggacgacctgatcctggacggccacaacatcctggacggcctgagaacccagagactgaccctgaaggtgggcagcctgctgggcgacagagagaaggccagctgcttcagcctgatccagcagttcagcaactgcgtgtacatcctgatcacctgcccccagatcgtgatcttctag

SEQ ID NO: 83525 - DNA, 699 bp, Artificial Sequence
  Description of Artificial Sequence: Synthetic coding sequence
atggaccccctgttccagcagacccacaagcaggtgcacgagatccagagctgcatgggcagactggagaccgccgacaagcagagcgtgcacatcgtggagaacgagatccaggccagcatcgaccagatcttcagcagactggagagactggagatcctgagcagcaaggagccccccaacaagagacagaacgccagactgagagtggaccagctgaagtacgacgtgcagcacctgcagaccgccctgagaaacttccagcacagaagacacgccagagagcagcaggagagacagagagaggagctgctgagcagaaccttcaccaccaacgacagcgacaccaccatccccatggacgagagcctgcagttcaacagcagcctgcagaaggtgcacaacggcatggacgacctgatcctggacggccacaacatcctggacggcctgagaacccagagactgaccctgaagggcacccagaagaagatcctggacatcgccaacatgctgggcctgagcaacaccgtgatgagactgatcgagaagagagccttccaggacaagtacttcatgatcgagaccagaagccaccacgtggcccagaacggccccgagctgctgagcagcagagacccccccgccagcgccagcagaagcgccggcatcatcgagttcagcgagaagatcacctag

SEQ ID NO: 83526 - DNA, 984 bp, Artificial Sequence
  Description of Artificial Sequence: Synthetic coding sequence
atggccgccgccgccgccatggccgagcaggagagcgccagaaacggcggcagaaacagaggcggcgtgcagagagtggagggcaagctgagagccagcgtggagaagggcgactactacgaggcccaccagatgtacagaaccctgttcttcagatacatgagccagagcaagcacaccgaggccagagagctgatgtacagcggcgccctgctgttcttcagccacggccagcagaacagcgccgccgacctgagcatgctggtgctggagagcctggagaaggccgaggtggaggtggccgacgagctgctggagaacctggccaaggtgttcagcctgatggaccccaacagccccgagagagtgaccttcgtgagcagagccctgaagtggagcagcggcggcagcggcaagctgggccaccccagactgcaccagctgctggccctgaccctgtggaaggagcagaactactgcgagagcagataccacttcctgcacagcgccgacggcgagggctgcgccaacatgctggtggagtacagcaccagcagaggcttcagaagcgaggtggacatgttcgtggcccaggccgtgctgcagttcctgtgcctgaagaacaagagcagcgccagcgtggtgttcaccacctacacccagaagcaccccagcatcgaggacggcccccccttcgtggagcccctgctgaacttcatctggttcctgctgctggccgtggacggcggcaagctgaccgtgttcaccgtgctgtgcgagcagtaccagcccagcctgagaagagaccccatgtacaacgagtacctggacagaatcggccagctgttcttcggcgtgccccccaagcagaccagcagctacggcggcctgctgggcaacctgctgaccagcctgatgggcagcagcgagcaggaggacggcgaggagagccccagcgacggcagccccatcgagctggactag

SEQ ID NO: 83527 - DNA, 1779 bp, Artificial Sequence
  Description of Artificial Sequence: Synthetic coding sequence
atggccctgcccgaggaggccaagatcaaggacgcctaccacatgctgaagagacagggcatcgtgcagagcgacccccccatccccgtggacagaaccctgatccccagccccccccccagacccaagaaccccgtgttcgacgacgaggagaagagcaagctgctggccaagctgctgaagagcaagaaccccgacgacctgcaggaggccaacaagctgatcaagagcatggtgaaggaggacgaggccagaatccagaaggtgaccaagagactgcacaccctggaggaggtgaacaacaacgtgagactgctgagcgagatgctgctgcactacagccaggaggacagcagcgacggcgacagagagctgatgaaggagctgttcgaccagtgcgagaacaagagaagaaccctgttcaagctggccagcgagaccgaggacaacgacaacagcctgggcgacatcctgcaggccagcgacaacctgagcagagtgatcaacagctacaagaccatcatcgagggccaggtgatcaacggcgaggtggccaccctgaccctgcccgacagcgagggcaacagccagtgcagcaaccagggcaccctgatcgacctggccgagctggacaccaccaacagcctgagcagcgtgctggcccccgcccccaccccccccagcagcggcatccccatcctgcccccccccccccaggccagcggcccccccagaagcagaagcagcagccaggccgaggccaccctgggccccagcagcaccagcaacgccctgagctggctggacgaggagctgctgtgcctgggcctggccgaccccgcccccaacgtgccccccaaggagagcgccggcaacagccagtggcacctgctgcagagagagcagagcgacctggacttcttcagccccagacccggcaccgccgcctgcggcgccagcgacgcccccctgctgcagcccagcgcccccagcagcagcagcagccaggcccccctgcccccccccttccccgcccccgtggtgcccgccagcgtgcccgcccccagcgccggcagcagcctgttcagcaccggcgtggcccccgccctggcccccaaggtggagcccgccgtgcccggccaccacggcctggccctgggcaacagcgccctgcaccacctggacgccctggaccagctgctggaggaggccaaggtgaccagcggcctggtgaagcccaccaccagccccctgatccccaccaccacccccgccagacccctgctgcccttcagcaccggccccggcagccccctgttccagcccctgagcttccagagccagggcagcccccccaagggccccgagctgagcctggccagcatccacgtgcccctggagagcatcaagcccagcagcgccctgcccgtgaccgcctacgacaagaacggcttcagaatcctgttccacttcgccaaggagtgcccccccggcagacccgacgtgctggtggtggtggtgagcatgctgaacaccgcccccctgcccgtgaagagcatcgtgctgcaggccgccgtgcccaagagcatgaaggtgaagctgcagccccccagcggcaccgagctgagccccttcagccccatccagccccccgccgccatcacccaggtgatgctgctggccaaccccctgaagaagcaggtgctgagcttcctgggcaaggcctgcctgcagccctggggccaggccatcctgctgaccaccagctgcctggcctag

SEQ ID NO: 83528 - DNA, 1956 bp, Artificial Sequence
  Description of Artificial Sequence: Synthetic coding sequence
atgaagaactgcggcagaagattccacaacgaggtgggcaagttcagattcctgaacgagctgatcaaggtggtgagccccaagtacctgggcgacagagtgagcgagaaggtgaagaccaaggtgatcgagctgctgtacagctggaccatggccctgcccgaggaggccaagatcaaggacgcctaccacatgctgaagagacagggcatcgtgcagagcgacccccccatccccgtggacagaaccctgatccccagccccccccccagacccaagaaccccgtgttcgacgacgaggagaagagcaagctgctggccaagctgctgaagagcaagaaccccgacgacctgcaggaggccaacaagctgatcaagagcatggtgaaggaggacgaggccagaatccagaaggtgaccaagagactgcacaccctggaggaggtgaacaacaacgtgagactgctgagcgagatgctgctgcactacagccaggaggacagcagcgacggcgacagagagctgatgaaggagctgttcgaccagtgcgagaacaagagaagaaccctgttcaagctggccagcgagaccgaggacaacgacaacagcctgggcgacatcctgcaggccagcgacaacctgagcagagtgatcaacagctacaagaccatcatcgagggccaggtgatcaacggcgaggtggccaccctgaccctgcccgacagcgagggcaacagccagtgcagcaaccagggcaccctgatcgacctggccgagctggacaccaccaacagcctgagcagcgtgctggcccccgcccccaccccccccagcagcggcatccccatcctgcccccccccccccaggccagcggcccccccagaagcagaagcagcagccaggccgaggccaccctgggccccagcagcaccagcaacgccctgagctggctggacgaggagctgctgtgcctgggcctggccgaccccgcccccaacgtgccccccaaggagagcgccggcaacagccagtggcacctgctgcagagagagcagagcgacctggacttcttcagccccagacccggcaccgccgcctgcggcgccagcgacgcccccctgctgcagcccagcgcccccagcagcagcagcagccaggcccccctgcccccccccttccccgcccccgtggtgcccgccagcgtgcccgcccccagcgccggcagcagcctgttcagcaccggcgtggcccccgccctggcccccaaggtggagcccgccgtgcccggccaccacggcctggccctgggcaacagcgccctgcaccacctggacgccctggaccagctgctggaggaggccaaggtgaccagcggcctggtgaagcccaccaccagccccctgatccccaccaccacccccgccagacccctgctgcccttcagcaccggccccggcagccccctgttccagcccctgagcttccagagccagggcagcccccccaagggccccgagctgagcctggccagcatccacgtgcccctggagagcatcaagcccagcagcgccctgcccgtgaccgcctacgacaagaacggcttcagaatcctgttccacttcgccaaggagtgcccccccggcagacccgacgtgctggtggtggtggtgagcatgctgaacaccgcccccctgcccgtgaagagcatcgtgctgcaggccgccgtgcccaagagcatgaaggtgaagctgcagccccccagcggcaccgagctgagccccttcagccccatccagccccccgccgccatcacccaggtgatgctgctggccaaccccctgaaggagaaggtgagactgagatacaagctgaccttcgccctgggcgagcagctgagcaccgaggtgggcgaggtggaccagttcccccccgtggagcagtggggcaacctgtag

SEQ ID NO: 83529 - DNA, 1365 bp, Artificial Sequence
  Description of Artificial Sequence: Synthetic coding sequence
atgagcgccggcggcccctgccccgccgccgccggcggcggccccggcggcgccagctgcagcgtgggcgcccccggcggcgtgagcatgttcagatggctggaggtgctggagaaggagttcgacaaggccttcgtggacgtggacctgctgctgggcgagatcgaccccgaccaggccgacatcacctacgagggcagacagaagatgaccagcctgagcagctgcttcgcccagctgtgccacaaggcccagagcgtgagccagatcaaccacaagctggaggcccagctggtggacctgaagagcgagctgaccgagacccaggccgagaaggtggtgctggagaaggaggtgcacgaccagctgctgcagctgcacagcatccagctgcagctgcacgccaagaccggccagagcgccgacagcggcaccatcaaggccaagctggagagagagctggaggccaacaagaaggagaagatgaaggaggcccagctggaggccgaggtgaagctgctgagaaaggagaacgaggccctgagaagacacatcgccgtgctgcaggccgaggtgtacggcgccagactggccgccaagtacctggacaaggagctggccggcagagtgcagcagatccagctgctgggcagagacatgaagggccccgcccacgacaagctgtggaaccagctggaggccgagatccacctgcacagacacaagaccgtgatcagagcctgcagaggcagaaacgacctgaagagacccatgcaggccccccccggccacgaccaggacagcctgaagaagagccagggcgtgggccccatcagaaaggtgctgctgctgaaggaggaccacgagggcctgggcatcagcatcaccggcggcaaggagcacggcgtgcccatcctgatcagcgagatccaccccggccagcccgccgacagatgcggcggcctgcacgtgggcgacgccatcctggccgtgaacggcgtgaacctgagagacaccaagcacaaggaggccgtgaccatcctgagccagcagagaggcgagatcgagttcgaggtggtgtacgtggcccccgaggtggacagcgacgacgagaacgtggagtacgaggacgagagcggccacagatacagactgtacctggacgagctggagggcggcggcaaccccggcgccagctgcaaggacaccagcggcgagatcaaggtgctgcagggcttcaacaagaaggccgtgaccgacacccacgagaacggcgacctgggcaccgccagcgagacccccctggacgacggcgccagcaagctggacgacctgcacaccctgtaccacaagaagagctactag

SEQ ID NO: 83530 - DNA, 1389 bp, Artificial Sequence
  Description of Artificial Sequence: Synthetic coding sequence
atgagcgccggcggcccctgccccgccgccgccggcggcggccccggcggcgccagctgcagcgtgggcgcccccggcggcgtgagcatgttcagatggctggaggtgctggagaaggagttcgacaaggccttcgtggacgtggacctgctgctgggcgagatcgaccccgaccaggccgacatcacctacgagggcagacagaagatgaccagcctgagcagctgcttcgcccagctgtgccacaaggcccagagcgtgagccagatcaaccacaagctggaggcccagctggtggacctgaagagcgagctgaccgagacccaggccgagaaggtggtgctggagaaggaggtgcacgaccagctgctgcagctgcacagcatccagctgcagctgcacgccaagaccggccagagcgccgacagcggcaccatcaaggccaagctgagcggccccagcgtggaggagctggagagagagctggaggccaacaagaaggagaagatgaaggaggcccagctggaggccgaggtgaagctgctgagaaaggagaacgaggccctgagaagacacatcgccgtgctgcaggccgaggtgtacggcgccagactggccgccaagtacctggacaaggagctggccggcagagtgcagcagatccagctgctgggcagagacatgaagggccccgcccacgacaagctgtggaaccagctggaggccgagatccacctgcacagacacaagaccgtgatcagagcctgcagaggcagaaacgacctgaagagacccatgcaggccccccccggccacgaccaggacagcctgaagaagagccagggcgtgggccccatcagaaaggtgctgctgctgaaggaggaccacgagggcctgggcatcagcatcaccggcggcaaggagcacggcgtgcccatcctgatcagcgagatccaccccggccagcccgccgacagatgcggcggcctgcacgtgggcgacgccatcctggccgtgaacggcgtgaacctgagagacaccaagcacaaggaggccgtgaccatcctgagccagcagagaggcgagatcgagttcgaggtggtgtacgtggcccccgaggtggacagcgacgacgagaacgtggagtacgaggacgagagcggccacagatacagactgtacctggacgagctggagggcggcggcaaccccggcgccagctgcaaggacaccagcggcgagatcaaggtgctgcagggcttcaacaagaaggccgtgaccgacacccacgagaacggcgacctgggcaccgccagcgagacccccctggacgacggcgccagcaagctggacgacctgcacaccctgtaccacaagaagagctactag

SEQ ID NO: 83531 - DNA, 1389 bp, Artificial Sequence
  Description of Artificial Sequence: Synthetic coding sequence
atgagcgccggcggcccctgccccgccgccgccggcggcggccccggcggcgccagctgcagcgtgggcgcccccggcggcgtgagcatgttcagatggctggaggtgctggagaaggagttcgacaaggccttcgtggacgtggacctgctgctgggcgagatcgaccccgaccaggccgacatcacctacgagggcagacagaagatgaccagcctgagcagctgcttcgcccagctgtgccacaaggcccagagcgtgagccagatcaaccacaagctggaggcccagctggtggacctgaagagcgagctgaccgagacccaggccgagaaggtggtgctggagaaggaggtgcacgaccagctgctgcagctgcacagcatccagctgcagctgcacgccaagaccggccagagcgccgacagcggcaccatcaaggccaagctggtgagcagaagcagcagcaagatggagagagagctggaggccaacaagaaggagaagatgaaggaggcccagctggaggccgaggtgaagctgctgagaaaggagaacgaggccctgagaagacacatcgccgtgctgcaggccgaggtgtacggcgccagactggccgccaagtacctggacaaggagctggccggcagagtgcagcagatccagctgctgggcagagacatgaagggccccgcccacgacaagctgtggaaccagctggaggccgagatccacctgcacagacacaagaccgtgatcagagcctgcagaggcagaaacgacctgaagagacccatgcaggccccccccggccacgaccaggacagcctgaagaagagccagggcgtgggccccatcagaaaggtgctgctgctgaaggaggaccacgagggcctgggcatcagcatcaccggcggcaaggagcacggcgtgcccatcctgatcagcgagatccaccccggccagcccgccgacagatgcggcggcctgcacgtgggcgacgccatcctggccgtgaacggcgtgaacctgagagacaccaagcacaaggaggccgtgaccatcctgagccagcagagaggcgagatcgagttcgaggtggtgtacgtggcccccgaggtggacagcgacgacgagaacgtggagtacgaggacgagagcggccacagatacagactgtacctggacgagctggagggcggcggcaaccccggcgccagctgcaaggacaccagcggcgagatcaaggtgctgcagggcttcaacaagaaggccgtgaccgacacccacgagaacggcgacctgggcaccgccagcgagacccccctggacgacggcgccagcaagctggacgacctgcacaccctgtaccacaagaagagctactag

SEQ ID NO: 83532 - DNA, 1659 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgctggagacctgcatgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83533 - DNA, 117 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgtag

SEQ ID NO: 83534 - DNA, 1821 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgacctacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctggccgagatcctgcaggccaacgacaacctgacccaggtgatcaacctgtacaagcagctggtgagaggcgaggaggtgaacggcgacgccaccgccggcagcatccccggcagcaccagcgccctgctggacctgagcggcctggacctgccccccgccggcaccacctaccccgccatgcccaccagacccggcgagcaggccagccccgagcagcccagcgccagcgtgagcctgctggacgacgagctgatgagcctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83535 - DNA, 1920 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgctggagacctgcatgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctggccgagatcctgcaggccaacgacaacctgacccaggtgatcaacctgtacaagcagctggtgagaggcgaggaggtgaacggcgacgccaccgccggcagcatccccggcagcaccagcgccctgctggacctgagcggcctggacctgccccccgccggcaccacctaccccgccatgcccaccagacccggcgagcaggccagccccgagcagcccagcgccagcgtgagcctgctggacgacgagctgatgagcctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83536 - DNA, 1971 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgagaagaggcgaggccaccatcagaccccccccctgcgacgacaccaaggtgctggagacctgcatgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctggccgagatcctgcaggccaacgacaacctgacccaggtgatcaacctgtacaagcagctggtgagaggcgaggaggtgaacggcgacgccaccgccggcagcatccccggcagcaccagcgccctgctggacctgagcggcctggacctgccccccgccggcaccacctaccccgccatgcccaccagacccggcgagcaggccagccccgagcagcccagcgccagcgtgagcctgctggacgacgagctgatgagcctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83537 - DNA, 1701 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagagatgcgagagaatgagacccaccctgttcagactggccagcgacaccgaggacaacgacgaggccctggccgagatcctgcaggccaacgacaacctgacccaggtgatcaacctgtacaagcagctggtgagaggcgaggaggtgaacggcgacgccaccgccggcagcatccccggcagcaccagcgccctgctggacctgagcggcctggacctgccccccgccggcaccacctaccccgccatgcccaccagacccggcgagcaggccagccccgagcagcccagcgccagcgtgagcctgctggacgacgagctgatgagcctgggcctgagcgaccccaccccccccagcggccccagcctggacggcaccggctggaacagcttccagagcagcgacgccaccgagccccccgcccccgccctggcccaggcccccagcatggagagcagaccccccgcccagaccagcctgcccgccagcagcggcctggacgacctggacctgctgggcaagaccctgctgcagcagagcctgccccccgagagccagcaggtgagatgggagaagcagcagcccacccccagactgaccctgagagacctgcagaacaagagcagcagctgcagcagccccagcagcagcgccaccagcctgctgcacaccgtgagccccgagccccccagacccccccagcagcccgtgcccaccgagctgagcctggccagcatcaccgtgcccctggagagcatcaagcccagcaacatcctgcccgtgaccgtgtacgaccagcacggcttcagaatcctgttccacttcgccagagaccccctgcccggcagaagcgacgtgctggtggtggtggtgagcatgctgagcaccgccccccagcccatcagaaacatcgtgttccagagcgccgtgcccaaggtgatgaaggtgaagctgcagccccccagcggcaccgagctgcccgccttcaaccccatcgtgcaccccagcgccatcacccaggtgctgctgctggccaacccccagaaggagaaggtgagactgagatacaagctgaccttcaccatgggcgaccagacctacaacgagatgggcgacgtggaccagttccccccccccgagacctggggcagcctgtag

SEQ ID NO: 83538 - DNA, 123 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaactag

SEQ ID NO: 83539 - DNA, 330 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgtag

SEQ ID NO: 83540 - DNA, 270 bp, Artificial Sequence
  Description of Artificial Sequence: Synthetic coding sequence
atggagcccgccatggagcccgagaccctggaggccagaatcaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgagaagaggcgaggccaccatcagaccccccccctgcgacgacaccaagggcggccaggactag

SEQ ID NO: 83541 - DNA, 330 bp, Artificial Sequence; identical to SEQ ID NO: 83539
  Description of Artificial Sequence: Synthetic coding sequence

SEQ ID NO: 83542 - DNA, 327 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgtag

SEQ ID NO: 83543 - DNA, 57 bp, Artificial Sequence
  Description of Artificial Sequence: Synthetic coding sequence
atgaagagctgcggcaagagattccacgacgaggtgggcaagttcagattcctgtag

SEQ ID NO: 83544 - DNA, 183 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgcctag

SEQ ID NO: 83545 - DNA, 87 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtag

SEQ ID NO: 83546 - DNA, 741 bp, Artificial Sequence
  Description of Artificial Sequence: Synthetic coding sequence
atgacccccggcaccgccaacagagccaccaaccccctgaacaaggagctggactgggccagcatcaacggcttctgcgagcagctgaacgaggacttcgagggcccccccctggccaccagactgctggcccacaagatccagagcccccaggagtgggaggccatccaggccctgaccgtgctggagacctgcatgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggcatcgtgaagagcgaccccaagctgcccgacgacaccaccttccccctgcccccccccagacccaagaacgtgatcttcgaggacgaggagaagagcaagatgctggccagactgctgaagagcagccaccccgaggacctgagagccgccaacaagctgatcaaggagatggtgcaggaggaccagaagagaatggagaagatcagcaagagagtgaacgccatcgaggaggtgaacaacaacgtgaagctgctgaccgagatggtgatgagccacagccagggcggcgccgccgccggcagcagcgaggacctgatgaaggagctgtaccagtag

SEQ ID NO: 83547 - DNA, 213 bp, Artificial Sequence
  Description of Artificial Sequence: Synthetic coding sequence
atgaagagctgcggcaagagattccacgacgaggtgggcaagttcagattcctgaacgagctgatcaaggtggtgagccccaagtacctgggcagcagaaccagcgagaaggtgaagaacaagatcctggagctgctgtacagctggaccgtgggcctgcccgaggaggtgaagatcgccgaggcctaccagatgctgaagaagcagggctag

SEQ ID NO: 83548 - DNA, 2172 bp, Artificial Sequence
  Description of Artificial Sequence: Synthetic coding sequence
atggccgaggccgagggcgagagcctggagagctggctgaacaaggccaccaaccccagcaacagacaggaggactgggagtacatcatcggcttctgcgaccagatcaacaaggagctggagggcccccagatcgccgtgagactgctggcccacaagatccagagcccccaggagtgggaggccctgcaggccctgaccgtgctggaggcctgcatgaagaactgcggcagaagattccacaacgaggtgggcaagttcagattcctgaacgagctgatcaaggtggtgagccccaagtacctgggcgacagagtgagcgagaaggtgaagaccaaggtgatcgagctgctgtacagctggaccatggccctgcccgaggaggccaagatcaaggacgcctaccacatgctgaagagacagggcatcgtgcagagcgacccccccatccccgtggacagaaccctgatccccagccccccccccagacccaagaaccccgtgttcgacgacgaggagaagagcaagctgctggccaagctgctgaagagcaagaaccccgacgacctgcaggaggccaacaagctgatcaagagcatggtgaaggaggacgaggccagaatccagaaggtgaccaagagactgcacaccctggaggaggtgaacaacaacgtgagactgctgagcgagatgctgctgcactacagccaggaggacagcagcgacggcgacagagagctgatgaaggagctgttcgaccagtgcgagaacaagagaagaaccctgttcaagctggccagcgagaccgaggacaacgacaacagcctgggcgacatcctgcaggccagcgacaacctgagcagagtgatcaacagctacaagaccatcatcgagggccaggtgatcaacggcgaggtggccaccctgaccctgcccgacagcgagggcaacagccagtgcagcaaccagggcaccctgatcgacctggccgagctggacaccaccaacagcctgagcagcgtgctggcccccgcccccaccccccccagcagcggcatccccatcctgcccccccccccccaggccagcggcccccccagaagcagaagcagcagccaggccgaggccaccctgggccccagcagcaccagcaacgccctgagctggctggacgaggagctgctgtgcctgggcctggccgaccccgcccccaacgtgccccccaaggagagcgccggcaacagccagtggcacctgctgcagagagagcagagcgacctggacttcttcagccccagacccggcaccgccgcctgcggcgccagcgacgcccccctgctgcagcccagcgcccccagcagcagcagcagccaggcccccctgcccccccccttccccgcccccgtggtgcccgccagcgtgcccgcccccagcgccggcagcagcctgttcagcaccggcgtggcccccgccctggcccccaaggtggagcccgccgtgcccggccaccacggcctggccctgggcaacagcgccctgcaccacctggacgccctggaccagctgctggaggaggccaaggtgaccagcggcctggtgaagcccaccaccagccccctgatccccaccaccacccccgccagacccctgctgcccttcagcaccggccccggcagccccctgttccagcccctgagcttccagagccagggcagcccccccaagggccccgagctgagcctggccagcatccacgtgcccctggagagcatcaagcccagcagcgccctgcccgtgaccgcctacgacaagaacggcttcagaatcctgttccacttcgccaaggagtgcccccccggcagacccgacgtgctggtggtggtggtgagcatgctgaacaccgcccccctgcccgtgaagagcatcgtgctgcaggccgccgtgcccaagagcatgaaggtgaagctgcagccccccagcggcaccgagctgagccccttcagccccatccagccccccgccgccatcacccaggtgatgctgctggccaaccccctgaaggagaaggtgagactgagatacaagctgaccttcgccctgggcgagcagctgagcaccgaggtgggcgaggtggaccagttcccccccgtggagcagtggggcaacctgtag

SEQ ID NO: 83549 - DNA, 2073 bp, Artificial Sequence
  Description of Artificial Sequence: Synthetic coding sequence
atggccgaggccgagggcgagagcctggagagctggctgaacaaggccaccaaccccagcaacagacaggaggactgggagtacatcatcggcttctgcgaccagatcaacaaggagctggagggcccccagatcgccgtgagactgctggcccacaagatccagagcccccaggagtgggaggccctgcaggccctgacctacctgggcgacagagtgagcgagaaggtgaagaccaaggtgatcgagctgctgtacagctggaccatggccctgcccgaggaggccaagatcaaggacgcctaccacatgctgaagagacagggcatcgtgcagagcgacccccccatccccgtggacagaaccctgatccccagccccccccccagacccaagaaccccgtgttcgacgacgaggagaagagcaagctgctggccaagctgctgaagagcaagaaccccgacgacctgcaggaggccaacaagctgatcaagagcatggtgaaggaggacgaggccagaatccagaaggtgaccaagagactgcacaccctggaggaggtgaacaacaacgtgagactgctgagcgagatgctgctgcactacagccaggaggacagcagcgacggcgacagagagctgatgaaggagctgttcgaccagtgcgagaacaagagaagaaccctgttcaagctggccagcgagaccgaggacaacgacaacagcctgggcgacatcctgcaggccagcgacaacctgagcagagtgatcaacagctacaagaccatcatcgagggccaggtgatcaacggcgaggtggccaccctgaccctgcccgacagcgagggcaacagccagtgcagcaaccagggcaccctgatcgacctggccgagctggacaccaccaacagcctgagcagcgtgctggcccccgcccccaccccccccagcagcggcatccccatcctgcccccccccccccaggccagcggcccccccagaagcagaagcagcagccaggccgaggccaccctgggccccagcagcaccagcaacgccctgagctggctggacgaggagctgctgtgcctgggcctggccgaccccgcccccaacgtgccccccaaggagagcgccggcaacagccagtggcacctgctgcagagagagcagagcgacctggacttcttcagccccagacccggcaccgccgcctgcggcgccagcgacgcccccctgctgcagcccagcgcccccagcagcagcagcagccaggcccccctgcccccccccttccccgcccccgtggtgcccgccagcgtgcccgcccccagcgccggcagcagcctgttcagcaccggcgtggcccccgccctggcccccaaggtggagcccgccgtgcccggccaccacggcctggccctgggcaacagcgccctgcaccacctggacgccctggaccagctgctggaggaggccaaggtgaccagcggcctggtgaagcccaccaccagccccctgatccccaccaccacccccgccagacccctgctgcccttcagcaccggccccggcagccccctgttccagcccctgagcttccagagccagggcagcccccccaagggccccgagctgagcctggccagcatccacgtgcccctggagagcatcaagcccagcagcgccctgcccgtgaccgcctacgacaagaacggcttcagaatcctgttccacttcgccaaggagtgcccccccggcagacccgacgtgctggtggtggtggtgagcatgctgaacaccgcccccctgcccgtgaagagcatcgtgctgcaggccgccgtgcccaagagcatgaaggtgaagctgcagccccccagcggcaccgagctgagccccttcagccccatccagccccccgccgccatcacccaggtgatgctgctggccaaccccctgaaggagaaggtgagactgagatacaagctgaccttcgccctgggcgagcagctgagcaccgaggtgggcgaggtggaccagttcccccccgtggagcagtggggcaacctgtag

SEQ ID NO: 83550 - DNA, 1956 bp, Artificial Sequence; identical to SEQ ID NO: 83528
  Description of Artificial Sequence: Synthetic coding sequence

SEQ ID NO: 83551 - DNA, 462 bp, Artificial Sequence
  Description of Artificial Sequence: Synthetic coding sequence
atggccgaggccgagggcgagagcctggagagctggctgaacaaggccaccaaccccagcaacagacaggaggactgggagtacatcatcggcttctgcgaccagatcaacaaggagctggagggcccccagatcgccgtgagactgctggcccacaagatccagagcccccaggagtgggaggccctgcaggccctgaccgtgctggaggcctgcatgaagaactgcggcagaagattccacaacgaggtgggcaagttcagattcctgaacgagctgatcaaggtggtgagccccaagtacctgggcgacagagtgagcgagaaggtgaagaccaaggtgatcgagctgctgtacagctggaccatggccctgcccgaggaggccaagatcaaggacgcctaccacatgctgaagagacaggccttcagccaggccgccgagaagcagaagcccagatag

SEQ ID NO: 83552 - DNA, 1806 bp, Artificial Sequence
  Description of Artificial Sequence: Synthetic coding sequence
atggccctgcccgaggaggccaagatcaaggacgcctaccacatgctgaagagacagggcatcgtgcagagcgacccccccatccccgtggacagaaccctgatccccagccccccccccagacccaagaaccccgtgttcgacgacgaggagaagagcaagctgctggccaagctgctgaagagcaagaaccccgacgacctgcaggaggccaacaagctgatcaagagcatggtgaaggaggacgaggccagaatccagaaggtgaccaagagactgcacaccctggaggaggtgaacaacaacgtgagactgctgagcgagatgctgctgcactacagccaggaggacagcagcgacggcgacagagagctgatgaaggagctgttcgaccagtgcgagaacaagagaagaaccctgttcaagctggccagcgagaccgaggacaacgacaacagcctgggcgacatcctgcaggccagcgacaacctgagcagagtgatcaacagctacaagaccatcatcgagggccaggtgatcaacggcgaggtggccaccctgaccctgcccgacagcgagggcaacagccagtgcagcaaccagggcaccctgatcgacctggccgagctggacaccaccaacagcctgagcagcgtgctggcccccgcccccaccccccccagcagcggcatccccatcctgcccccccccccccaggccagcggcccccccagaagcagaagcagcagccaggccgaggccaccctgggccccagcagcaccagcaacgccctgagctggctggacgaggagctgctgtgcctgggcctggccgaccccgcccccaacgtgccccccaaggagagcgccggcaacagccagtggcacctgctgcagagagagcagagcgacctggacttcttcagccccagacccggcaccgccgcctgcggcgccagcgacgcccccctgctgcagcccagcgcccccagcagcagcagcagccaggcccccctgcccccccccttccccgcccccgtggtgcccgccagcgtgcccgcccccagcgccggcagcagcctgttcagcaccggcgtggcccccgccctggcccccaaggtggagcccgccgtgcccggccaccacggcctggccctgggcaacagcgccctgcaccacctggacgccctggaccagctgctggaggaggccaaggtgaccagcggcctggtgaagcccaccaccagccccctgatccccaccaccacccccgccagacccctgctgcccttcagcaccggccccggcagccccctgttccagcccctgagcttccagagccagggcagcccccccaagggccccgagctgagcctggccagcatccacgtgcccctggagagcatcaagcccagcagcgccctgcccgtgaccgcctacgacaagaacggcttcagaatcctgttccacttcgccaaggagtgcccccccggcagacccgacgtgctggtggtggtggtgagcatgctgaacaccgcccccctgcccgtgaagagcatcgtgctgcaggccgccgtgcccaagagcatgaaggtgaagctgcagccccccagcggcaccgagctgagccccttcagccccatccagccccccgccgccatcacccaggtgatgctgctggccaaccccctgaaggagaaggtgagactgagatacaagctgaccttcgccctgggcgagcagctgagcaccgaggtgggcgaggtggaccagttcccccccgtggagcagtggggcaacctgtag

SEQ ID NO: 83553 - DNA, 918 bp, Artificial Sequence
  Description of Artificial Sequence: Synthetic coding sequence
atggccgccggcctggccagactgctgctgctgctgggcctgagcgccggcggccccgcccccgccggcgccgccaagatgaaggtggtggaggagcccaacgccttcggcgtgaacaaccccttcctgccccaggccagcagactgcaggccaagagagaccccagccccgtgagcggccccgtgcacctgttcagactgagcggcaagtgcttcagcctggtggagagcacctacaagtacgagttctgccccttccacaacgtgacccagcacgagcagaccttcagatggaacgcctacagcggcatcctgggcatctggcacgagtgggagatcgccaacaacaccttcaccggcatgtggatgagagacggcgacgcctgcagaagcagaagcagacagagcaaggtggagctggcctgcggcaagagcaacagactggcccacgtgagcgagcccagcacctgcgtgtacgccctgaccttcgagacccccctggtgtgccacccccacgccctgctggtgtaccccaccctgcccgaggccctgcagagacagtgggaccaggtggagcaggacctggccgacgagctgatcaccccccagggccacgagaagctgctgagaaccctgttcgaggacgccggctacctgaagacccccgaggagaacgagcccacccagctggagggcggccccgacagcctgggcttcgagaccctggagaactgcagaaaggcccacaaggagctgagcaaggagatcaagagactgaagggcctgctgacccagcacggcatcccctacaccagacccaccgagaccagcaacctggagcacctgggccacgagacccccagagccaagagccccgagcagctgagaggcgaccccggcctgagaggcagcctgtag

SEQ ID NO: 83554 - DNA, 4497 bp, Artificial Sequence; identical to SEQ ID NO: 75891
  Description of Artificial Sequence: Synthetic coding sequence
